United States Patent 7,745,391 (HUMAN THROMBOSPONDIN POLYPEPTIDE) - sequence listing, part 219

SEQ ID NO: 557425 - DNA, 673 bp, Homo sapiens
aactgtgacgtgagcctaatgtcataacaattcactatagcacgcgtagagcgctctgctacctgccacgctaggtcctggacatccggagcacgctactcatagatcagtacctcttatgcatactgatcagcatttgcggcagcatcatgagaattcaaatcagcgccttataagctaatatcgtactctgtatacggggtcaaccgttgaatagttccgtatatgtgactaaccatcatactcttatccttaacggtgacgaaagtgctacagtgtacagacacacaaactgcagttaaaccaccgatcacagcattcatgtattagttcacattggcacgagcaagcactatcgtcatgacatggacttcttaagatgccaaatgctccagcgtgacgacgcgcattacattctgaggcgtgcaactgcttatacagatacgcagtcttcatcaatactacgaacggagtggatgcgcactgggccaagcatttgaaatggcggccgctactgactgagaattactgtggcacaactgttgcgaccttaccagtctgaccctaactagtgcattgtagatcacttctggaggcctagcgttacaccacaatctttagcgaggatcattatagttatgcccttcagaaccaagcctccgctggcccacgt

SEQ ID NO: 557426 - DNA, 547 bp, Homo sapiens
ccgtaaatgatagatatgactcttcaatggccatacaaatccttagagtcattggtacataaggtgacccctcacaaaagagaatcataatatcccagacacagtcttacgaaggggtacgggatttcatacttctgtaagagcccgtttctctcagtggagtgaatggaaaaaaatcaattaatattttaccaacttctgaaaaagtttaatggacacttcgaattatcttaagcagtacaatcggggatgaatgaatgggcctcagtagtactgtacaatagaagacttctggctactttaactgctcaaaaggggagacctggtgccctaatgggtagaaaggtgtggcgggccgagcgcatggctcacgcctataatcccagcacttggggaggctgagagaggtggatcacctgaggtcaagagtctgagaccagccgggacaacatggcaaaacccggtctctactaaaaacaaaaaaatagccaggaggggtcgtaagcgtctgtaatcccagctactcggctgaggcaggaggtgaacc

SEQ ID NO: 557427 - DNA, 386 bp, Homo sapiens
aaaattcaggataactctcctgaggggtgagccaagccctgccatgtagtgcacgcaggacatcaccaaacacagataccaggaattgatccattccctgtggtcacttattctaagggcccaaaccttcaaaggtcaaggtggtgtatatggatgactccacagagagggagcagccacgcctcacttcttgccttaagaagagagaagatatgacactgaagggagtgtgttcacaccctccacgcgggagacgccctctgtccgatcctaccagagacggaaagctgctggctgcaacctttgctgctggcactgctgtcttgctgcctcacggtggtgtctttctacaggtggcgccctacaggggcacctggccagcctcc

SEQ ID NO: 557428 - DNA, 381 bp, Homo sapiens
  misc_feature (149)..(149): n is a, c, g, or t
tcccaaaaacatttaccctttttggaatgccattgtaaaaaagcgtgtgaggataaagggctgatgcaggacccggtgtgggggacaggggcagaggaatggagaaaggtgggatgtaaggtgggaatcacagggtcaaggggcaagangcctccgggcctctgggggcgcatgggcagagagattgggaaagataggatgtcactgtggagatacagtggtcacgggcaagagcctccgggcctcaatagatgggcctccctggattcttatacgttgggagcctgggacagaccaacattgggggattgatagacagacgcaagaatggggcgctatgagaagatatcgccacaaaaatacaggggggcccaacattgt

SEQ ID NO: 557429 - DNA, 217 bp, Homo sapiens
ctatacaggatccccggtggtcaggttcgccgatcagaaagcactcaatgtcgtattataatcgtctctcaatgaagtaatctctactctcgatgatagcttttagattacttctagtcgatgcctgagctctgagcgaaggctgagctctggggtatcgagctcaaattcgttgtcgtggtcgtagctgtaacctgttctacgatccctggcggtt

SEQ ID NO: 557430 - DNA, 1209 bp, Homo sapiens
gcagtagctcccgattgctggctggcaccctgatggacagccctggcggacgacaggacgcgatggcagcgaccgatatagctcgccaggtgggtgaaggtatgccgaactgtccccctgtgctaggacatgtggggttacgacagctatgcctgaccagctggtgaatacgtcctgtcagaccagtggcttctgcttcaatatcctgtgacgtgggagagacaggtttgggcaaagtccaccactcatggacaccctgtaacaacaccaaattcgcaggggagccagacacaccacaaacagcacgggatgtacagcatccagatctaatacctatgacctccaagagagcaaagtgaggctaacgctcacgatcgttagacacagtatggcatatcggaggaccagatcacccaagcaggacagctacaagcctatacgtggaattcatcgatgcacaattcgaggacctacctgcaggaagagctaacgatccgaagagtgctacacacctaccatgagtcccgaatccatgatctgcttgtattccatggccccacgggtcattccctgaagtctctggactcgtgcacatgaagacgcaggaccagcacaggagaccaacatccccaacatcgcaacagaagatcgccacaacggaccagtgaactaccaaagtcccacaccacactccacacagacactagaccgaccaacagacgcatccaagactcaaacaagacccccacccacagcaagactcgacggaccaacacacacaggacaccgagagaccgaccaccccgcccaaacgcacgacacggccagacaagcacacaccgaagacagacaccacacacacacacgccgacgccgacccccgagcgacacactgtccccagcatggcaccgcccacgaccaccacgcgaagccctgcacaacccgtaagagcaaagcaaagatagcaggaacaacagccgacacgcagagcgcgaaacaccataagcgagcacaaagtcgagcgctgaacaaacaaaagcaacacaaccggaatcgaggaacagaacacacaaagcagaactacgagacacaagtagcgcacacaacacaggaacgcagcaacgaaaacgcgagtcacaaggcaaccggcaggcacgcgaagacgaccagacgaggagagcagagaacacaagagcacgacattccaa

SEQ ID NO: 557431 - DNA, 901 bp, Homo sapiens
tgaagacagaaaaagcgcacgctatggtgtttctcacggttaaaaggtttcacctcccgtggtcacgaaccccaagttgccgatatgtgtcccctgattttctttgaagtccatgtcgcccgtcttaaactcccgtgttccctgagtttagcccaactgtttagtgtcgtggaccaagaaggggtttaaaacaacggcacttgctttcgcgtgtagtgatatagaccctgggcgttagcacccggggccatctctgttgttttcaaaccccgaagtgtggctagaacaccaagatccagacacccacgagggttgggccattctctcgccgatcacccttgagaccagtgcggagaatcatgccagccggggtaccctaaggaagagtgcaaggttgtgatgggcacccccgtgattttaaaaggtgttttttctttttacaatgtaaatgagaatggggttgaagcggcaccaagatttctgcgtgacccgcagttctgtggattaccagaggcccaccacggccagttggtagaatctcgtgtgaagggcttttctgggatacgcttagatagtttgacatagccccgtctctgtatgtactctgcatagaccaaggccacacccactcctgcggtgcttttaatgaagggtttcccggactgcgtttctgctcctgaggctctgttttacagtatgggtgatccctctgcttgtattttgtattaaaaaaactaagcgaaaaaggagccctcttcttgttgagcatgttggccttgccccccttatattttttctctttttgggacaaataagccagttatatcttttttcttatctttttttcttttgaacctttttttttttttttttaaaatgctttattaaagggccttttata

SEQ ID NO: 557432 - DNA, 940 bp, Homo sapiens
  misc_feature (10)..(10): n is a, c, g, or t
  misc_feature (69)..(69): n is a, c, g, or t
  misc_feature (82)..(82): n is a, c, g, or t
  misc_feature (135)..(135): n is a, c, g, or t
  misc_feature (155)..(155): n is a, c, g, or t
  misc_feature (299)..(299): n is a, c, g, or t
  misc_feature (328)..(328): n is a, c, g, or t
  misc_feature (370)..(370): n is a, c, g, or t
  misc_feature (414)..(414): n is a, c, g, or t
  misc_feature (549)..(549): n is a, c, g, or t
  misc_feature (568)..(568): n is a, c, g, or t
  misc_feature (571)..(573): n is a, c, g, or t
  misc_feature (579)..(580): n is a, c, g, or t
  misc_feature (585)..(585): n is a, c, g, or t
  misc_feature (587)..(588): n is a, c, g, or t
  misc_feature (593)..(593): n is a, c, g, or t
  misc_feature (602)..(602): n is a, c, g, or t
  misc_feature (604)..(604): n is a, c, g, or t
  misc_feature (624)..(624): n is a, c, g, or t
  misc_feature (630)..(631): n is a, c, g, or t
  misc_feature (635)..(635): n is a, c, g, or t
  misc_feature (637)..(637): n is a, c, g, or t
  misc_feature (641)..(641): n is a, c, g, or t
  misc_feature (645)..(645): n is a, c, g, or t
  misc_feature (662)..(663): n is a, c, g, or t
  misc_feature (672)..(672): n is a, c, g, or t
  misc_feature (929)..(929): n is a, c, g, or t
ggtgaaatgngaaaccagactctgtgcagtagtattaatgggtgggccaggggctgtgaataacatcancctcagtacaacngcaattccagggcccctctaccacaaagatggcttaagcaaaggcagccaganggaagtatgatatccaacangaaggaagtaggcaggggtcactaaagtagctggtggcccagcagatggaaacagaagtatggccccgagggaaggaggcaggtccagggctacagtgctttcaggtactggtgtttctataggggcatttgccacccacatcnttggaaactcccctggcctattgtgacanggcagggctgcctggatcttgaaggtagagaagaagctagangggaggagctgagcctgtgacgtgcatttgtaccaggtccagangggaaatgatgaggctgcaggctatgatggggccactgtgcactaaatgcttggtaccatcctatgaggggacaaggtgcagacccacattcccataggcacttaaacagaagtgaaaagaaaaaaattccattngttcttttttttttcaggngannngcgggnncccgngnnggacngagaggaanangagtaggacagtgggcagangacaanngccngngccnggcncacgggagaagtctggnngggccaggnatgtgggtgtttggtgcctccatctggatagtgccagcaggtacaccaccctgccttatacctgaatggccagctaaataaccatagagcttaaggtctggctcaggtcaggattccctggctccttgccaacaaagcaaaaccagagattcagaaaactcagggcctaggagaaaacagacctgcctttacaaaccccagagctggtcaacctcaggcttcctctcaggaaaaaaatttttttttttgagatgggncttgctctgtg

SEQ ID NO: 557433 - DNA, 1797 bp, Homo sapiens
  misc_feature (1447)..(1447): n is a, c, g, or t
gggtagaacgccccacagccccgcgtcgagacagagagaaagaaaatgatcgaggtggtccttacggatacagtgcggggtgggatgctcataccaaccgcgacgcagtgatgagaggaccatgcgcgctgtgtcccatgtagaataggagacgcagcggggagacactgcagcatgttgcgtactatgcacagcacgggaggtggtatgaggttcactacgagaacggcgagcacaaataaacgtgtgtgggcgtgacagagcgaggtcgagtcgtggggtacaacacacctaactaagatgcgtgtgggggagcaaattcacgcagcggtcactaccgagtacaaggggtgggaagcccaacaacagaaatcactagtgcagtgcggcatggacgagaggggtgggagcagagccagcgaaggggacgaaggcagggggtgacggactggtcgcagtcccgtccatctgttggtggagagggaggggggggacaaggcaccccacgttctactccacacccaaacatatagattaggggtgggtgctggcgatacgactcacagcagggggggtgctgctctaaagtgtatgatgcactactgaagcagagtggggtaggtgtcagacacgcagggtgagtaagatgacaaccattgagggtagggttaatgcgcacgcccaaacgttgggtatgtatgatcgtcagcatgtcgggctctggtcaccaagaagcggggtggtggtcggcgcgcgagcctacactcatgtttgtgtatcgcagagtgggtgtgagggtgcgcgcaaaaggtagcgctgggtctgaaacacacacgctctgccccctcgccgcggtcgtggcgtctcggagtgtgggtcagcactgcagaccacacgcgcgaggggggccacacacgccgcgggctcgggtgcggtggcatgcccctacacagggcgggggctgacgcggcggaggcatcacactctccgacgcacggggtgggtctctctctgcgctgggtgtggggttcgagggacacacacaacacacacaccacacagcacgcgctgggggctgcacacgaagagacacacgcggcgtgcggggagggacaacaagcggagagtggtgtggcgtcgtctcatcacacacgcgcgcgcgcgggatgcgatgtgcgctgtgcgtcgcgcgcgacgggcgcgcactgcacagggggccgcgcactgctgtagatatacacagtggacacggcgagtgtcggctctctgtcgacagcccgagagggcggaccacagcacacacgcgagtgagtgtgtccgtgctccacacacacacacgcctgcgcgcgcggtgtgagacagcggctcgcacgcgcgcgcgcgcgcgcgggcggtgcagagctcagcgcgcagcgcacagcactgcgctgtgcggggggcgcggagngcaacgccacgctaggcgtgtgtactcatgcgcacacacacagcacacacaccacaccgacgcgcgcgcgcggcgcgcgcgcgcgccagtgtgcgcactggtctctccaccacacacaacacgcaagcccccgcacgcgcgcgggagccacaccaccgcgcggggcgctagcgccagggggagtgtcactggagtgggcgggcccaccaccaacacacactcacaccgctcgtcacgtcgcccacaccacaggcgagacaagcgctgggggggggggggggcgcgcacccccccaccgggggggcccccacctgtgtgtgggggaaggtgtgtgtgtgtgtccccccaca

SEQ ID NO: 557434 - DNA, 94 bp, Homo sapiens
tgaaagactttttttaacccccctttttttccctacttcccccactgccagcgggggcccatttaaaaaaataggttaaaggttggtccttcca

SEQ ID NO: 557435 - DNA, 381 bp, Homo sapiens
  misc_feature (129)..(129): n is a, c, g, or t
  misc_feature (203)..(203): n is a, c, g, or t
  misc_feature (281)..(281): n is a, c, g, or t
  misc_feature (340)..(340): n is a, c, g, or t
  misc_feature (370)..(370): n is a, c, g, or t
ttccacaagcctctttgtgactgtagaactattgtagaaaaaaaaagttcttttctatattataaaagaaattatccaacacagtaatattggtacctgtcattttttcacttctgtttaactcactgntagtgactttgatgccttttaaaataagagctttttcatttcattccatctttaaaattttttatctttggtgnagaatattactattttaagaaagataaattctctttaaagagactctagccggtgtgaatagagcttcagatcctctnaaagcccatgtccaaaggaagccccgctatcctgctggtatatagcttttcctggttgnacctctttggctttggtcatggggacttgnagctggggggg

SEQ ID NO: 557436 - DNA, 263 bp, Homo sapiens
ctcagcgtctggagatcggaaatcagaactgaagaaagttcagacaggagctatcacagacatgcgggggccttgcgttgactgccagtatgaaacttatgcttcaaccaattctcatctaacagggttctttccttactgccaattacaatgtctttattgcattcaagtagactcttttcaaacaggataaccatatccatataaatagatcgtctgatcatatactgaatcaaggggatgctttaaataatatatataac

SEQ ID NO: 557437 - DNA, 595 bp, Homo sapiens
tagtatcctcaggctgttgccattctgctcctgctgtcaattttcaagcttcaccagtatcatgtgaataaattggtaaagattagagagtcctgaatcataagctcttatgaggattctcaattttccagtacgtttttgagtattttctcttggattagttaagtctttatgatggctctaagctcagctttagaccatggagtaaaagtggttacagcaggcaggctggttgactagagagtctcactttgtaaggcatttgtccaacttcccctttttcattagcctcaaggagaaaaggtaactgagcaaaagggttactgtactcaaagcatcgaggcaaagaagagacagagaaggagcaatccaggttcatgtgctgcatgagcctttcatttgcgttttgtaaagaatcttttaggcaattttagatttgtataatcctttagatgcctctgcataccgatttaaaatgcatcccgttgtttttgtggcgttttcgatcctttcttttctaatgtgtcccataaataaacagttttatttaaagtttcctcatcgtggccattttaattctaagttgttcctagta

SEQ ID NO: 557438 - DNA, 550 bp, Homo sapiens
tagtatcctcaggctgttgccattctgctcctgctgtcaattttcaagcttcaccagtatcatgtgaataaattggtaaagattagagagtcctgaatcataagctcttatgaggattctcaattttccagtacgtttttgagtattttctcttggattagttaagtctttatgatggctctaagctcagctttagaccatggagtaaaagtggttacagcaggcaggctggttgactagagagtctcactttgtaaggcatttgtccaacttcccctttttcattagcctcaaggagaaaaggtaactgagcaaaagggttactgtactcaaagcatcgaggcaaagaagagacagagaaggagcaatccaggttcatgtgctgcatgagcctttcatttgcgttttgtaaagaatcttttaggcaattttagatttgtataatcctttagatgcctctgcataccgatttaaaatgcatcccgttgtttttgtggcgttttcgatcctttcttttctaatgtgtcccataaataaacagttttattta

SEQ ID NO: 557439 - DNA, 513 bp, Homo sapiens
  misc_feature (6)..(7): n is a, c, g, or t
  misc_feature (47)..(47): n is a, c, g, or t
  misc_feature (56)..(56): n is a, c, g, or t
  misc_feature (75)..(75): n is a, c, g, or t
  misc_feature (93)..(93): n is a, c, g, or t
  misc_feature (100)..(101): n is a, c, g, or t
  misc_feature (166)..(166): n is a, c, g, or t
  misc_feature (205)..(205): n is a, c, g, or t
  misc_feature (311)..(311): n is a, c, g, or t
gccggnnaaaacaaacagcatattagttttacaaggcggccccaccnactacaganagactagatgttaacaaangagccgcgcccccaaccnaaccaannacacacaaaaaaaaagggacacgcacaagaccgcaacagaaaccaaacaagaaagcaacataccnacaaaaggcaggggaaagcagacagccgacaccaaacgngactcacttaagaatcaccgtggaattctataacttagacatacaaacttgtctttcaaatgtacaacactataaatctcttgactttatctttttcaaacactangtaagacaagattatcttatgcacgttatacatgacagtttttacacgcttagacacttataccactcaattccataccaaacattttattactttaaaaagcattttttaaatccttttttttaaaacttatttattttcatttcaaaaaactttccaaaaaacaaaaatttaattgctcattataattttttccaaaaaa

SEQ ID NO: 557440 - DNA, 100 bp, Homo sapiens
gacgtggggagcagagcagcaggagatagaaccttccagaaagtgggcagctagtggtggtgcctatctgggagaagcagcagaagatacacatggccat

SEQ ID NO: 557441 - DNA, 196 bp, Homo sapiens
gatcaagccggtacctgtatgggatgaggattggctggcttcaaggaatatgagggtggtttgatcttctctccagatcactcaaactttctctatgtcagcaatgaacctgtttcactttcttatttgtgtgttcaccagagcactttacatttccttcaagaactttttttttgtggaggtgggaggagaggaa

SEQ ID NO: 557442 - DNA, 138 bp, Homo sapiens
atgggatccccgggccatcaaacccttcatcgaagcaatataagaaggccccccaaatactccgttaatggctgtagtggtctacttgtagggtttcgatgaagggttgatgacaggctttgatgaagggtttgatga

SEQ ID NO: 557443 - DNA, 751 bp, Homo sapiens
gcttgcgctgtgagctgaggcggtgtaggtgcggtaataacatgtctatccccgcatgccgtgcatcgtgacccgccgcccggataggccggccgctgcgggccgagttttccttgcatggaagtgggagatactggggcacggcatggcgcatgaagcacttagcagagtatcacgaagttcacatatcaaaatatcatctgcccgcatgcgcctgtttaggcctgttcacatataatatatgaacgtggctatgccttcatggttgtgatattattgggcttgcaccagattcacagagaggatgaatctgggattagacaggtcagcaggaaaatataaaaggctttgattgatgcagagaagtgtagagatatggcattccttctgaactagaatgtatgtaggtgagggttggtactcaagggaggagctttatctttatatagtgcccttacctatcaaaaggagaaactggacgaggtgtcacatgcgactcagtatgctggtttccactttcgggtcattccttatccacatgggtcctgatcgagtggtgctaattagacgatatttctattctgcagtgccacaggggaatttgtgaccctttggttcccctgatgtattggtctctctgacggtggaacaatacgtaaaaaccattggtggaatccaggccaaatgtgaacctttataaaacctatgacaggtgtgagtgcacaggttcgtgtcgaccaggacaatgatg

SEQ ID NO: 557444 - DNA, 393 bp, Homo sapiens
caccggaccatgctgtgcccacagaaatgtggacgtctgcaccctccctgccgcgcctgttacgggagcccgtacgctgcacctgctctgcgcatggcaccggcttctcctgccccagaagtgtgggcagggcacccgccccagatgcggatggtcacaggcgacatactgaccgacatcaccggtcacaatgtctatgagtacatgctgttcatctccgaccgcttgcgaatgaaccggtatgggtccattacctttggaaacgccatgaagtacacttaagcctcatttggcaccaaggccccacccatggtgcggaagatcgcggtgcgcagggctgcccaggttttctacaacaacaagggctatcacagcatgcccacctacctcaac

SEQ ID NO: 557445 - DNA, 221 bp, Homo sapiens
  misc_feature (1)..(1): n is a, c, g, or t
  misc_feature (89)..(89): n is a, c, g, or t
  misc_feature (119)..(119): n is a, c, g, or t
  misc_feature (150)..(150): n is a, c, g, or t
ngggaaaacgattatccagagaagagacctggccagaacctgggtccctgagtcctagccatgcttcccatgtgccttacttgctgaanacccccggactgcagtgtgaacgtgctgtnaatagtgacacgctgggcttcccacaaggcncacctgaggtcttttaagctgtcttatgcagcctatttcttgttttttgggcctttttttttggagatggg

SEQ ID NO: 557446 - DNA, 451 bp, Homo sapiens
cagcttagagccgtaatgagctgcctttgcacaaaggcagcaaaagtggtttccctacagagttatcttctcaattatttatacttgcaacactttcacataatggcagttttaaaatcaaacaaacaaagcaaactgtacaataaaggaaggaggcaagaaggtgcagggaccttttcctttcttttttgaacaccagaagggatggcaagccacataaagtcaatgaatttggttcctggaaaagtctcaggggccttgcaatgaggcgacatcaaagcatttggagattgccaccttggtgagagattaaacatgctctgcatacctgctttgcttttaatctgtcatatctaaatatatgaaggaatgcaaactttatttcttctgtttgtaagtttgtctttgaaaattcctaatcagaagacttgctactcaccccccacatctg

SEQ ID NO: 557447 - DNA, 765 bp, Homo sapiens
  misc_feature (35)..(35): n is a, c, g, or t
  misc_feature (163)..(163): n is a, c, g, or t
  misc_feature (745)..(745): n is a, c, g, or t
accgagaagcgagaagccgagcaaaaagaccgganggggcgaccagagggaagattaggccggccgcagaccagggaagagtaaaactgccctaggaaccctgccagcccgcaaagtggacccccagaaaaggcaaacgaacaaggaaaacagaggcctcgcncaaaaaacggcgacaaaggtgtttggtgcatttacacgggagggtgggggaaaaccccggaggccacaaaaaaaggacgggggagaaagcccccccccaggaaagggaagggagccgcacacaaaccagaagggcacaacacggggggggggaggggaaacaaggggggcaggacccgtaaaaacaggggggcgaatcaacccggggaggagcgcgggggagtgaaaaaaaggagcccccaaaaaaaaaaaaaaaaaaaaagggggggccgcgtgaaacaccagaccaaagcaaagaagggaggggacggcgcggccacccctctccgagagaggagcgggaaaaagaaaaaaaaagggggggagaagatctcaaaggaaaatgggggggtccccccaccacacaggtgggggaccggggggccggggtcaaggggggtaaaagaggtcaccggagcccaaaaccccaggggtaaagaaaaccggtaacgggagaaaaggggggggaaaacagggggccccacacaggggcacaaaaaaagaaaaatgtgggagaagaaggggataatggggcgccaggatnacccgggggggacacctcct

SEQ ID NO: 557448 - DNA, 258 bp, Homo sapiens
cccggatgtacaagtgccgcgctgtgaaagcagctcgacgtgtagaaccagtttctcatcgtatggagcaagctctttgtgctctggccagcttgatacgtatccacccagttcggggacctttcagcttcccggacttattgaggaaggctgtcagagctctcaccaactcctgctggttcacgttttcttacagtatctccctgcattgtgcgccctccgcgctagtctgtcagggaaaagggatgagatcgggtt

SEQ ID NO: 557449 - DNA, 858 bp, Homo sapiens
  misc_feature (778)..(778): n is a, c, g, or t
  misc_feature (811)..(811): n is a, c, g, or t
  misc_feature (842)..(842): n is a, c, g, or t
gcaaacagtgcaacggggccgcgatccgatgtgccccgccgccccacctgagtgattcccctaggcctaagatccggtgaaatggagacacagagcgccgatctttcagatgcccacagtaaatcatttcagaggagtaatttcagaaggaaaatgggtccaacttgaaaaacacggaccatggatcctacgtgggaaaactagaacttggggatcagtgaaacgtacaaccaggaagagcagctccggatggtgtcgcggtcatccccgtgctgcagagaacacttcactatgagtgtatcttctggtgaaaccagttccgaccccccatggggggctactgcatagagttccccgcaggtctcatagatgatggtgaaacccccgaagcagctgctctccgggagcttgaagaagaaactggctaccaaggggacattgccgaatgttctcccgcggtctgtatggacccaggcttgtccaactgtactatacacatcgtgaccgtcacccttacggagatgatgccgaaacgccaggccgaagcccaagcccggggatggagagtttgtggaagtcatttctttaccccagaatgacctgctgcagagacttgatgctctggtagctgaagaacatctccccgtggacgcccgggtctattcctacgctctagcactgaaacatgccaatgccaagccctttgaagtgcccttcttggaattttaagccccaatatgaccctggccctttttgtaaacgagaccccccggccttnttcactaagactttgtattccacttagtttaangtagatttgcccttagctttttcgtaaaatnaaagccccgaaccaga

SEQ ID NO: 557450 - DNA, 821 bp, Homo sapiens
  misc_feature (377)..(377): n is a, c, g, or t
  misc_feature (381)..(381): n is a, c, g, or t
  misc_feature (385)..(385): n is a, c, g, or t
  misc_feature (407)..(407): n is a, c, g, or t
  misc_feature (421)..(421): n is a, c, g, or t
  misc_feature (504)..(504): n is a, c, g, or t
  misc_feature (571)..(571): n is a, c, g, or t
  misc_feature (599)..(599): n is a, c, g, or t
  misc_feature (654)..(654): n is a, c, g, or t
  misc_feature (698)..(698): n is a, c, g, or t
  misc_feature (711)..(711): n is a, c, g, or t
  misc_feature (720)..(720): n is a, c, g, or t
  misc_feature (722)..(722): n is a, c, g, or t
  misc_feature (728)..(728): n is a, c, g, or t
  misc_feature (731)..(732): n is a, c, g, or t
  misc_feature (735)..(736): n is a, c, g, or t
  misc_feature (744)..(744): n is a, c, g, or t
  misc_feature (748)..(748): n is a, c, g, or t
  misc_feature (758)..(758): n is a, c, g, or t
  misc_feature (763)..(763): n is a, c, g, or t
  misc_feature (768)..(768): n is a, c, g, or t
  misc_feature (770)..(770): n is a, c, g, or t
ggtgctctctctctctgggtcgtttgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgcctgtctcggcagcctgcctgctgcctcacctgtgtccctggggagtgctggagtggggatccctgctggggtgctgccctgggcctcgccctgccacgcagcctgccaccgctgctgcctgccctcggccacgtggtcccngacngcgnacagtgggctgggccagcgccngaccccgctgctgnccccctcggccacagcctcggtcaagatggagccagagaacaagtacctgcccgaactcatggccgagaaggactcgctcganccgtccttcactcacgccatgcagctgctgacggcagaaattgagaagattcagaaaggagactcanaaaaggatgatgaggagaattacttggntttattttctcataagaacatgaaactgaaagagcgagtgctgatacctgtcaangcagtatcccaagttcatttttgtggggaagattcttggacccnagggaatacatcnaagactgcngnagagantgnncannatcttgtntggnacggccatgnagaanccagngnaagtgccaaggggacccatttcccttgatgtcctttctgcttgccttagtt

SEQ ID NO: 557451 - DNA, 527 bp, Homo sapiens
ttagtggaccagattctagtgctcagaagaatcagttggttagagagtcatggagagtggtttcagtttacctacagccaatcctgaacttcctgaagatgtcccttgatgtgcagctggcattccttcgacttctcaccagccgagctacacaagaacatcacataatcacagcaaaaatagccttgcatacatggatcagggccagtggaaatgttaagaaccccctgaagctgatggggtccaaatgaaggtgaattcaaggctgaaggaaatagcaaatacacctacacagttctggaggatggttgcacgaaacacactgggtaatgcagcaaaacagtctttgaataccgaacccgcaaggctgtgagactacctattgaagatattgcaccctatgacattggtggtcctgatcaagaatttggtgtggacgttgcgcctggttgctttttatacaccaaactctatctgaaatcccaaaaaaaaataattttactccatatgtgttcctcttcaactaa

SEQ ID NO: 557452 - DNA, 352 bp, Homo sapiens
gtgcagtgcagattgcagcagatcataatgctccaggaaagatttcctcaagaagataaagtgataaactggccgggcatggtggctcatgcctgtaatcccagcactttgggaggtggaggcgggtggatcacctgaggtcaggagttccagaccagcctggccaacgtggtgaaaccctgtctctactaaaaatacaaaaattagctgggcatggtggcacacgcctgtagtcccaggtactcaggaggctgaggcaggagaatcacttggacccgggaggcggaggttgcagtgagccgagaccatgccactgcactccagcctgggcaacagagtgagactctgtctc

SEQ ID NO: 557453 - DNA, 708 bp, Homo sapiens
ggggtttgttatggttttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgtgtattgtaatggaggatgtcatcttttcatagatgctggaactagagtgcactgtgttagatgctaaaggtttgagctttacacaaaatgtcttcatctgtattgttatggtctacaatatatttgaattggcggcagcatattaagatgtaatggcctgttatgtcttgaaaatacttgtttgcctcttccaggcatactgcattctgtggatcagttgtgaacagctttcttccaccttatttgtggacagtgataaacttggaactcaagagttgtacgatttcacaagtgttaaccttttcaaagaggaagaactattgggggtctgaggctaatggaacaagtcaacaccaaaatagaatatgatgctttgtgttaacgaaaggtttcatggtttaagatattttccgggtcctaaaataattttccataatctaataatcccttaaatggcataaaaataagttatggttttcc

SEQ ID NO: 557454 - DNA, 923 bp, Homo sapiens
actgctagctaggtgggtgtggtgccgctgcgcgtgcttttgcagttcgctcgtgtgaagtgttttgtggagtggcgacggggcgggtctactggggacgcccctgggtacccccggttttaaccctcaggcgtttcccccttcgagcgcttcccgttttgtggaactccgcaatttgtaggccactaagaagttctccgctccggcccgcatatgcccgtttcccctttctcgggcttcttctcaattcccggaactggcgccacaacccccacgcccccacaatggggtcccacgcaacaccccgcccctttagggggctttaaaccccccaggaggcctcgtgtcaccctcttcctccgctatcaggtgttccgccccctactaggccctgcccaaaggctgcctctgctttttcgggtcgcccccgcgctttctgccagggttctctgtgcgccccctgggcaacacaggtctctagtcctcgcccggtgttcctccttggcgccccgctaggtctcctctcggggcgaagggtgctctcccaggcgcccacgccccgtacaccaggcgctatgccctatgggagcccgatggtcccgctactcagggtggtgcccctcggcggatacagaggccgaggatctttctcagcgtccctctgtacacacaccacaaggaggcgcctctgtctactcagaacgatgggcgccggtgttactaggcaccggttgccacatattactaaccctgcgagcgcacgcagcacaattgcagctaggcacccccgctgccacgcggcttcttacgtcacatctccatcgccggcctagccatggctcccccggggggtcccatccctctaggggccgccgccccccccccaaattccccccaaaaaaacaacaaccacaaacaaaaca

SEQ ID NO: 557455 - DNA, 271 bp, Homo sapiens
tccttacactagtcaagtgaagcagttggagtggagaaggaacaaaaaaatctgtaactggttgtgatcaattagttgtaaagaccgttgcactttgaccagccttttcctttgaaagaaataattttaacatacccagtaaggagaacgggggccgggcgcagtggttcatgcctgtaatcccagctgcttgggaggctgagacaggagaatcacttgaacccagggggtagagattgcagtgagccaagatcgtgccattgcactccag

SEQ ID NO: 557456 - DNA, 373 bp, Homo sapiens
gtggtgatggttacaaacactaaattgcacgcatagaaatagttatggtggctgggagtggtgcgctcatgcctgtaatcccagcactttgagaagccaaggcgggtggatcacctgagttcgggagtacgagaccagcctgatcaacatggagaaaccccttctctactaaaaataccatacttcgctgggcgtgttggcacatgcctggtatccagctacttcggaggctgaggcaggagaattgcttgaacccaggaggcggagggtgagccgagattgtgccattgcactccagcctgggctactggcactaccccttccctctcatgccgagaccctgtggctgaatctccctgtgtctccgagtgtg

SEQ ID NO: 557457 - DNA, 837 bp, Homo sapiens
  misc_feature (83)..(83): n is a, c, g, or t
  misc_feature (134)..(134): n is a, c, g, or t
  misc_feature (351)..(351): n is a, c, g, or t
ggggcatctgggtgctacagccacccccagagcaagagaatgtgcagtatgctggccttgactttgaagcaatcctgctgcancctggcagccctccagataagacccaagtgcccatggtggtcatgcccacngggggacccgattcatcctttgtcactgaacgtggatgctgttcccagcacatgtctttgcaagatgggactttgtcggtactactagtgaatctatacgtggcgtaccacgggctttgggcaggacaaggatcgctctccactcccaggtcgaatgtgggcgcaccgaggatggtgaacggatgtccaggtattgcagtggaacaggtgcgtccangaggaacactttgatgcaagccatgtggtcccttatgggtggttcccatggctggcattcatttgccgtgaccacgttgatcggtcatgtaggccgagagacctagcgagggcctgcgtggctccggaagcccgtgatcaagcatacgcctccatgattgggctccatgtgagcatacctgactggtgcgtggtggaggcatgggtttcgtttgcagcagtgactgccctgtcagacctcagcgtgtgggctgagatgctggagaacatcgccgcatcagatacatgcctcaggtgaagacaccactgtaactgatgtcgggccaggacggaccgtggtgtgcccttcaaagcagggcatggagtattaccgtgccctcaagaaccggaatgtgcctgttcggctcctgctctatccagaagctacccacgcattatcagaggtggaaggtggagtcagacagcttcatgaatgctgtgctctgga

SEQ ID NO: 557458 - DNA, 322 bp, Homo sapiens
  misc_feature (33)..(33): n is a, c, g, or t
  misc_feature (274)..(274): n is a, c, g, or t
gttgcttgacttacaatagggttatgttccagnagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccagggataatatcagagtacaaaatttgangtacagtttttaactgaatgtgtattgcttgtgccccattataaagtt

SEQ ID NO: 557459 - DNA, 1097 bp, Homo sapiens
  misc_feature (226)..(226): n is a, c, g, or t
ggcgacaacatgcttgcggacctcggcttaatcggaaccataggcgaggatgacgaggtgccggtgcgacggcccgagtctgatctccggggacgaggaagatggaggggcccattgtgctgggcatacgacaaaaagcttctgcgggaatggaaccgcatgtgctgatttcacccctgcattctcgtttctcactgcatgacaggaggcgtgcacgtacgatggncagctgggccctgcgctgatgtcatgagccaactcaatgaatgaacgcacgggcacgccaactacagttacactgacgcacagacttgagaacacgcttcgacaagcagacacaggcacccacccgagtgataacaggcaagcctgaggctctggcgacagttggcatcacacggcacgaagagaaagcacgcgcggcaccacgctcctcgcgacctcagcgcatactgcggacgcacacgttctacatggagaactgtactgaagcgacacggccttccacaagagagtgaccgcccatcgcagacggtgacttacctcactccagcgtgactgcagagacactcgctcgaccagaccgccagaatacttactcgacaccctacgctgcgctcagtcaaacggacagaccgagtgatgccctgcgagccgctaccctggatggcctgggcccgcatagcatgccactcgtcgctctccctgccgcaccggcgctcatcgatcccccggcgcaagtgacccactttctctgctcccatttgtccgctcccgtgccttcgtacccgctccttgaggggccactcgacgaactccgcccctcgggcttgcgaattgccaggacaaggcccttgccggtgccccctggttgcgtgtcctcctctgcgcgcgccccagcccccgtgcgtgtccctccttgtcttccccaccaacctgcccgaccccgcgcctactgaccctgtaccctaccgtctggcgcaccgccgcctgggttgcggctccctgggccctgcccctcacacacacctacctcgacccaccgtgctgcccactcccaccccgcgcttgcccggcctgtgccgatgccgcagccc

SEQ ID NO: 557460 - DNA, 1293 bp, Homo sapiens
agcgggttcctctcggaccggagacggcaaatggcggacttcgacagctacgaggatcgggcctactgcagcttcggcggaggctagagggtccatgcgtgcagttgctggtggctcattgggttccctgtatccagaaggagtagcgccactagtagcccgcgcgcatacacagtgatatcgtacggacacatgctacctttcagatacggcttcatgggcagacgataagatgcttatcgtgtgaaggactctcatgcgattcaacggagttgtacggctaagtcaacgagacaaaggacaacttgattgagatttacgaggacttctggctactagtagaattcggattgaacgctggggtgtccctgataacggaagtgccttgagtatacagacttgggtagcactggatcaggagcgaatccgtgttccactttgtacggtcgtttgtggaccactatcgcatgaatacggccgggcaaagcagccacatgcatacaaaggagcttgcgcctggtggcggaattttctaggaatagacatgggttcgcgaactcgaggtaatttgaaccacgacgttggcctctacgaggtgggaattcggaccttctcctttacagtgtcggagccagaggggggaaggggtcagggtcccgggcggccccaggggacgagatccccgaggggcttgagacaccggatggggcgcaccctctcccgatgggggttggccacagctccagagctaaagccacgaaatgaagttgggagacgccgtaacccgacggtcggccgaagtgaggataaccccgaaacacacagtgggcaggtagtcggcagaggcaagaagagtcccgcagagtcacagggacacatggagcgtgaaagagagggaaaggccgactagggaagggaacgccaactagagaacgttcccacggtcggtttgaaaacatcgctactggagacccaatggtgcgcggctggggagtgtcgcgctcacctacaataagttggcacaacggttaaggaccccagaagattcgcgccaagatctttccttggcataaatttcgtatacatgagggaggcgaggtttggccacaaggggttcgattaagcaatcgaaagagtgacagcggttctgcgcctacacagagacattgtggaagggacgatcgggaaaagttggatgagctctttggcgcggtgtattggcgcgcgagaggggcaagctgggggggcagtatgcgaggtgaggttttatgtagcggcggagtgagacacacc

SEQ ID NO: 557461 - DNA, 1444 bp, Homo sapiens
  misc_feature (383)..(383): n is a, c, g, or t
  misc_feature (497)..(497): n is a, c, g, or t
atctcgcgtgctggcggctgcgtccgagagttcaatacctaaggcagctggaaccgaaccatggtcaactggtgagcgtacccttcaattgccgaatcaacaaccaagatggaggtccacgcagaggtgtctatgtgtgcgacgagattcatcaagacgttattgagcacgagaaggattccgccctatgtatagtgctcattgaagagttcaattggcaaagactataccagaaatgaattcctctcttcaaggaatagcaacgtaccgattgggaacccttgacaggggaaccggtgccaatatcttttaggcgcagtggctcgtgccgatggaaaagtgatcgaattggcaactttcacgagggctctggggttagatantgtcccagtaggagtcttcgagcggatgcgtgcgcatgggaattccgttgcggttggagacgcacttggcgccccgagagtctactcgcctactgcgaagtgaaatgacgccanagctctcgttagcacaatcactgtctcaataccgctcttgggtggactcaagtccctgtagtgaagtaccttttccttggtctataaacaaacgtatagggcaatgagaaaccaatttagatgagccatttcggcgcaagttggatatacttagtacgcggatgcaagttagcgaggcaagaaaagagacgattccgggcgtatagctaagagtatatcaacactctagaagagaaactagggttaggatttaacagagagaagcctaggtgtctaccaggaaaccgtggggaattcctagtggacagtagaccaggggagcgagcaagacccaacaatttggcgtatattcatcaattccaattttcccccctcctttccccaatggggccacaggaaccacggacttgttaggaaaatcctagttaatattaccagggaaacttcaattcataacttctgggcagcggagaaggctcttttggaggctggttgaagtttcttcccctggtgacaagtggtttaacccatatccccgaaccattctgagtgtaaaatggtttcgttacccaggaaaaaaaagaaacaaacaggagggagggcggccaaaagaaaaggcacgcaaaaagaggggcccccaagattgatacacggataccccggattttctttgtgccacaaaggtggccccccaataagagggacgacgatcataaataacagcaaagggacgcgtggaccggccgatgtatcacaagcagtcgcgacgtggggacacagcgttagctcatgacgactcattgtgaagagagccccctatctggcgcagcggcacaatcgtgacagaaaaccactcagcaaaaataatcgaggcaagaaaaatatacagcgcgacgtgtacaaagcacattcatacgaccaggtcaggtataacaacgcaggacaca

SEQ ID NO: 557462 - DNA, 406 bp, Homo sapiens
ccatgtttaccaggctgatctcgaagtcctgacctcaagtgatcctcctgcctcagcctccctgagggctgtgattacatggcgtgagccaccgcgcccagttgagtattatctttacactctaaaccatacggtgttccaccaaagtctcttaactgtatactttagaatagtcagattctgaaatggccggtatataatttactgcataaaatgcatgttgggctgtgagtcaaaaactgcggttgaggttcaggtgcgggttagggacgttgttctctgtatagatcgaggtccatttcggggcttatggataatcacaactggacgtggcacatctatgccgatcgttacccaacagacctgttcctgctagaaggtgggtatggggtcccagggaaggagg

SEQ ID NO: 557463 - DNA, 740 bp, Homo sapiens
atctcggcgcgccaccctagagtttctgtggaccccatgtgcccctctcctctcaaacctctgaaccaagcagtgtggcctggttctctacaggctaacaagtctccaacttctattgagctgcttggcctgtttctttgtcccctgataacaacccagctcttcagtgactacttggcttggtctctcatactcctctcttctccagatctcctgtggttatattgccttttgtcctacaactccactagctccacttcccctgtaattgctcagcttggtccccagagctgtaggtcttctctgtgttctaccactcccacctgtcccagagactgctctgtcacctaacctcatagagctgctctgggaccctaactctgatacttactacaccctctgtaaatgctcagcatgtctctcactcacatctgctcagggttatcctggttcttgagctctcatgttttctttgaccttccccagactttgtgtagctcctcagtcattcctggcatctctctttgccccagatctcctgtaggtgcttgactttgctccatagcaccactcgtccttgttctctgtaagctactgccctgtctctcctgatacagacttgcccaagttatcctatagctgctcagggtaacactcccttcccataaagcccagctattctgtagctgttttccctcatgtcctataccctcacctgcccagtccttccataggtcctg

SEQ ID NO: 557464 - DNA, 400 bp, Homo sapiens
  misc_feature (400)..(400): n is a, c, g, or t
agcaccggcccgaccttagctctcaccatcgctcttatactatgaaccccgctgagaatacccaaccgactggtcaagctgagcctaggactgctatatattctagccacctctagactagacgcgtactcaatcctctgagcagggtgagcatcaaactcagactacgccctgatcggggcactgcgagcagtggcccaaacaatcacatatgaagacaccctagccatcattctactatcaacattactaataagtgcgtcctttctctgcaccgttatgacaacacaggaacacctctgattactcctgccatcatgacccttgaccataccatggtctatctgcacactagcagagaccaaccgcccacttcgatcttgccgtaggatagaccgcn

SEQ ID NO: 557465 - DNA, 932 bp, Homo sapiens
caagaaaacaaacgagagagcaggagtaggacaccatagcccgggaaaaggcacctaaggcaactagcaacacatttgtgcccagcactcgaaaccccggggcccacacacactgggtgtaaccaccggccgctattctttccaagcgggtgatcccgcgtcaaaaccacttcctcacgggcgaactgcgcactcgggaagtacgagacctcgcgcaagtcacgtagggccaccaatgtagcgtgcagcgtcgcccagcccgtcgtgtccgctgaactcccggcggcatccacgcttttgccgcgcgacacacacgtctcccatggtcccaatggggacgcccccccaaggggggcaccacagagtagagccaactctccggggacaccaaaacaaaatggtgccccgaagctttatcccacccccggggcaagaccccacaatgttgcaccccgcgcgaggataacaggtcaccccggcacccccggtgcggcagaaatacgggcacacgaacacacaccaagatccagttgctctgtgctcgcgaaatactagggaaccctgaacccactagtgacgattttccacgggccctcttccaacccggagtgcgtgatgcccgaggaatgaagacgcacgaacttggaagatggggaaatcgcacaaagcagtaaaaatactaggagggaaaaccaacaggggacaccacccccagatgtacctaggagcaggagagcgcacccaaacattatgacgtgggagacccacaacctgggagaacccactttcaacagttttcggcgcccacgaaccgcacgccgggggaaagtcctgccacccgcctccgccacccccgcaagggagagatgtcccggtagtggccccagaacagttccttacaaaaattcttcagggggagcgcaaaaaaaaca

SEQ ID NO: 557466 - DNA, 325 bp, Homo sapiens
caagtagatgagcggtgggcccccatggcggccccgtcgtcgacacggtcatcgggcatcaactcgacccggacctgataggtgacggtgtctgggtgactatcccttccccaccagtaggccgggaagttcgcttgcactggtacggccccagtaaccgcgttgaaatgctcaagtacatagaaacccctggcgatgtacgtatcaaaacacccgcccactatgtgctggaagacctcaagcgcctcgtaaaagtctattggcaagtcagcttgaacgggactgcgcaccgctattccaaagtcgtcacactgcggaattgcgc

SEQ ID NO: 557467 - DNA, 216 bp, Homo sapiens
ttgccagactgggtcgtaaactcttaatctccagctatccttcctcagcctccaaatctgccatccagcaatccttccacctcagcctcggggagggccgggatcacaagccacagaacctagatctctaaataatcttccatagaaatagtaaccataccctctcctatctcaaggcaagaaacagacatgagcctgtcaagaaaagaactagag

SEQ ID NO: 557468 - DNA, 275 bp, Homo sapiens
gaatttaaatccaccttcatcaaactgggaggtggaaaagttgagctgtgacctgaagatccatggctttggaaccagagctggaactgatgaggaaacgaatgtagcaatctctgtaatagtactctacagaaagccaaagaaagcggatccactatgaggcatgacaagtctgacgagctagaagatctccagatatctaagacatttcacagttgataatgatgcatactagtgcatatgtgtgaagcgtgaactagagggatacgcggtac

SEQ ID NO: 557469 - DNA, 549 bp, Homo sapiens
  misc_feature (509)..(509): n is a, c, g, or t
  misc_feature (513)..(513): n is a, c, g, or t
atgttaggaactatttcatacttaggtggctggttccttgagatcaaggactatgtatttttctccctttattactactcatgatgcctgggagaatgctttcttatgtagtgattgaaattcttgtatcattacaaactgtgtttttggtaagtttgcatccctaagaaactcttttcagtaacgatttccacagtccttcatatgatcttgaaatatgatgcctacatctttgtttacctgcccagatattgatcagtatggtaactctgctccagtggttgcttgtgtgtttcaatcacgcatgattcttattggccacattggggcaggaggcggcacattagagggaagaaaaggagcacccaaaggctgatcagaagaagccaaaccagcctagttggtggggaagttagtaaaggtggcaacaagttatatatgggcatataaaaaaaaaagacaataagcccttgagatactgtgtaagcctaaatgatgcacattatggngcangatggaaggaaaaatacaagtgggcagattatcaag

SEQ ID NO: 557470 - DNA, 193 bp, Homo sapiens
  misc_feature (25)..(25): n is a, c, g, or t
gctggtcgatctagaggaccccatngagcgatgaacgtggcactctctcagatggttctttcccacagagcatgctggggtgtagggcaggctcactttctgctctcttctcccattctgaaagggacaccctctcttatgaaaaaagcatttatgtagatattcaggcatttaataaggcccaaattctttc

SEQ ID NO: 557471 - DNA, 144 bp, Homo sapiens
cagttctctggagcgagaatgagcctgtctgttgaaaatcatgcagtactttttccacttcagtcagatcatgaagattccaattagccttatgagttctcacggaaagtaccctgatttgcaagcccctggcctgactttgtg

SEQ ID NO: 557472 - DNA, 808 bp, Homo sapiens
cgccgcctccgccctctgccgccgcagccgcagccatgggcgcgtacaagttcgtgtcggagctatggaggaggaagcagtccgacgtgatgaggttcgtgcagcgcgtgcgttgctgggagtacaggcagcagcccgccatcgtccgcatcaccaggcccacccgccccgacagggcacgccgtctcggcttcaaggccaaacagggttatgtgatctaccgtatccgtgtgagacgtggtggcaggaagcgcccagtgcccaagggtattgtttatggcaagcccaagcaccagggtattacccaactcaagttccagaggaacaagaggtctgttgctgaggaaagagctgggcgcaggcttggtggtcttcgtgtcctcaactcctactgggtgaatgaggacttcacctacaagtactttgaggtcatccttgttgatgttgctcacagcgctgtccgcaacgatccaaggatcaactggctctgcaagcctgtgcacaagcaccgtgagctgcgtggtctcacctctgcaggaaagaaattccgtggtctgcgtggcaagggtcaccgccaccacaagaacaggccctcaaggagagccacctggaagaggaaccagaccgtctccctccgccgctaccgttaagcttacgtggtgttatgtcctgtggaacctgtcctatgctggagtcttttccaccgtcaaattttgctacctttctgtggctgaacgtccaggcatgcctgttgaactatttgctatgtgcctgtgttatgtgaaatttgaatgatttaagtagtccc

SEQ ID NO: 557473 - DNA, 649 bp, Homo sapiens
acgcagcaatgccagcctgcgcataagccgacgccgcatacacagccgcatacagcagcatcatgcctgccgccaccgccgcaggactactatccaagcccgtacgtatgctcagggacccggccccgctacccggagtaggcagcgcaccaccagcctaccagctacggtccccgcccgccactaccaccaacctacgggggcccctgccagggtaccgggccaggcccgactaccgaccccgccgcctagcagtcacctacggcccctacccggggtcgccgcacacccaccccgccaagcagcggggtaccctaaccacacctacctacaggccggaggcccgccgcctaccgcccgcaggcagtacccagggcccggtgtaccagcgcgcctaagcagcggcccagcgtaccgggtaggtaccacaaaggcgcgcaaaactagcctaggccgcggccgaacgccaggtaggccgcgcccgacggcccaaagctaaagcctaggcggaccaccccaagcctaccgcatacgcagcgcgagcggcgaaagccccgccaggagggcccgcccagcaccacccgcccctaaccaccaccaccaccccccacggcgcccccgccccggcgccaccgcgcggaccgcaccg

SEQ ID NO: 557474 - DNA, 585 bp, Homo sapiens
ttacctggtatccccaccccaggcactatcatagcacattgcagccccaaactcctggactcaagtaatcctcctctctcagcttcctgagtagctgggacaacaggcttgcatcactgcacctagctaagccttgcattttttataattgcattgattcaccagaggctagagataaaacagcagctaacaagtaaggaccaactctcatggaacttatttagattttagtggacagagacaagtaaacaagaaaatatcacacagttgtaacaactgtgtaaatataacttaaatggggtaatgacggaaaggaagtgagtagatacttagactgggtgatcaggaaaactctgatatccttggggcttagagtatgccaaggagaggaaagagctagtggtcaaaggccttagggcagaaatgagcgtgaagttcaaggaaataagagaaggttcatgtgcctggagcatagtgttaaagggggaccatgataccgaatgagatttgagaggcagacagtgatcctatcatgtcgggctttaaaagcacccgggtgagttgtttggatcttatttccctttt

SEQ ID NO: 557475 - DNA, 1411 bp, Homo sapiens
  misc_feature (602)..(602): n is a, c, g, or t
gtgcacgtggccgcgactggactggcgacccagattcgggactcacttcatggtcctgggtggtgtggagctgccctgtatacgtgctgttcccctacttcagggtccataatggtagtatggtgccgagggcgaatccgaccacaaaggagacctacgtggggccatgtagtggtactcgcatggttgatttgagatgaattaacacgtgggtccatatctctttatggcacgtggagctcttgtgggagtctacaggccgaacggtggagccgttgaccgctgtgatcatccctccgaatgactttcctcggaggaagagttcagagcagctagtgtaggaagataccttgagagctcagtgcgactcaagagtaggcctactgaatagcgtgactagggtgtgaagttcaagggcaccttggattcaaccaccgagagacgtttcttgcacggagctagagctttgcggcgtgccttgctcgattggagtgacgcttggtggtgttttcccgcgttgcattctcttatgagacgtgggatttgtgctaccgtgggtgagccttgggtgtcaggggccccgcgaaagaaacgacactcgncctgctctacctagttctctgtgagcgaaggaacctcgggcgatgatggcaagggacccacatgtaaaggaatagggtgccggggaagttggtcaactatggtaccttaaagtcacgggaaaatcgtagttgctagttcgaatcatttacccgggcacgtaaattcacgtaaaattgtggcacccgggtagattctcctgctaagagagcccgagcaaagggctacggacgaaaaggaattttccacttctaatccgggtaccaaaatttcggttacatttccgggcgaaaacgcagaggaattggtttgggccttccaagtctttcgaggaaccaattccttttcctgggggaaaatggcccccctaaggggtaagaggccaattggttgccgacggggagaacgaacgtgggtgcggggtgcttccccctcttcctggttggcctttggagaagggctataagggtggggcaatggggagcgcctttttcaagagcgggggctaaggaaatgcatttgggggtgacccctggaagcaaactatgggcgaatgcgaacgagacagtgcgtggcggagagggaacagtccctggaacaccgggggcaaggtaccgtgtggccgacaacgaagccttcgtaccggcgcgaaagaagagtggaacggcccgcattgtggcgcgctggttggcgccctacagctcaacacgtagaagagccgcaacgaatgccaagtgcgtggccgtggacaagtcggtgagtgctgaggagagtgacaatcgaggtggttaccctgtgagctgagcgtcaa

SEQ ID NO: 557476 - DNA, 92 bp, Homo sapiens
gacgacgtataacattttgtatcattcaagtcacacctataaaaaggaaatgttcaaagatctccccatcctgcccttctgtcgtcttctcg

SEQ ID NO: 557477 - DNA, 233 bp, Homo sapiens
acagtctcagggactggtgtcaccatgtacgcatcgcgtgtgatggttcacgcctgtatcccgacactttcggaagcctaggcgggcagatcacgctggaggccaggagtttgagaccagcctggctaatatggacaaccccgtctctactaaaaatacgacaattagctgggcgtggtggcttacacctgtaatcccagctacttgggaggctgcggtgggagaatcgcttg

SEQ ID NO: 557478 - DNA, 170 bp, Homo sapiens
agctggtccaaaaaatcaaaatagctaggtgtggtggcacatgcctgtagcctcagcttctcgggtgggtgaagtgggaggatcaactgagcctgggaggttgaggctacagtgagctgcaaccatgccactgcacttctagcctgggcaacagagtgagaccttgcctc

SEQ ID NO: 557479 - DNA, 193 bp, Homo sapiens
gtatgataaccagggagggtcggtcatacaactgcctcttggataaccagagaacagaagttagagtcagactaactagcatgtggggagttcagtgcttttgctgctttgaagcctatctgtcaattcttcttaaaatacacacatacatatactgccttgggtcctttcgcggcctgattaatgtggctct

SEQ ID NO: 557480 - DNA, 1650 bp, Homo sapiens
  misc_feature (542)..(542): n is a, c, g, or t
  misc_feature (1201)..(1201): n is a, c, g, or t
  misc_feature (1203)..(1203): n is a, c, g, or t
  misc_feature (1477)..(1477): n is a, c, g, or t
  misc_feature (1479)..(1479): n is a, c, g, or t
ctgcggcgtaattacggcacgcagggcatgtctctgagctacatatcaagcagtgtcctgcatacactcatattacatcttcacttccactatataatcatattcaatcacagacatataatcatcatacacaacactcattgcgaatgattcatcatttagtaccttcaatatcacactgcatatcacccatactatcctatatctcatatcactcctcacatcacttctacgagccacatagcaccatatgctcacaataacaatcccaatcaatagatatcacgcacacactgagccaagtcaatcaatcccgatgagaaatacagtacatgacaaccaaatgcatcacaaagctcgcacaatacacaaagatcacacaaccagatgctaactcaaagtcaacaatttctttcacagcacttgtgtgtgcaatccaacaagaaccgactgatagtgagccacaagatgaaatcttggtaaacattaattaaacatagcaccgcacatgacacactagacatagctaatcgtcaacactnattgtaaagacacagcatcactccacagactctgcccataaaatcaagatgacagcaatatcaactatgcgacatagtgtcacaatcaacagttctaaagccacgtccagtactacccactactaatattctatcttagtagagtagtcaacgatgtgacaaactagtacaggacgtcgactagtaagtcttcacatgactatcggactttagacacatcgcttcagacgtttccactactaacaagcatttctccatttcagcctacttccatctctcgacacactaacttgcgttagtgcacaacagactcaggagacgcaacaataacgttctgatacctcagtatgataaccagtatattaaatgtaacgatgacttctaacatagaaattgatgcatgctactacacacgtagatgactcgaagccagagtacatccacatagactagaaattacatacagacatgatatatatacacacaagtgagtagtgcatatgcaagactagcatgataaagatgaaatacaaatagtagcaaacgtatagccatcccaagatggtgtagctctgcaaccattctacatgcataacatcaatatgtcatgcagaagttgtccgacttcaggggagctctcagcaacagcagtgacagancngcaacagagtaactatgtgagaactagatgcatgacagatcgcatgtcatattaatctcatggacagctagtctatacatatgttcatgactatactttgagacatactatatactacaccatgttgtacagtagtcactgcataatatagtacgtcaggacagttaatgatacatgtctgtgtgattcggttagatactaatctacaagagtgtaacattagcacatgcaccgctgcatacacaatctacaacacttggctactactgctagnantactaccttagcgctatgaagacatacgaccatgtagtctgacattggtcacctattgtacgatatgatgatcactggtctgattagaatgttgcatatatacgtatatgacttaatgatacaatacgtactattagctgtgacatactggtattaccttgtataatattc

SEQ ID NO: 557481 - DNA, 842 bp, Homo sapiens
cgcttttgccggacgtgccggtcgcttggtccgcgcaccaggactgtgccttgatcctcccccgtgtgtgagcgcccgggcggatcggatatttgagcgctttctctggggggaagggggcttttccccccttcctaggggggcccgattctcaagaaccctggggagatctgaggagacgcctttgggcttgcagcgcccaggtgccgtgttccccagccatctccccgactcgcgatgtgtctccccccctccgtcgccgggtttcaatagtcatgcctctcttgcgcccgggtgcaacgggtatgtggccacccgggcgccccctctggagagtctcctcccgaaaaggccctcctcttgtggctcggccgccttctgacccttcctgggcttccaaggaaggcttctgtgagtctttctggtgggccgccgccaccttctcccggcccctcctgcgtggccctagaggacttaggatctcctcttgatccaccaatcggggttctttccccccaccccggaattctgtctgctttaacctgggataccaccggagcccttcctggcctggatggtggtctccccagcgttcccccgcgcacagcttgcgtccaccccctgagttggtgcagcatacccctagacttggtgctgcagttgggggaccccctccggagttagatagcgcgcccgggctggggttggcccccggagggtcaggggaccctattttttattccctctttttctcattccccccacattcctcccccccttccattatttttttgtaaagattgaagccctactttttggatgaatatttttgaagctggtta

SEQ ID NO: 557482 - DNA, 442 bp, Homo sapiens
  misc_feature (422)..(422): n is a, c, g, or t
gaattcggtacgagttatcataaaaaggattacaggtatgagccaccacacccagcctgtttgcaaattcattccttcccgagcctttcagcagtggttctcaatttgaatgtgcataggaatatcttagtactgttaaaaatgtagatttcaggccacacttccactaatttgatagggctggtatgggtcctgggaatctacattttaaaaaatatttttaaaataataacttatccgagtcacatggcaccaaagtgtgttagcagccaaaagtatctgttcgggtctgcagcagccccaattcttgcctcctcaggaggacagaaggagagaccgagacaagttttaggagcagggagtgaaagtttatttaaaaagccttaggagcagggaagggaaagggaggaaaaatacacttngggaggaggggcccagcagg

SEQ ID NO: 557483 - DNA, 883 bp, Homo sapiens
gactcggattcgttgcctgagcaatggctgccatccggaagaaactggtgatggttggtgatggagcctgtggataagacgatgcttgtcttcatagtcttcagcgagtaccagttcccagaggtgtatgtgcccacgagtgttctgagaactatgtggcagatatcgaggtgggatggaaagcagcgtagagttggctttgtgggacacagctgggcagcgaagcattatgatcgcctgagggcctctcctatccagataccgatgtgtatactgatgtgtgttgccatcgacaggcctgatagtttagagaaacatcccagagaaagtggacccagaagtcacgcatttctgtccctgaggtgtccatcatcctggtttgggaataggaaggatcttcggactgatgagcacacaaggggggagctggccatgatgaagcgggaggccggtgacacctgaagaaggcggagtatatggcaaacgaggattgtgcgcttttgggtacatggcgtgttcagcaacgaccaaagatggagtgagacaggtgtttgacacgtgggtaccgaagagctggtctggagagtacgactgttgggactgaacaaatctgggatgtcttggttgttgtggaacactctttggtggcatgtaacagagttagttggggtgaaaattgaagtggcgggtcaattgattgtgagtggtagtggatacgggctttagggggatggaataatgagtaaaatagactcagagtatttgcggaggggttgggaaggatttatgttaggatgtcaccggtggcgaagggcttggaaggggtagagctatttggccgtaagagggcagagattaaagagttgaaagagggcttgagggc

SEQ ID NO: 557484 - DNA, 787 bp, Homo sapiens
gagacagaagtgtgagctgcctcggggcaggcacatgggggaaatggggctgaggtgggtctgaagacagatggtccttgtgactacgtaagccagtatctgctgcatcataggagcatcgtacagtgcggtggacgccggcatggtacgtgaggacggtgtcccagatgccaatgctggtgtccattagtgggtcatgtgcactataaactacgagatcacggtctttcatgtcccattacatcatggccgagtatattgcactactttgaaatcgtacaatgaccaagatgcgaccaggatcagaggttccttggggaagacccacctacgaagttggaatgagaccatcagatgtgataagggaaactcttctagatgtcaacataaccaagcttataaaggactaaaaattcatgagtagaacagggaaaatcatcctgactcatgtggtgtgtctttatttttaattttcaaagaggctcttgtatagcagttttgtctattttaacattgtagtcattgtgtacttgtgatatcagtatttcttaagctttggtgactgtttcaatattacccccgtgaaagcttttcttaatgtaacttggagtaccattttaattggcttctatttttaaaaaatcaaaatcattagtcggggcttacctgttcttgtattgtatggcatatacattcttgctgggatatatttctactcctggaccaaaggttgtaagaacaaataagatttcggggagggaatggggaggggcacaaatttattggg

SEQ ID NO: 557485 - DNA, 357 bp, Homo sapiens
atcataactatttatatggctgaatttaggtctttattttgatatgtgttttctatttgtttcatcttatttgttcttctgttcctcctttacaggcttattaaataaaaaaattttagcatatcatttttattcctctatttatagttttaagctatatttatttgtgtgagtatgttttacttgctctagggagcacaatgtgcatactaaccacaacctacttcatattaatactgttaatgcttcatgttaatacaaaataaagttgcgccagcttatctacctccttgaccccttcaccttgtgatattattgtcatacccaaatctgctttacttcctgtgcatttatagt

SEQ ID NO: 557486 - DNA, 228 bp, Homo sapiens
ggtattgtgccatcgtgagtcatgagatcctccctggatgtggaccatgacttgaagcgctgctagttagtgtgaccgagaaggtgctggctgctgtcatactagaggctctgagtgaccaccacatctacctggaaggaaccttgttggaagcataatagtcgtcaccccaggccatgttgccctcagaagttttctcatgaggagatagccattgggccagccgtg

SEQ ID NO: 557487 - DNA, 248 bp, Homo sapiens
agattgtctacatggttgggagcgtgttatgacacagtgaacaactatgctatggacatgctccaatgactattgtcgactcagttggtgttaccctggtgaatctaagccttccattatgtctgccagagacttggagatcagtcacattatcactgtagcccaaagagagaggctattaccacttaatgcggttataaaccaatttattgcaccagcgttgattgcgagtcgtgcatgcaccgaat

SEQ ID NO: 557488 - DNA, 410 bp, Homo sapiens
acccccagatgagaaccactgctctaggtgtttaagaaatacaaataagtatttttattttttcagaaatactttctgaaaattactggtatcaaaataccataccggccgggtgcggtggctcatgcctgtaaccccagcacttcagagaggccggggcgggcggatcacttgaggtcgggagttcaggaccagcttggccagcatggtgaaaccccatctctactaaaaatgcaaaaattatccaggcatggtggcgggtgcctgtaatcccagctacttgggaggctgaggcaggagaattgcttgaacctgggaggccgaagctgcagtgagctgagatcacgcaactgcattccagcctgggcaatgagagggagagtttgtctcaaaacaaaacaaaacaaaac

SEQ ID NO: 557489 - DNA, 158 bp, Homo sapiens
caaaaaattaaccgggggtggtggggggggcctgtagtcccacctccttgggaggcttaggcaggaaaatagcattaacctgggaggtggaggtttcagttaacttagatcctgcccctgccctccagcctgggtgacaaagcaaaattgtgccccca

SEQ ID NO: 557490 - DNA, 874 bp, Homo sapiens
ggagagagaactagtctcgagttttttgggtttttttttatttctgaagcccgggaaaaaacatggcaacagaaataaaaaaaaaaaaagtcgtaaactctacaagcaccgtggatatgtgaggttgggctgcaacaaaaatgtcatctgcattgtgcagatggaaaagagcagaagctgcctgttgcctgtggaactgtcccaagaacactagcactgtaaaacgggccctgctcttgcagaagcacggttgcacccacaagtctccatgtcaagaccaagggcctcctggaaacaccaatctctgacaaaagggagtcatctggggagcccgaaaatcctactcctgggccgggcacagtgggctcacgcaccaacatgggaagaaaccccgttctctactaaagaataccaaaaaataattagccaggctgtgcgtgtgcgcccacctgtaatcccagttactcggaaggctgaggcaggaaaatcaccttgaacccagggaggcagagttggcagtgaatggcaaattgcgccgctgaactccagcctgggcaacagagtgaaactgctctcacaagaaaaacacatattcgcacgggcatggttcccgaagcacactttgtggcaccaaaggtgcaacgagaaaattccccatttctgagtgtcctaagtggggtacctccgaatctaaccacgggacttgggtacagtcacgtgtacagcggggagcacacgtcacactagggaaccgtgtccagtgtacccccggggtgacagcgaagctgcggaatttactacctaggcccaatttcactggttaatccctaattcacaatgtccagaataagcaaatctccatataaggagctta

SEQ ID NO: 557491 - DNA, 336 bp, Homo sapiens
cttttctataaccaaatagacaggaatggaagattctcctcggggcctgaaagcttgcgggatgaataactcctcctcctcaggcccagtcccaaggtacaaacttgcaccagcagcaagatagcagaggcagtaagagagctggctggaagacacgtaccccctgaagatcaagagggaggtcgccctggtactacatagcagtcacgttaggctgggacaattcctgtttacagaggactataaaacccctgccccatcctcacttgggctgatgccattttaggcctcagcctgtctgcatgcaggcgctcattaaaacagcatgttgctcca

SEQ ID NO: 557492 - DNA, 285 bp, Homo sapiens
acacaggcccaggacgcacagatcactcccgtccggccgggagctgacacgggcccaggacgcacagatcactccggtccggccgggagctgacacgggcccaggacgcacagatcactcccgtccggccgggagctgacacggtcccaggacggacagatcactctggtccagcccaaacccagtggcatggacgggacttgctcagaacctgttagtggctcagacaggacgtaaagtgagggttccccagtgctccccaccgcacagaggctggcccctcct

SEQ ID NO: 557493 - DNA, 908 bp, Homo sapiens
  misc_feature (105)..(105): n is a, c, g, or t
  misc_feature (112)..(112): n is a, c, g, or t
  misc_feature (114)..(115): n is a, c, g, or t
  misc_feature (137)..(138): n is a, c, g, or t
  misc_feature (181)..(181): n is a, c, g, or t
  misc_feature (214)..(214): n is a, c, g, or t
  misc_feature (226)..(226): n is a, c, g, or t
gagggccggaagccgcgctcaccggcgacatcgcgtctataagctggtggaggacacgaagcatcggcccaaagaaaacctggagctcatcctgacgcagtggtngagaatntnngagtccggggtgacctggtctnnagtaagaaatctttaggccggatcgactccttctcagggactngctgtatatgcatccctgaaacagaagctgttnagaggagaaatnctgagacagaaggacaatcagagaagatccagaccaaggcaggtgaggcgacagtgaaatctctaaaaagctgcccgcctggaggtagggatgaaggacacaattgttcgaactgggagctgaaccctgaaatagtgtgcccgccattctgatacgaatcttggctggtgagtggtatgcaccagcatacgttaaagttaccagcagagactatcacacggtggggcgaacatatcggtgtgcaggtgaccggtacaactgggcttgaactgtgagcagtggcctatgtctgtcgtgaactttgagacagccaagagccgaagagatgatacgctcggttaaggcccaagaaaggctgcccaagggtcatgggccccaagccagcccgccagatcagaaagcctcgctcgccttccaagggcagcacaacgcagactcgcgagcagcgggaggcgagaagcgcgaagggactggatcacaacccaggtcgaacagagagcatgaaggaaatcggaagactacgacggcgcggaaactgggacccccacgggcctaactggcaacgggaggggcggcacaggacggggcaggacacacgaacaagcagaccgtggccaacgggaggaagcgggcaaggacgagccacaaacgagtgccaaaaaaacagcggcataccgcgaag

SEQ ID NO: 557494 - DNA, 426 bp, Homo sapiens
aatacttccagtcaactgatctttggacaagcaaacaaaaacataaagtggggaaaggacacccttttcaaaaaatggtgctgggataattggctagccacatgtaggagaatgaaactggatccttatctctcatcttatacaaaaatcaactcaagatggattaagggcttaaacctaaaacctgaaactataaaaattctaaaagaaacattggaaaaacccttctagacaatggcttaggcaaggatttcatgaccaagaacccgaaagcaaatgtaataaaaacaaaggtaaatagctgggacctaattaaactaaagagcttttgcatggcaaaaggaacagtcagcagagtaaacagacaacccacagaatgggagaaaatcttcacaatctatacatctgacaaaggactaatatcca

SEQ ID NO: 557495 - DNA, 859 bp, Homo sapiens
  misc_feature (41)..(41): n is a, c, g, or t
aattgtgacttgctgcagaaacactatgtgtcaactccagngatctcgggtctcgagacatgcagagatgcgtcggaataagtgtagtgcaagaacaaggttaggaagaactgatacacaagtatcatggaggagacatctgtgcagtttcagatgtgtgccaagtgtgtaataaagtgatgatgacgagcgtcgtaggaaaatccatggtgagaaagatgaccataggaacccggacaggagtagtgaaattgcctaagatagtgtggtgaatttgtcacattaggccactgatcctacttcatatacctgcaggcgtcagatgatatggcaaagccctgtgtaccaggctcttcaaaaccaaattatcagcatggtgaaatacgcatatttacatgatgataatagtcgatcggtatatggtcggcatgtggacccaatacacaggcgggaattgcataatccgggggttgccccaggttagatagttgacacgttgcttgaatgcattatgagcctagaaagcttcgcgaggttcaggtaatatacctattaatcaatggggctgtgttgacactagggtcatatcaccaatttgtccccgggcactgtataggttctgatcgagtatcaggataaacgggaccggaaaggaggccttagaataaaacccgcggcaacgggctcaacacaccgagggacggtctgggatgccgggccggctgataccaccggcgagaccccagtggacaagaccatagtgacaactctagcgaacaatcaattactgttgctcactatattactcttccagcaacgacacacgcaaccaactagaagacaagaaggcaaaggaagg

SEQ ID NO: 557496 - DNA, 445 bp, Homo sapiens
acattttgtggactgaatacgaccccgactatagaggattcctaccggaagcaggtggtcattgctggtgagacgtgcctgttggacatcctggttaccgccggccagtgaggagtactgtgccaatgccggagcagtacatgcgtaccgcggcaggtcttccctgtgcttgtgtattgccatctaacatagaaccaagtcttcatgacggacattccagacaagtaccaggggcatcactgattggtcaacgggccttgcgaaagtgaacttctggggattggacgggtaggtccccggttcgatgggcggtggttggcgggggaagccacagggtgcgttggaaccgttgagccttgggggcggcgccgtggtggggcggcttcctttggggcgtggtccttcggagggcatgcctcgggccccgagttgccatagtggccat

SEQ ID NO: 557497 - DNA, 124 bp, Homo sapiens
aggtattactgtgccataaacatcaccagctctgcaagttctttgctgggttatttggttgcaatttgaaaatctccacattggatttgtagtgattatactgctgtagatactcctcgatgta

SEQ ID NO: 557498 - DNA, 120 bp, Homo sapiens
acctcggcccgtgtttttccttctttattggaggaacgtaggacagagttgtgtctttctttataactaaatgataaactatgcttttttaaaagagtgactgttagaactttgtttggt

SEQ ID NO: 557499 - DNA, 574 bp, Homo sapiens
  misc_feature (48)..(48): n is a, c, g, or t
gtgctcgtatgaggtcgacttcctgggctcgagtgatgtcctgcctcnccttttgagtagctgggagctggaccacaggtgcatgccatcacacctggctagtttttatatttcttgtagagacaaggttttgccatattacccaggctggtttcaagctcttgagctcaagcgatccacccatcttggcctccccaagtgctgggattacaggtgtgagccactactccagaccaaagctgcagttttaagtaggaaggtcaggccttctaagaaagtgatccctgaaagggaagccttgtagcaacccgggagaagagtagcttcgagagggaggagtccagtagggcaaaccgaatgtgtgaggaacagcaaggtggtcagggcagatagagaggcgtgagggcagggaatggtggaaacgggccaatactttaacaacagacaatgtctactggctgtgctgtactcactgcttcaggcaataaaatccatgccctttttttttaattcaaaaaatttttaaatttatgtggtgcctgtttccagtcagccagctcacggccagctgagt

SEQ ID NO: 557500 - DNA, 253 bp, Homo sapiens
acgagcgcagcttttgtcgcgacctggtagcttgatctctcatggctcacaagcgacccgagaacagcccaacgcaaggcatcgaaaacggacgaccaagcagagaacggcaacggtgaaagctggcgctcgccagagcgcaccaaggcatcaagctgccccagccgtgtctcatgtgacgggtgcaactgagtcgccccctgatgaaccggcgcacgttgagcgggatcgcgtgggcagaaggagcgggcca

SEQ ID NO: 557501 - DNA, 559 bp, Homo sapiens
gggtttctctttaattgggaaaaatgtcgccaagcgccgattaaattcagcatcccaaccatgtgccccctccaaaggaagaggaaccttgcccgtttcctgttctctttggttggcccaaagcataatgctgtccaccccacccctattgaaaactggggggaaattgcggtttttccgtttaaaaaggggagccgttaaaaaaaaacccctgtttttcccccccttaactttggttttgggaaaagcccctggctccctgggaattaaccccccgtaaccaacgtggggttttggtttgttctccccccaattggggggttccgtgttcaagggcccccccatttgccaaggggggttgggtttttttaaaacccgggtcccttttacccggccccccagcccccttaatgaattgccggaactggtttttaaggggtttgatttttaaaaagggggtcttttccgccctttttccgtaagggggcttttttttaaggccaagttttttttttttgggccggtgtccaggggccattaaagccccctgtttttttta

SEQ ID NO: 557502 - DNA, 879 bp, Homo sapiens
  misc_feature (85)..(85): n is a, c, g, or t
  misc_feature (96)..(96): n is a, c, g, or t
  misc_feature (98)..(98): n is a, c, g, or t
cagtttcatgcccatcgtcctagaattaattcccctaaaaatctttgaaactagggcccgtactttaaccctatagcaacccccntcctaaccccncntcataggagccataaaaaaaaaaaaaaaaaaaaacaaaaaaaaaaaatgtgtgtgcgggacgccccgaggcccccgcaaaaagagcttcttaacacacacctctcgttgtgggcgggcggcggcgcccccagcaaggtacgcggtgaacactggtgccaaaagcggtgtgctcccaaggaagaaccgcgggcccacggaactaagggcgtcggcgattccccccccatataaaaaaaaccgcccgcggggcgacaaacccgagccgtcctcgcgaaaccaaatccccaccaagcggcagctcccgcgacggtccctaaccaccggggcatcctcacacacacgcggcagtccccaacgccgccgccccgacatctatccacatatacaccgcccccgcacccgcgggcactccaccacgacaacaacacccccaccgacctgcaacaaccacccccataaccaacgcatcttactctgcgcaccacaacagagagcacacctccaccccacaaaacgcaggcactatgctatcacacaccatcgacacacctccccccgccagccccacaccaaaactcaacctcggtgtcgcacacaggagctccacaaactcaaaacaggcgcaccaggacgctcacaccaacccgtgaagcgcacacaacaacaagcgcgataacacaacaccacgcgccccaccctccccaacgcaccaaccaaacagcggacgacaccacaccacccctcctactgcactctaccctcgaacaccccaacacaaac

SEQ ID NO: 557503 - DNA, 394 bp, Homo sapiens
tcccctaccgaagagttgaaacaaacctgaaaaataagtttctcaaagtatgactgggttttacattaaaaatccagggtaataagagataccaaaccaatctatccatggcctatcaaaagattctaccttttccataggaagggactggcaagaaaggatatttaattttcaatatcagccaattttgcctgatgggtaattccttgttttaataaacagcatcaataggatatcatttaaagctaccctgaaatgttccttctctgaggcatcagggccctgtgtctggacagtgaatacctgtcaagtgaagagtcccatgcattgaaggaaattgccagtcctcatgaatgaacgctgaaaggaagtctgatgtgcgccattctatcat

SEQ ID NO: 557504 - DNA, 314 bp, Homo sapiens
tgaagttaaaagttttaaagtttgataagttccactaatgaatttcccctttaatggctttgccttttgtgttgtagccatgaaacctttgcctaacttaggatcatagagatctgtccaggcgccggtggttcacgcctataatcccagcactttgggaggctgaggcgggtggatcacgaggtcaggagttcaagactagcctggcccaagtggtgaaaccctgtctctactaaatatacaaaaattagccgccgggtgtggtggcgggtacctggaatcccagctactcgggaggctgaggcaggagaatc

SEQ ID NO: 557505 - DNA, 571 bp, Homo sapiens
ctcccacctcagcctcccaagtagctaggactagaagtgtacactaccatgcctggctaatttttttttggtacagcctgggcaacatggcaagaccctgtctctactaaaaatacaaaaaaattagctgggcgtggtgacaggtgcctgtaatcccagctactcggtaggctgaggcaggagaatcacttaaacctgggaggcagagattgcagtgagctgagatcctgtcattgcaactccagcaacaagagcaaaactccaaaaaaaaaaaaaaagagaaaaaaaaatgactacaactgaaggcctcttgtgattgtaaagtagaagaaattagatctctggatactgaacaggagaaaggagattagactttgaaatcataaattagcaaatttcaaaaaggggcctccctgtttgcccagcaaaacattaaggatctattattctgttgacatgttaactttctctaatctttatgctgtcttttacagatgggctgatttctttgtcattctagagccttaaaatattcatacattttgatctattgataaatttcatcactgga

SEQ ID NO: 557506 - DNA, 481 bp, Homo sapiens
  misc_feature (70)..(70): n is a, c, g, or t
  misc_feature (88)..(88): n is a, c, g, or t
  misc_feature (128)..(128): n is a, c, g, or t
  misc_feature (184)..(184): n is a, c, g, or t
  misc_feature (196)..(196): n is a, c, g, or t
  misc_feature (226)..(226): n is a, c, g, or t
  misc_feature (234)..(234): n is a, c, g, or t
  misc_feature (290)..(290): n is a, c, g, or t
  misc_feature (355)..(355): n is a, c, g, or t
  misc_feature (366)..(366): n is a, c, g, or t
  misc_feature (456)..(456): n is a, c, g, or t
atgctgagaaactgatgaagctgcagaaccaacgaggtggccgaaacttcctttaggatatcaagaaacnagactggtgatgactggnaaagccggctgaaatgcaatggagtgtgcattacatttgnaaaaaatgtgaatcagcctactggactgacaaactggccctgcctgaccccattgngtgacttcattngacacattacctgaatgagcaggtgaaagncatcaaanaattggtgacacgtgacccaacttgccaagatgggagcgcccgaattggcttggcnggaatatctctttggcaagcacaccctgggagacagtgataatgaagctaagcctcggctaattncccatagccgnggggtgacttcctggcaccaaggagtgcatgcatgtggggttccttacctttctataagttgaccaaacatcacttaagtctttgattgnaccattcttcaataaggtttgtccc

SEQ ID NO: 557507 - DNA, 122 bp, Homo sapiens
ctgccgacactagagtatcccctcagcaccactgcatgatgtcaccgatggaggatgggacgaaaatatccacgaagtatatatatgatattttctcccatcctccatcggggtaccgagcg

SEQ ID NO: 557508 - DNA, 100 bp, Homo sapiens
ggagctggggggggctatcctgggcctctcgaataatttccggtagagcatctcacgggtctcctaccatgggtgatctagggattaatagagagaaagt

SEQ ID NO: 557509 - DNA, 1076 bp, Homo sapiens
gggagcccgggtcctccgcgggcaggaaggggagggcccatcggggctaggggaaccccggcgcagacctggggtggggtcggaaaagctgtttcatcgcccgctcccgggccctccgctccctgcctccctcagctctctcggctggcaggagtccccgacaggccacccaggcactctccagaggcagcattccgggaggcagcggacgcagaggactcgccatgtcccagccggggacagaagcccgacgactccaccgcggacccggcgagcagccgacagccgacgcaaccatgagcatgtcagtgagaaaagcagtgaatcgccttccaaaaccaggagaaacagaaaggatcagatgagaaaaaagcagcaagcctcggaagcaagtcaatcctccagaacgcaatgacaggatggaaacagcctcggcacaccaaggatgtcaagataaccatctggtgcaaccagccaagtcattccaggtatgaatcccacagaaagcaaggctgtaaaaagcaggaacctgagaagaagtcacagtcaagcaagctgtctgatggtacacatgagaaaaaagtcccaagaaggacagccaggagaacacacagagccaaaagcctacccaagaagggctcagatcacaggcaagcagcgatgctcagcgaaaggaagcagtaccagaatcagatgaaccagacaaggcatcacgagaaatccaacagaaccaaagaaataaaccacagaacatgaatcatgctggtggagagagtggcaggaccacaggcaaaccctgggcacggcgggctgcaaggcaaacacgaaacggacgcgtaaaacacggcgtggccaggacgaatcaacgcggaatcaagcccaagcgggaacaggccaggacgtgaagtgctagacaacgaaggacataaagaagccctgagggacgcacggaagacacgacgacgaaaccaagtgaggcggccccagtgacaatgccacagcacaccaccgaggacgactgcaaaagacgagcatgaccagaaaatagggagcgggacaaccaagagccaaaacaa

SEQ ID NO: 557510 - DNA, 479 bp, Homo sapiens
  misc_feature (418)..(418): n is a, c, g, or t
tgctctggtcacctttgaggaccccaaagtggttgatcggttgctacaacaaaaggaacacagagttaacttagaggactgccggctgcgggtgcaggtccagcccttggagctgcctgtggtgaccaacattcaggtgtccagccagccagataaccacagggtgctcgttagtggttttcctgctggacttaggctgagtgaagaggaactgttggacaagctggagatcttctttggcaaggcaagaatggaggtggggatgtagaagacccgggagatgctgcaagggaccgtcatgctagggtttgctgatgaagaagtggcccagcacttatgccagattggccagttcagagtcccactggaccggcagcaggtcctcctgagggtctctccctatgtgagtggtgagatncagaaagccgagatcaaattccagcaagcccctcattcagtgctggtgacaaatattcctg

SEQ ID NO: 557511 - DNA, 644 bp, Homo sapiens
  misc_feature (19)..(19): n is a, c, g, or t
  misc_feature (44)..(44): n is a, c, g, or t
  misc_feature (56)..(56): n is a, c, g, or t
  misc_feature (58)..(58): n is a, c, g, or t
  misc_feature (81)..(81): n is a, c, g, or t
  misc_feature (89)..(89): n is a, c, g, or t
  misc_feature (118)..(118): n is a, c, g, or t
  misc_feature (135)..(135): n is a, c, g, or t
  misc_feature (149)..(149): n is a, c, g, or t
  misc_feature (154)..(154): n is a, c, g, or t
  misc_feature (174)..(174): n is a, c, g, or t
  misc_feature (182)..(182): n is a, c, g, or t
  misc_feature (202)..(202): n is a, c, g, or t
  misc_feature (206)..(206): n is a, c, g, or t
  misc_feature (209)..(209): n is a, c, g, or t
  misc_feature (215)..(215): n is a, c, g, or t
  misc_feature (217)..(217): n is a, c, g, or t
  misc_feature (221)..(221): n is a, c, g, or t
  misc_feature (225)..(226): n is a, c, g, or t
  misc_feature (241)..(241): n is a, c, g, or t
  misc_feature (260)..(260): n is a, c, g, or t
  misc_feature (272)..(272): n is a, c, g, or t
  misc_feature (281)..(281): n is a, c, g, or t
  misc_feature (288)..(288): n is a, c, g, or t
  misc_feature (297)..(297): n is a, c, g, or t
  misc_feature (309)..(309): n is a, c, g, or t
  misc_feature (313)..(313): n is a, c, g, or t
  misc_feature (316)..(316): n is a, c, g, or t
  misc_feature (319)..(320): n is a, c, g, or t
  misc_feature (334)..(334): n is a, c, g, or t
  misc_feature (347)..(347): n is a, c, g, or t
  misc_feature (349)..(349): n is a, c, g, or t
  misc_feature (352)..(352): n is a, c, g, or t
  misc_feature (360)..(360): n is a, c, g, or t
  misc_feature (362)..(362): n is a, c, g, or t
  misc_feature (367)..(367): n is a, c, g, or t
  misc_feature (382)..(382): n is a, c, g, or t
  misc_feature (386)..(386): n is a, c, g, or t
  misc_feature (405)..(405): n is a, c, g, or t
  misc_feature (416)..(416): n is a, c, g, or t
  misc_feature (430)..(430): n is a, c, g, or t
  misc_feature (432)..(432): n is a, c, g, or t
  misc_feature (459)..(459): n is a, c, g, or t
  misc_feature (465)..(465): n is a, c, g, or t
  misc_feature (468)..(468): n is a, c, g, or t
  misc_feature (472)..(472): n is a, c, g, or t
  misc_feature (487)..(487): n is a, c, g, or t
  misc_feature (498)..(498): n is a, c, g, or t
  misc_feature (502)..(502): n is a, c, g, or t
  misc_feature (538)..(538): n is a, c, g, or t
  misc_feature (548)..(548): n is a, c, g, or t
  misc_feature (619)..(619): n is a, c, g, or t
tgctttgaaatttagaaanaaattttatttaagatctgaaaaanaattcctaaaanancaacttttccagaaaaccggggntacacaanaatgcattgcctctatcatgttagaacgngcataagactcaaatanaaaaaccatgaaanaaatnaccatccttcaacaatttgngcaaaganagaatgcctaagaacaacanaganggncttgcngngggngggnngttttacttcaagcnccaaaaaaaaaaaaaaagngcacaaatgcangggttttcngggatanacattaagnggaacctttggnactnggnatnngggggttttgtcanaaagcattaacananatnagaaaatngngtggngtcaaaggggtaggnaccnccagcatttaagcaatgtngtgaactaggnaataaaatgttctncngaatgtttcttctttgttctaattacngcatanacngggngcaactttgaaatgngaaaaggggcntacnccccttttattttctgtttaaaacagaacggaaaanaaactgaaanaaaagccctgttatacattaacgattttaaagaacatcaattttacaagaaaaagactaagaacaaaaagngtttacagaaacaggacaaaaatgg

SEQ ID NO: 557512 - DNA, 244 bp, Homo sapiens
aatcctagaaacgggtttagcaggattctccgaatacatacgaggaggcaccatataaccgagataacggatttcagcacggtgctcactgttgtcgacggaacttgtaaaaggaggcatgcaccgtaatggtgaatacacgtcgaccaggctccactgttaacgatattgggacgtcatcacggtgctcacgtgtctgacggaacttgtccaggagaggcatgcaccgcagtggtgaatacac

SEQ ID NO: 557513 - DNA, 197 bp, Homo sapiens
tgcaagtacttgacacatactgcaaatgatcctccagaaagggtatactcaatttatatacccaataaccagatcaggatatttgcttttttttttttccccacttagtccaaaaaaccaaaacaaaacaaaaaaagctcaaccttcccagtattcaattcggtaaaaccaatgaggtctcattgggctctccaaag

SEQ ID NO: 557514 - DNA, 1321 bp, Homo sapiens
  misc_feature (115)..(115): n is a, c, g, or t
  misc_feature (571)..(571): n is a, c, g, or t
  misc_feature (579)..(579): n is a, c, g, or t
  misc_feature (601)..(601): n is a, c, g, or t
  misc_feature (1077)..(1077): n is a, c, g, or t
  misc_feature (1196)..(1197): n is a, c, g, or t
  misc_feature (1275)..(1275): n is a, c, g, or t
gaggatcttcatggtacaactccagcctatctgagcactctcactgtgcatctgaaaggaacaggagactgcaggaaagacagtgcctggattaacttaaaggaactaaaaattnggaatttttactcttgatatccttccaaatcaactctctcaatgttcccatcctcaaaactatcatatggggtaactgaggcagtcagagatttactgactcaatgtcactcaattgattctgagttcactgctgattacatccgaccaaactgctttttctgaagtctactccgtttaatcatgctggtgatgattttgtgcggctctgggacaaactccacctggctgaagataaagcaaatctgcggtgacttagtcctcctgtcatttcccatcagttccccactctcctcctctgcccctccacagtctcccatgcaggctgacaccatatgacggccttaatggagtccaccgagtatttcaggttctctcctgggccacttgaaagtggatgtacccatgggatttgctttgacccaggagatgtgcgtggaagtgaagcgtgtcaccncgaggcanaagagttgggagccattgagangggccactctctccttcatctcttagagcagctgacagctcccatatggaggctgctcctttattctcgtggcaggatgagggcatgtggggcacagggcacaggagagccatggaggatgtgcagcatgggcaggaaaagagccttcagtggtgtacatttccatagtttggggctgtttcttacctacagtgatacctagcccatcctagcaggcatgcaccatctactccacactctgtgatgcagactagcctgccgtcagaacacgaactggtggtcagacacaggtaggtttcagttccagctctgcctcttattgactgcaacctcaggcttaactttcagtctctgagcctcagtttcaactctgtaaaatgaggtggctataccatctcaggttgcagagagaattaaatgaaatataagtgcatgtagagcattgaacccagggcctggcacacacagtgagtacncaatgttagccaggtagcttcataatgcatactgattgtcaatattcagacaatgcagtaaagtgttaccaaaaataaaagtaaacttatttgcatatgtattctttcaatctttattnnaaaacagggtaaaactatgcatattctttcatagccagtgtttttctcttcttagtagagacagggtttcactgtgtnggccaggatggtcttgatctcctgacctcatgatccgcctgcctcg

SEQ ID NO: 557515 - DNA, 832 bp, Homo sapiens
  misc_feature (115)..(115): n is a, c, g, or t
gaggatcttcatggtacaactccagcctatctgagcactctcactgtgcatctgaaaggaacaggagactgcaggaaagacagtgcctggattaacttaaaggaactaaaaattnggaatttttactcttgatatccttccaaatcaactctctcaatgttcccatcctcaaaactatcatatggggtaactgaggcagtcagagatttactgactcaatgtcactcaattgattctgagttcactgctgattacatccgaccaaactgctttttctgaagtctactccgtttaatcatgctggtgatgattttgtgcggctctgggacaaactccacctggctgaagataaagcaaatctgcggtgacttagtcctcctgtcatttcccatcagttccccactctcctcctctgcccctccacagtctcccatgcaggctgacaccatatgacggccttaatggagtccaccgagtatttcaggttctctcctgggccacagagtgagactccgtctcaaaaaaaaaaaaaaaattgtagatagtatccaggttttggctctctaggtcttttttatccagctcttggtcatgaattgcacgtcacagaggtttctgaaaaggcttgcccaggactgggaccagattaccctttattaatggtcacagtggcagcctgggctcatggtcccactttcccgtggtttcatcccttaatagaccaaaagaatggtatctttcaactcctaacaaaagctctactatggtcaatgtaagaacattcatactctgtaaaatggtaagccctctgaaaagccaaccgtgaactagt

SEQ ID NO: 557516 - DNA, 142 bp, Homo sapiens
cgtgggtcagcatttcaagttgcagtagtcaggcaatgcggtcagtcagttcaggcatcatcatcacattgttcccattcaagccatggttcatgttcagggttgtcctggtcacactgctcattcattccatcctcatgtg

SEQ ID NO: 557517 - DNA, 100 bp, Homo sapiens
ggtcggtccttttaacactaacctcttgtgtgtgcgtgtgtgtgttgttttaatggagaggcctccttagctttacttcccttgagtcttgtgggcgtga

SEQ ID NO: 557518 - DNA, 1534 bp, Homo sapiens
  misc_feature (1145)..(1145): n is a, c, g, or t
ttattcttaggttatgtttggcggtgtatgggtgaggagggatataagacgtgtggtcgtgatgattctgctagagcatgttgaactactgttcattttaattggcgtttgatttgattctggtgtgtttttagttgatcatatagaacgtcggcgagtgatagtatatgattgtgttatgctatcttgagttttattcagtaagtgatcgggtgtcgtgttgtagagatagttgtgatttgtgcacttggttgtagcgagtgtggtatgtataatctggtaataatcggggtgtgattgatttggtggtatatatggtggatactatttttggagtttcactaaatactgtggatacatatgcttgatactattaccatctgttgtcataatgcgtgaatcttgttggttattgtcagctcggtttatagtgggattctcccattcaccctgctagaaggtagtcacgcgctttgatgtgtgagtccttcgagtcactgcgaagccatgccgcgctcctgcgtattgagctatcaggtcgacttcgagattgaaatgtctcttctaaagggacagattattctggctgtaacaagtgctgccattgtgtgaatgcctacctcctatgttaatgtactgactgttcaacgctgcacgaaagatattctgaagtcttgcgagtgcaagacttagtggtcctatgcattcttcacgaggacgaactagagcgttccctgattagctcatgtggctctccatctgggctcggaacatagagtctacgatcgaccataactgatgtctactatgagtctccgcagcgttgagttacctcgagccgctgttctatagccaactagtcgtgctggcactgcactaacgcatgtcgacgttctacgtcgcctataggggtaccactgaattacaggagtccgcttcaatctacgaccatgtccgcatttgagatgaggatacgcatttcttcagctgatatggtctaggtccttagtcgatatttcgcgacgcaagattgtgtaatacgacgcaattgctctatgactttgtccctaatggtagtcagtcccgagttatcttatacgcggacaatgtatttgctttgcacggccattcagtatgccatgatncagtgttctatgtcttgccaatactattgtgcgaaatacactggtcgacttgctcaaacatccagcgatcccagtagcactactgaatgacacggggatcgccgcaaataaaacaccagcatttgcttctcggtgtcgaagtgctcttagcgcatgcacaaccgtacttgtttccaggaagcttatcgtctattgagtacttgcaccgcgaatgatgagtgtttagctattatacaggagtcgacaagataattataatatcttggtgtcttgtttctattgtgtggctttttataaaatgacaaatatgtatctgtgttgtgataaaaagtattttatttgtttcaatgatatgcatgataacctctctgtaatatataataattgtc

SEQ ID NO: 557519 - DNA, 343 bp, Homo sapiens
caaaatggtggcgccgaggcggaggccggcgcacctgggggcgccacacgccctacgggatccccgcagaccgccgccagctggacgcgagccccgggtccaggcggcccgcactggtctgcgccaggcccagcccgcaggggccgcccacagccggtggcccgcgtcgccgctcggtgtccgcgggtctggtgctggcgggggcgcggggcccggcgcggccgtctcggcctcacccagcggtccgcgccggggagagggagcgcactcacctcagacgcgccccgggagccgctggaagagcccgggaaaggaggcggagccgcgcgaatgaatggagccg

SEQ ID NO: 557520 - DNA, 111 bp, Homo sapiens
ctgggcatatggtgggcgtctacaagggcaagaccttcaaccaggtggagatcaagcccgagatgatcggccagtagccggggcgagttctccatcacctaacaagcccgt

SEQ ID NO: 557521 - DNA, 386 bp, Homo sapiens
gaatcccaacgtccgctaagagtacaacaaaaaacaacaatgatccagccatgacagggtgcaccgtgttaaccccgagctactcgggaggctgagacagcaagaatcgcctgaacccgggagggcaggggttgcagtgagccaagatcacaccactgcactccagcctgagcaacagagtgcgactccgtctaaaaaacaaaaacaaaaacaaaaacaaaaaccccccaaaaaaaaaacgaaataaatgctgtctcccccattcggcaaaatgtggcttttctgtagtcctacctctccagctacctatggactagggtaaacaatcgactatgcagtctaggaccaatttggcttagggacccatggtagcccagccacaaaac

SEQ ID NO: 557522 - DNA, 276 bp, Homo sapiens
gggggccgggggcctttttttttttggggcctgggccccccaaggtcctgggggggggggccggttgcccctggtttaaaaacccccccccccccccttttggggcggcccaaggggccctttaaccccccccggttggggggttttatttttggggccccaccggggcgggccccggggcctcccccccccccaggggggggggggggggggggcgggggggggttttggggaacccccccggggggggttttttttatttggttttgtttttga

SEQ ID NO: 557523 - DNA, 156 bp, Homo sapiens
  misc_feature (17)..(17): n is a, c, g, or t
  misc_feature (41)..(41): n is a, c, g, or t
  misc_feature (104)..(104): n is a, c, g, or t
  misc_feature (155)..(155): n is a, c, g, or t
gctaaacctagccccanacccactccaccttactaccaganaaccttagccaaaccatttacccagataaagtataggcgatagaaattggaaacctggcgcantagatatagtaccgcaagggatgattataaccaaggcataatatagcggant

SEQ ID NO: 557524 - DNA, 6384 bp, Homo sapiens
cagacttcaccacaagcaggaatgcagactcagcctcagatagcaactgctgcacaaataccaactgctgccttggcctcaggcttggccccaactgtacctcagacacaagacacgttcccgcagcatgtgctcagtcagcctcaacaagtcagaaaggttttcacaaactcagcatcatcaaatacagttcttccatatcagagacatcctgccccagctgtccagcagccctttatcaataaggcctccaacagtgttcttcaatccagaaatgctccgcttccatccctgcaaaatggacctaacacacccaacaagcctagttcacccccgccaccccagcaatttgtcgtccagcactctctatttgggagtccagtcgccaagacaaaagatcccccccgctatgaggaggccatcaagcagacacgcagcacacaggcccctctgccagagatttccaacgctcacagtcagcagatggatgacctctttgatatcctcattaagagtggagagatctccctccccataaaagaagaaccttctcctatttccaaaatgagaccagtgacagccagcatcaccacaatgccagtgaatacagtggtgtcccggccaccaccccaagtccaaatggcaccacctgtatctttagaacctatgggcagtttatctgccagcttagagaaccaactagaagctttcttggatggaactttaccctcagccaatgaaattcctccactacaaagcagcagtgaagacagagagcccttctctctgatcgaggacctccagaatgatctgctgagtcactcaggtatgctggaccattcacactcacccatggagacttccgagacccagtttgctgcaggtactccctgtctgtctctcgacctgtcagactcaaacttggacaacatggagtggttggacattaccatgcccaactcctcttcaggactcactcctctcagcaccaccgcgccgagcatgttctctgctgactttctagacccacaggacctaccgctgccatgggactaacgtcacagatttcttttctgagagttgatgaggtttaagaacatgaagattctaaaaggtcagtttttagagatagatctatagttgcattgttgcaatcaaaatatgttgtcacagaaagaataggtggaaggtcatagcctggaacccaagtttgaaaacatttcattgtgttcagtagtgaatttctacagtttaacatagcacagggccttctgaaaatcgcacttgtcaaagacgactcatctatttctccagacttcagtaaagaatgaaaagtacctttagataaaaacaaagaagagtaatatatgcagcacagtgacgttaggattctggtaattaactacatttaaatctctggtcactttaagaccctaaataaaaggcagacagctccactcaaaaactaaggctgatgtgagggaggtgagaggtcactgcacttggtacttcctagagacggccggagccaggcccaagacacagcagaggtcaaaggcagtggagagccttggccagttcagtgacagcttctggctgaagacttttggttctattcagaaacctgtgtcgtttttttggtgttgtagtttattttgtgattttttggaatcgtactttatatttccaaatttaaatttaaatgcaagatctttcaacataaacagaagatacctacaaaatactgtcagaagtccaggtatactgataacactgaaaattctattagcaaccttctgggttggttagattgattttaatgtatatattagacatttgtatgtatgctctgacattgtgatttgtacagcctacgctggggtaaggaaatgggtatccaaggtcctacttttttaatagctcgaatatttctagagtacttgagccacatgtatttctgtatttaaagaattgctgactaactttcaggtaaccagacccatctcaaagaaccaagaaaaggctttagcatgaaatatctttctgagctggcgagttagaagaatggaaggtaaggggaaggtctgtcatctacccaggacattcccatgatgagtacaggtcagattgtgccacaaggtgggcctccacgtccctgccctggccctctttcttctgtcactaaccctggttatcattttacaggcttgtaactggatattctaccagagctctcactatattgtcaagcctaagattgaaaaactggaggctttattagtgtttttatatagaaaacagttattacatatgtgttaagtcatttcttaagaattttctaaaatgccaactatcacaggattatttcaagctagtcattgaggtatatgacaaaatgtaaataacaaaaaactgaaatctaccaaaagagcatggagatttttcttaaataataatattgtgctctccacctcacccttgtgtaaaccctcaggtcaggttggttcccctgggtcacaaaatggtaaatgttccatactgacatgccggaggcagcctgacccgttatttggaaagaatttgtgaattatttctgggtttgtgttttgcctaagagctgatcttatttctgatttgtgtgtgtgtggtttataaattttactacgtgtaacaaaagtctgcttttccagcatgagcacactggagccctctgctcactggcacttcctgactcaaaggcactaacagtgctcatgtgccttccagacggttcaaggcagaggccactgtgctcagtgtagtctgtgatgaatagtttaagtgttcagaaattggtaaaccaacacacgggatacaataactctctgttaaccagaacaccgtcatttgaccaagccctacaagagtttaccacactagatgttctgtgaatcctcgagtcagttccattgagaggggcctgtctccagggccaggctatttacttgggaaagtatttttcttacagttcttggccacagtttttttgctgagggtttctgtctgggcctatcaggtccatacttagaccctgagcatcttcttcattcagatttgaatggcttattaaattagcaccaaatatcagtgggactgtagaaggtaaccgaacactagtaccattgactctcgttgaataactttatatttccataatcctgaattgtgtagatagttttctagctctcgggtccctttattgctttttaaaatagggtttgaaacatgccacaggaaggttgctctccaaaaatacacagtgcagtgcaagaaaatgctatctcattggcctactctcctatgaattgctaaagtgcccacttcacatatgtgtttaaacctttataaaccagtatttcacttttaaaaagacaaggcatctctacccattaactctgcaagccactccacttgcaccattccgcttgaccctcctctctcctggcttgggtcaccagccaggcacctgtgacacgagtgctgctctccaggatctccactacatgttccaggttggagtgaggacgcgctatgtgctcacactcatgtgacatgaccaaagatgatactctgtaaacaaggcccttctgaccggactcagtgcgtgtgatggtgagtgcaatgaggaagggtggatattgactaaagactggttgttgttgttgtttaggttagtgtcacagccattacagcacaagtcaaagtcgccagttgaattttcattatgcacgtgtgtggtttaagcagtggtactgttgtatatcatattgtaaagtatcatactgccaagaaaataactcctagaaaggcattatctcacatccccatcttactttcctacatgttctcaaaacacagtagtaccagccttacctttctgctgtatgtagatagtcagatcatcctactgggggtgggatgaatttaaaagttataccaaaatttctgtaaagtctttgaaagtctaggagtaggtggtcatcttgtacatttcagcaaagcatccactaggaaacctcataggacagtgttagtggttcacgttctagtgtttttcctgaaatgtgcaatctactgtatagtattgccacataattgtacatagatgtattctgaatttgtggaatttcttgcttagatactattgtgtttgtttcatatgaatatttttgtaattctaaaagagatcttatttaaatttcctttttaaaagccgcatggttctgtgatccatgtaactgacactttttggctttcagtgctgtttagaaacagtggcaaaggcagggtggtgctgcctgcaagctgctgcctatggaaggcaaagtcatagtaatgagatagcacctctgaactgtgcagtcagcataccctgagtgatggctcaggggcgcactacctattttgtcaccagagctgactcaggcttcctggaccctcaaccccagatcattccaggcagcatagctttcttcacagtcctttcagaattcccaggctgaaatcagccatagcagttgacaaaacagctatccccacaagtgatgagatagtccctttactgtcctcaaatggacttggccttagagacgtggtaaagcactttggcagggtttaaaatatttgtgagaagcccacatttcagtatacatcctcactggcttccatgcacccacctgacggtagcctcacagaagtcctggctgtcactcaggtggggagctcatggtgccgctggggactttttagagaaatgtaaagagaatagctattcagtgtctactagcagagcaacatgtgtcaatttaaccaaattcacaaataaccctccatttttcaatatctgctactgtaaacatgaatattgaatactgacaagagaatacccatacaaatcgtcccaccgccctagaggccacagaattagcccaaaattatcaaagaacattaactggaaggtcaggtttttcaaggaacatagcttacaaatgcatcagtgtgtatctggagagcatcctaactgcatttcaactcatcttttaagtgatttcagtcaaaactggaaaacaactaagatgtagtaatttttttttcctggttcaaaccttcaataacttgctcattcagcagtctctctgagctacatttttatttgtaaagtgactctgtctgcatggcaatgagcaggtgcgtgttttttccacattcgccctttcttgcagtatccagggaaacacatcattacaaagggtttctacctgaaatctttcatggaaggcctacaattcgaaaagctgcacatgtttacagaagagctcttaccctccatgcaaacactttgctctgtggtgtcacagctttgtgacaataagatggcaatctcggatctacaaggtgctgtcgggaatcaaataaaatatgttatcagagatatcatcacatctatagtgtttaacagagctttatgccaactactaagacaaagctttaacaaagtttatagaatactgaaactcgtaacaattacctctctacgtgatgctgtaaggaatcttgctaatttggtaggaagaggaagcatttaggaaagggtttagtatctaccaaaagtacttgacctcaagtaaccaatagtaatgcaaacttgctttaaaggaaccaaaggcattgccaagtatttgccaaaaggaggcactttttatttaaaatttgagactaatgagatctcaaaaatcagccccaaaaaggtattatccatttaaggttataattttcactaagatgtagatatttctcttattgttttcatgtaaaatagtatagagttgttttgttggtttaagagtaacattcagtagtaatacaaagttttttttctatgtagaaattagttttcttttcttgcttgcaatagaaatgcaatgtgataggtgtttctcttcttattttcattgtcacattatgtcttagcatctcactttatgaaaaaaaggagaaagataccaatctacagagccctgcttgttgaagcactagtttaatcaacaaaaaattatggcaatcgggggtccattcatctattgcctttatgttgttttttaaaagaaaaaccatgatgcctttgtatttgctgtttgcacccctgaaatcaattccatatcatgtttgaatgccatacattttgcacatgtactgtacataagtaatgcatactgtatttttatatgtgtgcacatttatcatcagatcttttgtacatagtggcagtattgtagctgatcgggaaatgtttgatatctcagcaattttgcatttttgtgtctcaaataaaagacattttgatgt

SEQ ID NO: 557525 - DNA, 129 bp, Homo sapiens
gatccaagtatctgccaggccaagccagctcaaggggaatagaactcagatggggccagatcagcctggggtctgagttgatctggaacccagactcagacattggcacctactccaggcagatccagg

SEQ ID NO: 557526 - DNA, 761 bp, Homo sapiens
  misc_feature (80)..(80): n is a, c, g, or t
  misc_feature (151)..(151): n is a, c, g, or t
  misc_feature (313)..(313): n is a, c, g, or t
  misc_feature (365)..(365): n is a, c, g, or t
  misc_feature (438)..(438): n is a, c, g, or t
  misc_feature (440)..(441): n is a, c, g, or t
  misc_feature (449)..(449): n is a, c, g, or t
  misc_feature (452)..(452): n is a, c, g, or t
  misc_feature (454)..(456): n is a, c, g, or t
  misc_feature (464)..(464): n is a, c, g, or t
  misc_feature (512)..(512): n is a, c, g, or t
  misc_feature (523)..(523): n is a, c, g, or t
  misc_feature (528)..(528): n is a, c, g, or t
  misc_feature (531)..(531): n is a, c, g, or t
  misc_feature (533)..(534): n is a, c, g, or t
  misc_feature (537)..(537): n is a, c, g, or t
  misc_feature (540)..(540): n is a, c, g, or t
  misc_feature (543)..(543): n is a, c, g, or t
  misc_feature (548)..(548): n is a, c, g, or t
  misc_feature (553)..(555): n is a, c, g, or t
  misc_feature (557)..(557): n is a, c, g, or t
  misc_feature (561)..(561): n is a, c, g, or t
  misc_feature (563)..(563): n is a, c, g, or t
  misc_feature (566)..(566): n is a, c, g, or t
  misc_feature (614)..(614): n is a, c, g, or t
  misc_feature (620)..(620): n is a, c, g, or t
  misc_feature (623)..(623): n is a, c, g, or t
  misc_feature (678)..(678): n is a, c, g, or t
  misc_feature (681)..(681): n is a, c, g, or t
  misc_feature (685)..(685): n is a, c, g, or t
  misc_feature (695)..(695): n is a, c, g, or t
  misc_feature (738)..(738): n is a, c, g, or t
gcgtgcggctgctctgggtgtgcgctattggtgctgctggcgcgtagggccgcagcctgggactgggccggctcggagangatctccggcgtgcgcttcaccccggtcgtgtgcggcctgcgctgcgtccatgggccgacgcggctcccgntgtaccccgacctgcgcgccccgcaacgccaccagcgtggacagcggcgctcccggcggggcggccccggggggacccggcttccgcgccttcctgtgtcccttgatctgtcacaatggcggtgtgtgcgtgaagcctgaccgctgcctctgtcccccgganttcgctggcaagttctgccagttgcactcctcgggcgccgcggcccccggcnccggttgtaccaggcctcacccgctccgtgtacactatgccactggccaaccaccgcgacgacgagcacggcntnncatctatngtnannntccacgtngagcacccgcagaggcgtcggtggtggctgcaccaggtggagcgtgtntctggcccttnggagnatncnnacnctnagncggtngcgcnnncngaancngcngcgcgggcggaggcggcagcgccctacacggtgtttgcacagagcgcnccgcgngangacggctactcagatgcctcgggcttcggttactgctttcgggagctgcgcggangcnaatncgcgtccccnctgcccgggctccggacgcaggaggtctgctgccgaggggccngctttgcctgggggcgttcacga

SEQ ID NO: 557527 - DNA, 246 bp, Homo sapiens
tagcaccatggtcaaacagaagctatattttgcatattagagactcagccatccattaagaacccatgtcgtcctctggacctgggaggcaatataacttggttttaaatagtatagaagaaaacttgtgatctatatattaatgtatcaccttcattgtaaatttagcaggaaatgcatcacaattataatttttttttgcaccagtgaaacaataaagatgctattgaaacttcggaaactagg

SEQ ID NO: 557528 - DNA, 241 bp, Homo sapiens
cgatctgtctgcaggcaggctgaatgcacttccgtgagtgctaggtggacctggccaggaggcagctgggggccagcgctggaagggcagcagagctctgggctggcacatgctctgtaggcatgggcaaggagggccgttgagctgaggggcccacggcacaagttggttttaggaaaaagggtgtgggccattggccgcgcgaatgcaagtttccacagttctagttaaggtgagacat

SEQ ID NO: 557529 - DNA, 205 bp, Homo sapiens
tgtttaaagaagagatttattttattatttaactttaaaagtcacaaatatgacttataaaaagggttctgagacacagaaaatatagacagaaaaaaatcagagtagagaactagaattacagaaacctaagaaatactaatactgagctttctatcacacaagaaaatgcacggaaatgaattatacatggataccaaattgt

SEQ ID NO: 557530 - DNA, 419 bp, Homo sapiens
tgatagacatgtgtcaaaattcaacaaacattgtccttttattcctaaatttgctttttactccaagccaactatcatccctataaagcggtggggatttgcgaaaatcacagtgtcctcagagctctataaagttaccgtcaaagtggggaggcaacgaggtaaaatataggagaggaagagaaggaaaatatttcaaagtatgccttttgatacttttgaattttcagccctgtgattatgttacctactccagaaaataaaattaaagaggagagactggtactcaagtttctgcattatgtaatttagaataaaaaagtactcttcactaagaaaggaacagaggagaaagaagagaatttgttaaactttttgtcacgtgtggaagagggcaggaaaagaattgttggggacag

SEQ ID NO: 557531 - DNA, 449 bp, Homo sapiens
  misc_feature (99)..(99): n is a, c, g, or t
ggagtctcatttgttagtttatagtggtaactaagggtaaactcagggttccctgagctatatgcacactcagacctcttgtgctttaccagtggtgtntgtgagttgctcagtagtaaaaactggcccttaccttgacagagccctggctttgacctgctcagcccctgtgtgttaatcctctagtagccaattaactactctggggtggcaggttccagagaatgcagtagacctttgtgccactcatctgtgttttacttgagacatgtaacctatgatagggaaggaactgaatttctccattcatattttataaaaccatttctaagttttatctttccttgtggccttataacgagtgtgccagtgggacaagtggactaccgaacatgaaccttctaggctaagcaaaaagatgctggagatattggatactctcatttaac

SEQ ID NO: 557532 - DNA, 228 bp, Homo sapiens
cttcatataaccatatctaatcatatgttcatatttacatcatatacataaatcatcatcatatatgtatacacaataaaatcttaagatatatatagcataagtattctctatacagtactagtacaatatgtactccagaactgttgctaagtatgatatctatactcatatctataatctttgtctacccattacctgagaggtattaccctgggtagtcacaga

SEQ ID NO: 557533 - DNA, 112 bp, Homo sapiens
ccggtaacatgagataagcctccacttgctatggtgatctgccgcagaggatgcccgtagaaagggaaatcagaggacaagaccactctcgaagcctgccggttgaagatct

SEQ ID NO: 557534 - DNA, 149 bp, Homo sapiens
ggtgtctgcagctgctgtatgcgaagagagtttggcgcgatgtctcacaccattttgctggtacagcctaccaagaggtccaatcttccggataccagatatagcctaattacaaagaaagcattaacctggctctgaggtgactaaag

SEQ ID NO: 557535 - DNA, 329 bp, Homo sapiens
catggagccattatccccattggcagaaaaatttttttttaaaaaaaaagactagaataacccaagaaaccccctttaggattatgcttccctcaaaggaggcaggcagggaggaccccccaggggctttaaaaccctgggcatgttttctttttccaattgggcaatggggacaaggacgttccctgtaacgggctttttctttcgtctttttttttttttttttttttgctcctggcaaactgtgcgtgacattctttatggctttttgtatgtcaaaaacttcatactaaactttttaaaaaattaaactttaatgatgggcccca

SEQ ID NO: 557536 - DNA, 162 bp, Homo sapiens
gaagctttactgctagacactaaacaacacgaattaatagtcaacataaagacaactaacaggttgtgacacaaccatcagcaggggaacatagcatagaccacatattatcctcatagtctttctataaagtagattatatcatcatcattatgtagatag

SEQ ID NO: 557537 - DNA, 94 bp, Homo sapiens
ggatttgctggtgcagtacaactaggcttaatagggacatgggtttaaggctgtaaatgttcccctgagtactgttttgtccatatccaaaaaa

SEQ ID NO: 557538 - DNA, 430 bp, Homo sapiens
ggccgccttttttttgtatgactaggtgagtatttttttgtatctttatgactctttgattagtttactctgaatgtccttcttcaagctctataacagagagctgtgacaaactatgtaataaataggattcaattatcaccagaggaggaaagacaaacaaaacccagaggaaaccaaaattctttcctatgttaaaaaaaaagagacagagtaacccaataatcacccaggctggagtgatgaacagctcactgcagcctcgaccttctgggctcaagcgattctcccacctcagcttactgagtcgctgggacaacaagtgtgtgccaaccatgcccagctaatatttaaatttttgtgtaagagatgaggtctcactatgtagcccaggctggtctaacactcctgagctcaagcgatgtaccca

SEQ ID NO: 557539 - DNA, 346 bp, Homo sapiens
gagaccagcctggccaacatggaaaaaccccatctctactgaaatacaaaaattagctgggcatggtggcacacgcctgtaatcccagctagttgggaggctgaggcaggagaaccgcttgaacccaggaagcagggttcgcagtgaggtgagacgccactgcactccagcgtgggtgacagagtgagactcggtctcaaaaaaaaaaaaaaaaaatgctgtgggcacattatagagaattgaaatcaaataacaaaagggaaaggaaagtgactaatattgctattattttggtacagtttctttctttctttttttttttttaattgagaccctgtctcaatta

SEQ ID NO: 557540 - DNA, 118 bp, Homo sapiens
ggatttgctggtgcagtacaactaggcttaatagggacatgggttggcagatttgtgaggtgatgcctgcaacacatatgtgcctagatctagtctgattcctaaaattaaaaaaaaa

SEQ ID NO: 557541 - DNA, 243 bp, Homo sapiens
gaactcaccatattggccaggttggtctcgacctcaccatattggcctcaggtgatccgcccgcctcggcctccaaaagtgttgggattatgggcgtgcgagcccacggtgcccggcctgttttattgtttgaaaacaagtacaggttgttattatccaggattgttgatagagtatatactgtatttgagtgtagactgaggcagagctgattaatatactagttacattgtagcctccaca

SEQ ID NO: 557542 - DNA, 154 bp, Homo sapiens
ttgggggggaaaaaatttttgaaccccggactttaaaaccaaaaaaaaaattttttaccccggggaaaaggttgggaaaaaaacctgggaaggaggtattattagaaaaaaaaccctttaaacccccgaggaaattccttggaaaaaaaaaaaa

SEQ ID NO: 557543 - DNA, 274 bp, Homo sapiens
gtcggggttcagtagttctgctcctgtctgtcgctcccgttcagatatcctcagtacttgctcgtctatatgtcgacatgtttgaagcccagaggttgatctcggggctcctacttacagtctgacctgccctatgttagctgtctacatgtgtcgtctaggcaggtgtgtgtggttgtctatcttcatgttagtacacccttttcaccttcaaaatcctatgcgcacctcaaactcagcaagtgttaactgaattagtcatctttgctgccat

SEQ ID NO: 557544 - DNA, 361 bp, Homo sapiens
  misc_feature (128)..(128): n is a, c, g, or t
  misc_feature (205)..(205): n is a, c, g, or t
  misc_feature (220)..(220): n is a, c, g, or t
  misc_feature (250)..(250): n is a, c, g, or t
  misc_feature (260)..(262): n is a, c, g, or t
  misc_feature (321)..(321): n is a, c, g, or t
ttgtgttaagcagccagggccacaggagtgatagaagatggagacccgccgtctggtcatgatatggggggcctgggcggtggcctcgcgggcgggggggggtggtcctcttcggtccggggtgtgtntgtgagactaatgactccatgccctcacatggccactcctctcacagcagacagcttcactccgctccggccccggngctgcggtctgtggnggtttgcgtgggggtggggtggggtctggnggttttgggnnnggcgcggttctggggggggttggtggtgggccggggctcgatctatgcggtgtttgggnggtggttgggggttgtggcgcttcggttcttttcgggggg

SEQ ID NO: 557545 - DNA, 1198 bp, Homo sapiens
cggagatcatgagcatgatctggaacgcggctcaatgaccatggcaagaactggcgtcacgtttacaatggccatgacagctgatgagagtaacctcatcaagcaccggcatcgtgagcgctgtgtcagccagccagtgctaaggcagcacaccatgtcactgcctgtgcaagcacgctgacaggcacttccagtcacgtggacctgcgcacggcacaggcaccagggacgtgaacggtgcagtgagacaagctcaagcagcatggtggcccttgcatgccgcgcacgagagacctgagctgcagggcaagcagccgggctgcacggcagcatcaagacaccacaggaaaaacagctggcaacaggacacgaccaacggaccatcaatcaggcacgacatgatggagacatcagagacaccaccccatcccgaaggacagctgaagaacacgagccgatgagcccagcgaagaaagcgaagcagagagagaacagagaaggggaacgacatgacaaagacaatcacaaagccatgaggacacaccatggagaccctaaatctgaaagagcacaaacaggggaagaccgacaggcgcgccacaagaaagcccaaaatagacacacaccacacggaaatcacacctatgaccacagagagaacacgcaccaggacacggggacaccagggaacagaggaccacgcgcaaagggacagacacacaacagaacacgatgggagacaacacaaacataaacagacgaaacagaggaaaaggacccccggaaacgagaaacagggacacgggcccgacagtggaggaactaaccaaggcgcggaacccgggcacacgacgcggtgacaaaacccgccgaagggaggaacagagcaggggggagaggggaaaatagagcaccaacacaagtgagacagcagaaacaacagggacgacaacacaaccaggggcaccaacaacatcaggacacagaggaaaagagacaggaccaaagacaggaaacacggcgggcagaagaacacctagccacgccgcgacaacccccaacggcgccacacgggcacccgcccgccacaccccacacaccgatcacacaaccggcgacaaccgccaaatcggccccgccacgcgcaacagggcccaacacccacaaacccgccagcgaccaccccccaccaggcgcc

SEQ ID NO: 557546 - DNA, 266 bp, Homo sapiens
  misc_feature (33)..(33): n is a, c, g, or t
  misc_feature (100)..(100): n is a, c, g, or t
  misc_feature (127)..(127): n is a, c, g, or t
  misc_feature (243)..(243): n is a, c, g, or t
taaagaattagaacaatgcgagaagcttgtctngagatgccctttttaaaatcgtttctggccgggcgcagtggctcacgcctgtaatccaacaattttngggaggctgaggcgggtggattacttnaggttaggagttcgagactagcctgcccaacgtggtgaaaccctgttctctactaaaaatacaaaattagccgggcgttgttgcgtgcgctgtgatcacagctacttaggaggctnaggcaggagaattacttgaacct

SEQ ID NO: 557547 - DNA, 229 bp, Homo sapiens
tttttaaggacatggtctaactctgatgcccgggctggagtgctggaatgcaatgacaccatcacagctcactgtagccttgacctcctgggctcaagcgatcctcccacttcagcttcccaagtaactggagcttgaggtgggaggatcacttcggcccaggagtctgaggctggagtgagcttttattgagccactgcactccactgcacagagtcagaccttgtct

SEQ ID NO: 557548 - DNA, 965 bp, Homo sapiens
  misc_feature (3)..(3): n is a, c, g, or t
tgntatagagaaaaaagctagaaagcaacacagaggcggacacaagcagcaggaagcgctacctgttacgttagttgctgcaggcactatgcgaggagtgtaagcctgcgctatgcctccccccatggagatcgtcagcaagcaggagggtgttaaggaaccacaggcttctaacaggaaaagggctgcccaacacgcgtggggcccccgaagaacctcaagtggtggcacaaatcggctcacaagtccgggattttccgtgtgcatagggccctgtcgggcgtcccacaccccagcgcggtgtgcacggccaacaccaccccggggcccacaagcaccacgtctcctggggtaccgcgcgggggtcccccgatttggggatttggttaccgcgcgtgtgtcaaggaggccccggctacaccatcagcaagggccctccttcctgggaacaaaattcgggcagaacacggggctagccagggccccagggcagtttctcccgaggagcccatctgcccgctccgtggtagttcgccccctctatggcaagctgggtggtctcctgcgcagcccgccacatccgtcgtgtgtttgcggcgccgccatcccacagcgctcttctataggaggacggagaaaccaaccgcgggcaacaggaggaagagcaataaaggcttctccacactacgcgagagaccgcccacctccgggcccgcgcaaagaaacacaccaagttcacccacgtggtgtgtgggggggccccacgcaggagacgctctttcttggggggtgcgcgaaggccggggtacatccaccaaagaagacccggggggagccgagcagtggaatcccggaagtcgggatactccgtgccccccaccccaccgcaccgggggcacacgagaaggaacatcgtttcaaaaaaaaaaaacccaccaaccttttgctgggtgggaaaccccaca

SEQ ID NO: 557549 - DNA, 253 bp, Homo sapiens
tttagagaccatgaaatcacgcgttatgttcagtaactgggacaggctgggagggatattttttttttgagacaaattctcattctagttgcccaggctgaagttgcaggggcaaagtctcagctcactgcaatcttcacctcctgggtcaagcaatctcctgactcaacctccttagtagctgggattacaggtgcccaccaccacgcctggttaattttgggtagtgtctagtaaagatggggtttctgta

SEQ ID NO: 557550 - DNA, 258 bp, Homo sapiens
actgctacctgtgtgacctaagcattcagctgcagggactacttttgcttctttagctttagacttcatcgctgcccatgaatgaccctctgggcagactcaggtatcccttcccagagctattgatgttcttgagggtactcgactatccatctgcccgtgagctcttcgtagaaaccggtagtagttgtgtccacgagaagaagataggtctattccactgtgggcagtccagcaatgagagccggccatcaagtc

SEQ ID NO: 557551 - DNA, 305 bp, Homo sapiens
catcaacttttctaagactctggtttcctcatctaaggatatagcataataatgaaacagactgtgtcgtgttacggtgaaattgaactaagataatgtagtcagcccagtctggtacgtggccagaacttaacgcaagcgagctctcaccatcaaaggagtgcagcttactctagagatagccttgactaggtgattcccagcccttgaggagatgattcttatatacccctagggattagagagtaggtttatatatccataccctaccttaaagacattaccgtacatattgttagcctacc

SEQ ID NO: 557552 - DNA, 299 bp, Homo sapiens
tgcttatacccagtgtgattgagtagtaagaactgtttcgtgatcctacaggtgttgtgacgtgtaataacctggaggagtatgtgaatggagcctactatggtgtcgaataggaagtatgtgcctgcgttcaggcgttctggctggttgcctcatcgcgtgatgatagcccaggtgcggattcgtgtggttacgaagaacatgtgtaatatgattagttctgtggctgtgaatgttataattaaggagatttgtagggagattagtatagagaggtagagtttttttcgtgatagtgg

SEQ ID NO: 557553 - DNA, 327 bp, Homo sapiens
  misc_feature (4)..(4): n is a, c, g, or t
  misc_feature (111)..(111): n is a, c, g, or t
  misc_feature (116)..(116): n is a, c, g, or t
  misc_feature (162)..(162): n is a, c, g, or t
  misc_feature (169)..(169): n is a, c, g, or t
  misc_feature (244)..(244): n is a, c, g, or t
  misc_feature (252)..(252): n is a, c, g, or t
  misc_feature (260)..(260): n is a, c, g, or t
  misc_feature (263)..(263): n is a, c, g, or t
  misc_feature (288)..(288): n is a, c, g, or t
gatnttgtttgcatcgtttatataattagacagttttttagactaaatttgtgtccaaactaatacgcacgggaacgggctccagctgcagctccctgggtttgtgaggtnggggngcggttttactggaagagcgggtatgtcttgggtaggcgcccgttnttattcnatagggtggtctggatgtgctcatacgtgggcaggtcagttaggtcacccagggcggccactgccggcttccatnggagtatnttagaagngantttttttacatcttctggttttatnttgtggatgagcgtgcacatctcttgcggtatctttttg

SEQ ID NO: 557554 - DNA, 291 bp, Homo sapiens
agttataaagcaagaaaatatacctcatgcaagtaacagggacttcgaactatataccagagagagctgagtgaaaatcaggatgaagttgaacacaaggaagtcagtgttcacacaatgagaggttcccattaaggatgtcgaggagggacatggagaagaagagtcgggcatgggtgcaggagaagacagagcggcacaaggcgccaaggcaggaacgtcagacacatgacaacccagataaaaccggccgaaagcgaatataaggtgaggagggtacaagaacatcga

SEQ ID NO: 557555 - DNA, 896 bp, Homo sapiens
  misc_feature (120)..(120): n is a, c, g, or t
  misc_feature (126)..(126): n is a, c, g, or t
  misc_feature (164)..(164): n is a, c, g, or t
  misc_feature (220)..(220): n is a, c, g, or t
  misc_feature (274)..(274): n is a, c, g, or t
  misc_feature (309)..(309): n is a, c, g, or t
  misc_feature (315)..(315): n is a, c, g, or t
  misc_feature (323)..(323): n is a, c, g, or t
  misc_feature (325)..(325): n is a, c, g, or t
  misc_feature (343)..(343): n is a, c, g, or t
  misc_feature (352)..(352): n is a, c, g, or t
  misc_feature (370)..(370): n is a, c, g, or t
  misc_feature (401)..(401): n is a, c, g, or t
  misc_feature (432)..(432): n is a, c, g, or t
  misc_feature (437)..(437): n is a, c, g, or t
  misc_feature (452)..(452): n is a, c, g, or t
  misc_feature (457)..(457): n is a, c, g, or t
  misc_feature (464)..(464): n is a, c, g, or t
  misc_feature (467)..(467): n is a, c, g, or t
  misc_feature (474)..(474): n is a, c, g, or t
  misc_feature (488)..(488): n is a, c, g, or t
  misc_feature (502)..(502): n is a, c, g, or t
  misc_feature (510)..(510): n is a, c, g, or t
  misc_feature (527)..(527): n is a, c, g, or t
  misc_feature (558)..(558): n is a, c, g, or t
  misc_feature (563)..(563): n is a, c, g, or t
  misc_feature (576)..(576): n is a, c, g, or t
  misc_feature (593)..(593): n is a, c, g, or t
  misc_feature (622)..(622): n is a, c, g, or t
  misc_feature (631)..(631): n is a, c, g, or t
  misc_feature (633)..(633): n is a, c, g, or t
  misc_feature (659)..(659): n is a, c, g, or t
  misc_feature (679)..(679): n is a, c, g, or t
  misc_feature (685)..(685): n is a, c, g, or t
  misc_feature (696)..(696): n is a, c, g, or t
  misc_feature (746)..(746): n is a, c, g, or t
  misc_feature (748)..(748): n is a, c, g, or t
  misc_feature (780)..(781): n is a, c, g, or t
  misc_feature (784)..(784): n is a, c, g, or t
  misc_feature (786)..(786): n is a, c, g, or t
  misc_feature (888)..(888): n is a, c, g, or t
cagatgcgatccagcggctctgggggcggcagcggtggtagcagctggtacctcccgccgcctctgttcggagggtcgcggggcaccgaggtgctttccggacgccctctggtcggccanccaaanccgcgggcgctgatgatgggtgaggagggggcggcaanatttcgggcgcccctgccctgaacgccctcagctgctgccgccggggccgctccantgcctgcgaactctgaggagccgaggcgccggtgagagcaaggacgctgcaaanttgcgcacgcgggggctgggattcacgcccaaaanttcaanaggcaaanantccgaaaccttcccgcancggagaaanagcttgagggtgcgctanacggcagcctccgccctcggttcccgcccanaccgggcagaagatcttggaggagccaaaanagaanacaaaaagcggccangacancgtgcancanctggganccgccgttctcagncttaaaagttgcanatattggnggctgccccgagagggnacagtaccccagctccgactgcggggggcangagangacggtacccaantgccacctcccttcaancatagtagttcctctgtaccgagcgcagngactaacanangggggcgcggcactcggcgcggagancgggaggctcaaggtcccanccagtnagcccagtgtncttgagtgtctctggactcgcccctgagcttccaggtctgtttcatttanantcctgctcgcctccgtgcagttggggggaaannaananacttgcgcgcacgcacagtcctctggagatcaggtgggaagagccgctgggtacaaagactgttcagagcctcttcccatctcggggagagcgaagggtgangctgggcc

SEQ ID NO: 557556 - DNA, 1169 bp, Homo sapiens
ttctttctaggttgtatctcccacttcacccgttctagaccagtcccagaagatctagtaagtatttcagtctgggaatatcacgtagcgagttcttggaacgggacaagaaggaagcatggtagggttggaactaaaagacagggccttgaatgacgttccacgcaaagcaggcgttctcaaaccatcggtggcaccacgcaattctgcagacagaaagagaagcttcagaaaacaccaatctagaacgcaacactgcacgagcacacgtaaaactgagcagtgggcctctctcaggacaagacagacaggctggtcgcaccagccacgaacaacatccttgaacgcagtctctcccgagtgaagcatggcggtaggctcgctcgtgcagaagaacccccctatcagagaataccgctgcaggacaggcacacacgataatgaaacaatgccagaacgactacctgggacacacggcagatggtaggcaagtcaccaggcgacaggcagcgtcaggacccactacggacagcacccaccggggccccgaggcccgaatcccccaccctgcacggacccggctgaccgacggcgcctgaaccgaacactagcacactggagagccacacaaggtgacacgacttccgtgcacaggaacttcaacacccacatgaccttaggctctcgaacggaacttgggcgaacctctacagcttatcccagtgacaagaaaggacagacatagcttcacacaccttcccctggcccagagtaaaacaacatggtccgcatcgcaacatcctttcaccgcgacgtatagcacacatggcgagacacacctgcataggacacactgagcatggactaaccaaatgggcaattactcccggcagcaaactgtcaacactagtacggccccgatccataacaagcacgcagttccaacggtgtacacgctgtgagcaaccaagaggggccccaacacctcgcacgaaagcccaccagcacatccttgcgactagccagtggggcaacccacggaagactcccctacccccaccctgtagaagatacacagcattggcgaccataggaacacagttgtccagacatcacatcaaaccgcgtcgtagaaaaccgtacaaaatcggccaacaggatgcaccacg

SEQ ID NO: 557557 - DNA, 428 bp, Homo sapiens
  misc_feature (174)..(174): n is a, c, g, or t
  misc_feature (176)..(176): n is a, c, g, or t
ttttttttgaaacggagtcttgctttgttgcccaggctgaagtgcagtggcataatctcagctcactgaaacctctgcctcccgggttcaaacgattctcctgcctcagcctcccaagtagctgggattacaagcatgtgccaccatgcccagctaatttctgtattttagtananacaaggtttcaccatgttggccaggctggtctcgaactcctggcctcaagtgatccacctgccttggcctcccaaagtgctccgattacaggtgtgagccacccggcccagcccctcccttgtgtttcaaccaatcggaatgaatttaactagatgttagtaacctttttttctttacttctaaaaaagttacagtttactaataaagttaagtctggttctgtcctaaaagaaataaattcactattaatc

SEQ ID NO: 557558 - DNA, 868 bp, Homo sapiens
  misc_feature (22)..(22): n is a, c, g, or t
  misc_feature (53)..(53): n is a, c, g, or t
  misc_feature (71)..(71): n is a, c, g, or t
  misc_feature (83)..(83): n is a, c, g, or t
  misc_feature (89)..(89): n is a, c, g, or t
  misc_feature (108)..(108): n is a, c, g, or t
  misc_feature (112)..(112): n is a, c, g, or t
  misc_feature (121)..(121): n is a, c, g, or t
  misc_feature (123)..(123): n is a, c, g, or t
  misc_feature (129)..(129): n is a, c, g, or t
  misc_feature (135)..(135): n is a, c, g, or t
  misc_feature (140)..(140): n is a, c, g, or t
  misc_feature (158)..(158): n is a, c, g, or t
  misc_feature (175)..(175): n is a, c, g, or t
  misc_feature (181)..(181): n is a, c, g, or t
  misc_feature (187)..(187): n is a, c, g, or t
  misc_feature (196)..(196): n is a, c, g, or t
  misc_feature (204)..(204): n is a, c, g, or t
  misc_feature (215)..(215): n is a, c, g, or t
  misc_feature (221)..(221): n is a, c, g, or t
  misc_feature (239)..(239): n is a, c, g, or t
  misc_feature (254)..(254): n is a, c, g, or t
  misc_feature (271)..(271): n is a, c, g, or t
  misc_feature (291)..(291): n is a, c, g, or t
  misc_feature (301)..(301): n is a, c, g, or t
  misc_feature (308)..(308): n is a, c, g, or t
  misc_feature (339)..(339): n is a, c, g, or t
  misc_feature (362)..(362): n is a, c, g, or t
  misc_feature (364)..(364): n is a, c, g, or t
  misc_feature (375)..(377): n is a, c, g, or t
  misc_feature (387)..(387): n is a, c, g, or t
  misc_feature (389)..(391): n is a, c, g, or t
  misc_feature (396)..(402): n is a, c, g, or t
  misc_feature (404)..(404): n is a, c, g, or t
  misc_feature (410)..(411): n is a, c, g, or t
  misc_feature (413)..(413): n is a, c, g, or t
  misc_feature (418)..(419): n is a, c, g, or t
  misc_feature (422)..(422): n is a, c, g, or t
  misc_feature (425)..(425): n is a, c, g, or t
  misc_feature (429)..(430): n is a, c, g, or t
  misc_feature (432)..(432): n is a, c, g, or t
  misc_feature (434)..(434): n is a, c, g, or t
  misc_feature (437)..(437): n is a, c, g, or t
  misc_feature (439)..(439): n is a, c, g, or t
  misc_feature (443)..(444): n is a, c, g, or t
  misc_feature (446)..(446): n is a, c, g, or t
  misc_feature (450)..(453): n is a, c, g, or t
  misc_feature (456)..(456): n is a, c, g, or t
  misc_feature (461)..(461): n is a, c, g, or t
  misc_feature (465)..(466): n is a, c, g, or t
  misc_feature (476)..(477): n is a, c, g, or t
  misc_feature (480)..(480): n is a, c, g, or t
  misc_feature (482)..(483): n is a, c, g, or t
  misc_feature (486)..(486): n is a, c, g, or t
  misc_feature (488)..(489): n is a, c, g, or t
  misc_feature (492)..(492): n is a, c, g, or t
  misc_feature (494)..(499): n is a, c, g, or t
  misc_feature (504)..(506): n is a, c, g, or t
  misc_feature (508)..(509): n is a, c, g, or t
  misc_feature (511)..(513): n is a, c, g, or t
  misc_feature (527)..(528): n is a, c, g, or t
  misc_feature (530)..(533): n is a, c, g, or t
  misc_feature (535)..(535): n is a, c, g, or t
  misc_feature (543)..(543): n is a, c, g, or t
  misc_feature (564)..(564): n is a, c, g, or t
  misc_feature (574)..(574): n is a, c, g, or t
  misc_feature (588)..(588): n is a, c, g, or t
  misc_feature (600)..(600): n is a, c, g, or t
  misc_feature (624)..(624): n is a, c, g, or t
  misc_feature (629)..(629): n is a, c, g, or t
  misc_feature (676)..(676): n is a, c, g, or t
  misc_feature (697)..(697): n is a, c, g, or t
  misc_feature (727)..(727): n is a, c, g, or t
  misc_feature (734)..(734): n is a, c, g, or t
  misc_feature (740)..(740): n is a, c, g, or t
  misc_feature (745)..(745): n is a, c, g, or t
  misc_feature (759)..(759): n is a, c, g, or t
  misc_feature (762)..(762): n is a, c, g, or t
  misc_feature (764)..(764): n is a, c, g, or t
  misc_feature (769)..(769): n is a, c, g, or t
  misc_feature (772)..(772): n is a, c, g, or t
  misc_feature (776)..(776): n is a, c, g, or t
  misc_feature (779)..(779): n is a, c, g, or t
  misc_feature (783)..(783): n is a, c, g, or t
  misc_feature (791)..(791): n is a, c, g, or t
  misc_feature (793)..(793): n is a, c, g, or t
  misc_feature (867)..(867): n is a, c, g, or t
aacaggaagggatgttggtggnggggggggggtctcttttgcctggactgggnaaaattgacccccgcgtnatgcaccacccncgtccncgtaaaaatgtgcggccancccncccaaaagnanaaaaanctgcanaaacnaagcaaggggaggggganccccaccgccccgcctnaaagcnggtttnctggccgcnaggacttnaaagtttcttnaaaggngcagctgcgcgcgtccanacgtgcatctgtggnggctgtaaatggacttnaattgcccggaggaaaaatnaatgggatgnaaacgtnaaaggaaaaggatttcctgcttccaagcggncctggaaagggaaaaaaccaaancncaaaaataaannnacaccccccncnnncacannnnnnncntgcccnnancccanncancancttnncncnatngngcanntncacnnnncgnttccnaaanntagcctaccnntantnnccnannctncnnnnnncccannncnntnnncccttttgcccatnncnnnntnttttctgnatcatatccaataatactcanctcctttaancttttttttttttnatccactttttnacttccattaattctcctttaacnatacncatttatctaaaatatcctttccccccttctctcaaaattttcttantttttcccccccctttaatanatttaaatctattcacacataaaaaaaacnatatttnctcctnccccnctcctttttttctnaantncattnaanaaanaantaantttttaananaaaaatctttaaattttttttcataaatattcccataaaatttttttaaaatcatttacataatcccaaacctnt

SEQ ID NO: 557559 - DNA, 128 bp, Homo sapiens
ataatcaacggtgatgtagcttacaagtactcgctcagcctcccgagtcgctcgctgacgtacaggcgcgcgccagcagatccggactcattatctctattgagttcaatatagacggggttacacct

SEQ ID NO: 557560 - DNA, 377 bp, Homo sapiens
aaaatgcaggcggcgcctcagtccccagccgagcctgtgtctcaccccctcacaggacagagctggatctgcatagagctggtctcactgtggcgcaggcccctgggggagtgcctgtgctgtcaggacgaggtgctgctgatttgagggccaccactgcagtcctgctaggtctgcttcctgcccaggaaggtgcctggacatgataggagagacatacacgtctgattagacttcatgcaataataattatagcacagaacagtttgggggcctttcctgttccactgattcagctgcaatgacattatacctgtattacctgtcaattttattacctctataataaaatgatacctttcatgtgaagcacagaa

SEQ ID NO: 557561 - DNA, 131 bp, Homo sapiens
tgatctgaggatcccgttgtggccgtggttgtgcgcgtggttgtggggcgggcagatgtcaccgagagagaggggagggttcctcaagttgtgcggaaggcggccaccctgcccacaacccgcgcccacaa

SEQ ID NO: 557562 - DNA, 289 bp, Homo sapiens
ctctagaggatcgcatgttatcgccaacactcactatgcttcgtaattctccaagatctcctcatcagacatattaggcttcttcttctgcttctcagtattccgggtcaaagcatcttggttggagtggtgttattttcagtaggtgaaatgtgagatgtagccacggttccgagtttggagtgacaggaaagtggttcaaatcacgagacctgtggtgtatacacgatttttggtgtgctcctggtgcgttggagcaaatccactaggtgtatggaggataaacatt

SEQ ID NO: 557563 - DNA, 353 bp, Homo sapiens
gcaaattactgatgagaattagcagaacctttatttgtagtggaatcctctacatctagaggagatataaccgtgtatatatgtattctaaatggtaacagttttacctccatgctgctattatatgcaattagttagcaacatattgcgaaagagtactcatccagagtcattagctagctctgtttagcatttcagcactcaatttattggtaactacccccttgataaaacacagagtaagtcagctctagttcatttcattcagttcctagtgattaaaaataatgtttattccacatggcttttcttatcaaatttgaaataatagaatctgaggatcaatggtggat

SEQ ID NO: 557564 - DNA, 149 bp, Homo sapiens
ggtgttctagaggatccctttcttgccaagagttggtacgcctgttcttgtacaccaactggttttgtaacagttgcgagaaccttctccttctttttctttcaaccttctgagtcgtgtgcaagcaatgagtcgtgtgctagacatgt

SEQ ID NO: 557565 - DNA, 281 bp, Homo sapiens
ccagtctggtgtcaaagcttaacattttctttggccttttagtttaaaaagttaatgaaataacatttttctcagggccctttagtagccctgagtcaatgatttcccgattttaatttttcaaaaggggggcctccgctttaaaaaaattttttgatacttttataaccttatatataaatatgtgtgtaatggggatatataactatatataacgttttttcatgactaccccccctaacagtgaataaaatttttaatgtttttgaacctttaaaaaa

SEQ ID NO: 557566 - DNA, 747 bp, Homo sapiens
  misc_feature (12)..(12): n is a, c, g, or t
  misc_feature (708)..(708): n is a, c, g, or t
agcgggcagtcngtggagaagccggtccgggcggaggcagcagcagcgcgcagtccctacggcctgcgcgcggacgcgtgccctcgtgaccgtgacaggcctctctgcgaaggtgacgtgctgtgtgctcgtactgaagtgagagccgctggagagttcgggactggtggagtcccagaaggcggcatgtggtcagctcgcactgttagtgagagcgatttcatctgcggaagtggtgcttgctgctcaacacgtggactgaatgtatagagcgtccgctgcggcggcggcagagagaaggctgtgcggaggtcgctcgcccgcaggcgctgacagacgtcgcactggaaagaagagccaaccggaactgacctacactgacgtcgaatcgagctgaccgacacgctcaaagagcctctctcgcgtggctctgctgcctcacatgccctggctttccgccacgtttccgatacagcgctgactgcgtagctggaagcgtcgcgtgtggcacgaggattctccggaggttcaacgacttcagagactcttgtgagacccacgagcgcagactccgtgacgcgatgcattacggtagcgaaccgcgcaactgtgtggaccgagctcgcgtcttgctcgttgtgcgcccatatcgtcgcaactcagacgcgcgtccttccgctgcagacatgtctaccggtgcatgacatnttgatgagcgcacggcttagcgaggtgcgtggacgcaca

SEQ ID NO: 557567 - DNA, 341 bp, Homo sapiens
cacgggtgattaataaccttcagaagtttcccacagaggctcagactctgggcaagaaaacgagaaccaggccccagggctgatagcgttaccttcccggcacctcaccagagtctggagcttccctggactgatggagaggggactgtgagagatgatgggagccctgtgtaagatccctgtttgaaggaactcagtcattgtagaggagatttcatggaagttcaagatgagtaaattccactaccaatatctgaatactatatagatgcaatgacatactctatatcagagatttactgctaaggcagtgacgctacatcgtgatgagtgggatatct

SEQ ID NO: 557568 - DNA, 390 bp, Homo sapiens
tgatgaaagggagtcatgaccagcaaacctttcttctggtcatcgggcatgtcgcgtagttcttggcgaggctatccagcaatgcctcattcacacccgctgccagggcccctgtgcggaaatctcctccagaagcctcagctgccaacccgcccatcaaggcatgtagcccaatcttggtaatgccaccttctgcaaaccggttcttggaaacatccccgaccaggttgaatccataagccgcaaatgcgttagccaaactactctacaacgcgtcgccaagacgggcttcgcccccgagcgcccgatctaccaatagtgatgttccgttttgcagtacttggttggccgtgaactgccccacaccttgccaagtgctcaacggactta

SEQ ID NO: 557569 - DNA, 372 bp, Homo sapiens
  misc_feature (22)..(22): n is a, c, g, or t
  misc_feature (92)..(92): n is a, c, g, or t
  misc_feature (193)..(193): n is a, c, g, or t
  misc_feature (323)..(323): n is a, c, g, or t
tggactcagtcggctcatgctngtacttgcagcactttgggagtctgaggtgggaggactgtttgagcccaggagtacatgtgcacaatgtnaggttagttacatatgtatacatgtgccatgctgctgtactgcacccattagctcgtcatttagcattaggtatatctcctaatgctatccctcccccctnaacccaccccacaacagtctccagagtgtgatgttccccttcctgtgccatgtgttctggaaacgggatttcctcatataatgttacacagaagaattctcagtaacttatttgtggtgtgtgtattcanctcacagagttgaaccttccttcagaagagagcagatttgaaacactct

SEQ ID NO: 557570 - DNA, 983 bp, Homo sapiens
  misc_feature (513)..(513): n is a, c, g, or t
  misc_feature (712)..(712): n is a, c, g, or t
  misc_feature (902)..(902): n is a, c, g, or t
  misc_feature (983)..(983): n is a, c, g, or t
tccactagtgtaggcctacgctttgctttggacagcagatcttgaacttcgcgaggtttgcagctaatcgcgatcaataacgatgtcgcgatcagcgcaccggcgggagtagtgaagaactcgattacagagtgttggttctttgggatggcgtacccggcgatcaggagcacgaaaaatacagccagaggcagaattaccttgataaccgagtcctgataagcggttggatcagtcggatcattgggggatgaaaagtccgtgcgggtcgtccagtaagtccagatcgttccggtcatccaggtgacgactgtgagcagcacccctagatacagaaattttggttcatgagtgttggctcctagtccaatcccaatgatcagtgggcctgcgggcatcagaagcttgaaccctgagtagcatccgatcgcaatgtacttcctgtgttggcccgcgatgggagcaagagaggcgtaggccgtatcgggacaaaccatcccggcacccagaagnggtgatagagagatgccgaattttccgaaagatgcacttccttgcgtcgagatccaccctgcaatgaaaaacgcgctcaggatgacgatggcgaaataaccgaggttgtttccgaagcctttgctcagcgattggaatacgtccccgctgctacttccggcaagaagtgagatcagaatcgcgcccagtagcatcgcgncagggagaggaatggaaacgctgctccataggttccgtaaccgggagcctgttttcgtcctaagcgcttctaccaacatccatgtacctccaagcgttaccgaaaccgcctctgaaaggcttgaaagccttacctccaattcacaatcgcaaaatacgttgcgcatcgcaactaatatcttggaacaatntcgctagcccttatgcccataaaaatgtgtcgctgcgactcctaaggtggtattagcggttcccccggaattgcgagccgn

SEQ ID NO: 557571 - DNA, 130 bp, Homo sapiens
cacgaggcctactttatctacggcgaaattgacatttggggctctcacggtaacatagaggtcaagtgacttctcagatcgccaggctccattctctctccaccgggttgtgtccctgtcatgggagtgt

SEQ ID NO: 557572 - DNA, 569 bp, Homo sapiens
tgggggcggtttttcccaggcaattaaccaagggtgggatcacccggtcttgcccccaggtggaaatgtatttggactttgttcgggttcccctccagggccctttattaccttgcttggggtcaactgacagggggtttggccccagcttgtggggattacccgatccgggtggttcaggagggttcccacttgggttcccagcaggccccctttttcctggcaggccccttggatcagggccctttcccggatgttaactgtgtgggctgggacccccaggagccaggggttctggcctccctcagtgatgatggggggggggccttttggaaggatcaacggcctgaagggcttttgggttcctcggctttgggcagaggaatggctcccccgaaaacgttattttaggcttttcccggccctgggggggcccggggggggatccttggcctttcttttacttgggtccctttttttcaggcttggggggaagggcagagccccagaattggtttcctttcccgccttttacatggggccttccgttaaggggttccggacctgga

SEQ ID NO: 557573 - DNA, 1004 bp, Homo sapiens
gcgtgcgacgagtgtgggccagctgccacaaggttgaagtcccaggtggcctgtgtgactcctgccagcggctgctgaaccttcccctgtgcccatcctcaccagctcaaggggtcatcatctctgtgtcaccatgtccacacatgatgggacagagcagctatgatcctgcagccaatgaccctcgctgtatcaggccatatggcggagcctccgcattgcccccagcgcccattttccatagggggttgtaatttataagctgacgaaggtagccagaattccggagtgactgagtcatctctcacatgtccatcctccaccgttcgttcctcacgacaacgacgacacaaagccgtatctgcacttttgagtgtggacacgatttactgtacaggttttcatttgtgtaacagatagcatccgttctcataggcttgaggcaacgagaaaagaagaatacgtcggagaggaaagaacagaaagacgtacagaaagcagagacagttatggactgtcagggcgcgttgatagtcggtggaggtagctccggccagaagattcattcgtggaatttgagaacagtaggtgatattgggggtaggtgagagtgagagaattgtaaggtgatacgtcaagggaggcgtaaaagggtagtaggtggtagaccgggagtaggaaagttgcgggtgtaattgcgagcattggcggcgtcatgtaccgagtgtgaaagacagagggatttgaggtaagaagtcaaggattaggaacgcaagtgtatggcagctagtctgttttgcgctaagtggtcacctttccgtccgactacagctctggcacgtctaagggaaaaagagtcgtagccacgcggacgcgtgctccccatagcagaggccgcgacgggccctcaactgatgctgggacgacaggacgcacccatacggccaggcaagcggcggggcaccttcacggcacggcacaggtgccccaggggaggacaaaga

SEQ ID NO: 557574 - DNA, 742 bp, Homo sapiens
agtttggctcttgtggctcaggatggagtgcaatgacgtgatctcagctcactgcaacctctgcctcctgggttcaagtgattctcctgcctcagcctcctgagtagctagggactataggcgtagtaaccgccatagcctggtcaaataatagtagacaaaaaaaaaagaacaagagaaacaccagaaaaaacaaacaaaacaaaaacaccaaaccacaaagaaaccaccgaccaaaaaaaaaaaaaaaaaaaaaacaaacaaaaccaccacacccaatgcaaatagaagaccgaggctgagactataaaggcctacaagagcggacagagagagcgagagaagaagcgaagagaagacgagaggaaagaagagagaccgataagcgggaagagcgctagacgagctgccagcgcagcaacggagaaggcgacagagcgcaggcgagagaaggggagagacggacgaggaggagaagaggagagaccgtggggaaagcccgaatgaggacggagaccgaggagcgacggacgggcggaggaacccagggtaagggaggaaccgaaagccgacagaggcgggagcgcggagaccgaagtaagagaggagagagagtgagaggcagagccgaaaaggggacggaaaggcggcggaggcgagagaccggggggaaggcggggggggagggaggggcgggggggggggagggggaaacgggaggtggggagccgggggggtgctg

SEQ ID NO: 557575 - DNA, 315 bp, Homo sapiens
  misc_feature (168)..(168): n is a, c, g, or t
gggggtccccccaacccccccctttttttccccaatttaaattttgggggttccccccccccccccccgggggttaaaatttagggggacccccccgggccccttggtggttattggggggttttgtttaaaaaaaaaaccgggggggggggatcttttggaaacccnggggggggggggggggggggagcccccatttttggggtttggggccccggtcggggggggttggggggtttccccccccccccccccctttttttttttttttttaaaaaaagcaaaaaagggaaaaacccccgggggcccgggcca

SEQ ID NO: 557576 - DNA, 314 bp, Homo sapiens
ctaacttctcttgatgtaggtttctcgtactagctaggaactaattagaatatagcatacgaagagtaagtaagaactgaaagaactgataggaatactagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgactagaatcaagagccctcatccct

SEQ ID NO: 557577 - DNA, 145 bp, Homo sapiens
tggcccgaaataaagagaaagaaggaaggcaccagagaagttgccaacttcaatatataaaagaattttcttcttttcttttcttctttctctatctctctctctccctttttctctttctctctttctctccttctctttcttt

SEQ ID NO: 557578 - DNA, 212 bp, Homo sapiens
  misc_feature (1)..(1): n is a, c, g, or t
  misc_feature (44)..(44): n is a, c, g, or t
nggggggggagtgtatgtaatgtgtgtgtggtgtgtgtgagggnagtgtggatgtatgtaaggagagtgtggctgtgtgggtctgtgtgtgggggggagtgtgtaatgtgtgtgtgtgtgtgtgtgtgtgtgtgtgtgcgtgtgtgtgtgtgtgtgtgtgtgtgtgtgtgtgtgtgtgtgtgtgtgtgtgtgtgtgtgtgtgtgtgtgtgtg

SEQ ID NO: 557579 - DNA, 483 bp, Homo sapiens
tacagttagggtatctggttcctaatggaagactaaactcatgcttattgctaaatgtggtcttggcccacctaaatttaagatgcagcattttagaagatttacattatccaatgtttctacagtattgttggctaatttttaacataaagtcatgatcaggtgtgcattgggtgatttatatgtgtactcattctcttacctagcgaacaagatcttttcagaggggggtgtttctaaaagagctttgtacaaaagtggcctggtggacatttaggcctgggtgatgcattggctcttcctgtttggttgcccatgtttcaatgtagagttgctctgttttcttcaaactgtattaatggcggcatttctcagcataaacttatcccatggtattttttctatcaaatacacatatttttcttcggaacctttaaaaaacaaaacaaacatcaaaattcaacatgaacacgcaaccagttg

SEQ ID NO: 557580 - DNA, 135 bp, Homo sapiens
ccgatgcttattggagtagggatgggtcggaacagcgtaaggctgatgtgcaggaagggcgcggacgagtcaaagcggagcacggacacgcatttcatgtagttctcacagtggctctcgccaggcaccacgttg

SEQ ID NO: 557581 - DNA, 110 bp, Homo sapiens
ggaggtaggccaaaaaaacggtttttaaatttacaattggggggggaggggtttattaaacccatgaaaggggttcccttgttttggggttaaaaaaatttggggccgga

SEQ ID NO: 557582 - DNA, 863 bp, Homo sapiens
attcatttgaaataatccaggataatattctatttacttaagggacacaaagtaaataaatgttttgaaatgaatggatgaagtggatccagattttcacaggaaaaacaaagtttccttttcccttagttctccttacacacctggctttgcaggaaacgcacttatcattgggacacacacatctgcctcagccacaggtagaacaggcttggactacatgtcggttgacgttgacaatctcagtccttccccaaccatccaaaatatttacctccctcccttgtctcacaatcatctaagctgccttcttgaatgactcccacacctgtgcatcatagaaggaacacacatacaagcaaatgccatatcaaatctctcttcttcaacaaggtcttctgtttgaaatactgaaacagttcctgttctattacctcaccagtgtggcttctatctcctaaagggaatagctgacgtcttaccagtcaaagtccatggtgttacggagccataatatctccttcaatcctccatgataatccccctctgatggtacagcagatcctgtaacatgcaaggggagcaggagagtcttgatgactgtaactaagccctgagatatcccagtcttctcaagaatttatttcaacatgcgtcacaatccggacaatgtgctggatacctatcataattttttaacggttcatgatggacttaatttaccgcacaaaagtgcatgaagtcaagggctgctgaagcaggttgaacaatcgctaccaccgaaacacacaaatgcgcggataacatgggccacaactacttcaagatgtgcacacggccatttccactcgcgtaattaaaaa

SEQ ID NO: 557583 - DNA, 248 bp, Homo sapiens
gtttgccattcttgagtaacccgacagtatcccaagtgatatcgagattcgaaatacgcaacgtctcaactcacattgttgtctgcaaacgttgtctccgtagttatcaaagcggctctaggtggcgtacttcccagtgcctccatagccataggcgaaaggctcttcgcctatctggtttctgcaggagtcctagggaccagccgatacggatcacgtgggagtccgcctgtcttgagggtaccgag

SEQ ID NO: 557584 - DNA, 1317 bp, Homo sapiens
  misc_feature (997)..(997): n is a, c, g, or t
  misc_feature (1021)..(1021): n is a, c, g, or t
  misc_feature (1317)..(1317): n is a, c, g, or t
gctgacaaaatatttgaagaaataatggacaaaaaagtctcattcagtgaaaaacataaacttagggtttacagaggctcagcagatcccaactaggaacaacaatactaacgagaccacagatatcatggcacagtcctagtaaaacctgtggaaaaccaaagaaaaagagaaaactgattaaacagtatcttgaggggagggaaaaccgcattacaaggccaccaataccatggtcagggaccacacaccaagcattaacagattttgactggccttccatagcaaggtcactaggaaccgccggacaggtcacaccagaaggagttctcaacactggcccaggaaggcttcaacccgacacacgcgggggtccaaccgcaaacattaaccccttggtagaaactccagggacaatttctcttaattcctaaactgggcattggtccttgacaacacacaaacaaacttaacgggtggaccccttggcaacggaaaccattttgcacaggcaactttcactttacacacaggcctggacaacagcaacggtttcgggtgaacccaaggttcaaaatttccccttaaagcccctttaaatcaaacggaaaaaaattgggcgtttaaaaaaagggtgttgggttcccctattaccacaggggcgcacaacaacggggggacacacacttaattttggcccacacgaacttggtcggcaacaactccttctcaaagaacttctctaacgacagaaacacaaaggttacacttggtcacaggacaagtttacaccctgtgtggacaacacttacggttagacaacttgttaaggacaaaaccccccttttgtagtaggtaccattgtaaactgcgaaacattatatctgtggggacacaaccaggacaacacaaccatcttgcggggctaaccacttttacacaccagcgaccacacacattttgagggccaggttaaaacacacgacgaagggagganattatatacattataaagtattgngcaccacaatcttataagcgaacactttagggggactagtacgccccattctatcaaagcggccacactggctgcatattatcaagccgatccacctaatgagacaacacaaaaaacccccaagcagcggaccaaacattctctaccacacaacacgactaggggcgcctattaagtgattgacaaagaggccaccaagggtttgagaacacggcaaagcacatatacaacaacaatacaactataaaaacgaacaagtcggcatacttggatactgatacagaacaaccaccacn

SEQ ID NO: 557585 - DNA, 250 bp, Homo sapiens
ctactccccaacagatcaatcatcatgtccatggttgcttacacacaaatttattcctttcacgtcttcactactctccaaatcgtgcatctccatcacttcacttcagttattcattacggagttcctctacagctttccacaaatttcatattacctagtcctatttcttgtgctacagctacgatactctaatcgctggagaatcaggaagtagggccttgcccttggtatacccgccgcagtacag

SEQ ID NO: 557586 - DNA, 925 bp, Homo sapiens
taaggcaggtacgaggcctgggtggtatcttgccccctctgctgatgcccccatggtcgtcatgggtgtgagccatgagaagtatgacaacagcctcaagatcatcagcaatgcctcctgcagcacaactgcttagcacccctggccaaggtcatccatgacgaaactttggtatcgtggtcaggactcatgaccgacagatccatgccatcactggcacccagaagactgtggatggccctccgggaaactgtggcgtgatggccgcaggggcgtcgtccacgaacatcatcccctgcactctacgtggctgcttgccaatagggcgtagtgaggcgaaggctcatcgcctgcagtccgttgaagcaggagaaggcgtcgactaggctatggcacttccgttgtcccgcactggccaagcgtggtcagttggtgtgaccgtgaccatgccgtcatagtaaagaacgcgtgccaacatactgagtgagcactcaaaggaagggtggtgaaagcaaggcgtccgagagaggccccctcaagggcatcctgggctacacatgagcaccaggtggtctcctctgacttcaggacagggacacccagtccttccagctttgacgctggtggctggcattgccctcaagcgaccatctttgtcaagcctcagtttcctggtatgacaacgcaatttggcgtacagcagacatgtggtggtgtgacctcatggcccatatggctccaaggagtaagacccctggaccacagcccagtaagagcacaagaggagagagagagaccctcactgtggggagtcctgcacagtcagtcccccagcaactgaatctcccctcctcacagttggcatgtagacgccttgagacggggaggggctagggaccgaactgtatggtccatcataagtacc

SEQ ID NO: 557587 - DNA, 628 bp, Homo sapiens
agatgaaagacctatgatgtttcatttggcaacattgaaaggagataccatacaagaaccttacagggtgtgagcaaaactgcctgcagaactaacgaggaagagacgatacatgaaggaagaatccactggagattatgacatttgctaaacagaccatacaatagctggatgatttggaaacacagtgcaaatgatcagcgtgacgagaaagatcaccattatggatgagaacacagtgagatgaatctactatgatagaagagcagccaactggaaatgtcaacttgcgacagttcgaactataaatatgcagtgaaacatatgcatggcagaaagagttgaaattcagcgaatgaatcatatcaacgcgtggtggggccgacaagcataagagacggaaactatagatctagtgacagactccaatccaaagaactgacacttgctactacactttatgagaatctgccaggcacttggactgcgcatctgaaagaaagctgatccattcgtagtacgaataacttcgtcgctccattcccgatcacatgtaaatccgctacgtcaaacagtgatgaactataagttagtgagatatgccaagcgcagtcttacccttttggcg

SEQ ID NO: 557588 - DNA, 653 bp, Homo sapiens
  misc_feature (3)..(3): n is a, c, g, or t
  misc_feature (103)..(103): n is a, c, g, or t
  misc_feature (162)..(163): n is a, c, g, or t
  misc_feature (170)..(170): n is a, c, g, or t
  misc_feature (173)..(173): n is a, c, g, or t
  misc_feature (195)..(195): n is a, c, g, or t
  misc_feature (209)..(209): n is a, c, g, or t
  misc_feature (315)..(315): n is a, c, g, or t
  misc_feature (328)..(328): n is a, c, g, or t
  misc_feature (341)..(342): n is a, c, g, or t
  misc_feature (357)..(357): n is a, c, g, or t
  misc_feature (360)..(360): n is a, c, g, or t
  misc_feature (405)..(405): n is a, c, g, or t
  misc_feature (414)..(414): n is a, c, g, or t
  misc_feature (467)..(467): n is a, c, g, or t
  misc_feature (483)..(483): n is a, c, g, or t
  misc_feature (499)..(499): n is a, c, g, or t
  misc_feature (502)..(504): n is a, c, g, or t
  misc_feature (507)..(508): n is a, c, g, or t
  misc_feature (510)..(510): n is a, c, g, or t
  misc_feature (512)..(512): n is a, c, g, or t
  misc_feature (517)..(517): n is a, c, g, or t
  misc_feature (519)..(519): n is a, c, g, or t
  misc_feature (521)..(521): n is a, c, g, or t
  misc_feature (523)..(524): n is a, c, g, or t
  misc_feature (527)..(527): n is a, c, g, or t
  misc_feature (530)..(530): n is a, c, g, or t
  misc_feature (532)..(533): n is a, c, g, or t
  misc_feature (537)..(537): n is a, c, g, or t
  misc_feature (540)..(540): n is a, c, g, or t
  misc_feature (548)..(549): n is a, c, g, or t
  misc_feature (551)..(551): n is a, c, g, or t
  misc_feature (553)..(553): n is a, c, g, or t
  misc_feature (555)..(555): n is a, c, g, or t
  misc_feature (557)..(557): n is a, c, g, or t
  misc_feature (559)..(559): n is a, c, g, or t
  misc_feature (562)..(563): n is a, c, g, or t
  misc_feature (568)..(568): n is a, c, g, or t
atnttcccccccccccccgccccgcacaaaataattctgtggcagggcaaggcttaaatgtgtcccttattaatatgtaaattcacagtaaatatgtaaagcnaaatacttccccccccaaagatcattatctttattgattagcactgaggaccttaacanngtgatanatnatatatttataatttaccatcncttgatgagacccntatccccttatataggtcagccttgcaagtaccattttataagcagctgtgaaatttaagtgaaatgttctttgtaaacatttgtactattttaaatgaataatgnccttatgaagtangctatctgtaggnngaaattataggtacntcngttttcactatatgatattaagaaagcgtgaaatgacttaaatgntcatttttntctgtatagatactttatcatgttttcatgattttaggaattactgctttgtngatattcaaagtgtanacctaaacctttatgnttnnnctnnantncttgncntntnnccnctntnncccnttnaaaataanntncntncncnttnnctttngatgggaaataaggttgtatgttgatggatgaattttggcatgatgactgtactctcaataaaggctgaaaatgttgtataaaaa

SEQ ID NO: 557589 - DNA, 901 bp, Homo sapiens
  misc_feature (901)..(901): n is a, c, g, or t
gaccactggtagcggcagagctcggcccgcgcctcctcgtacccgtgcgccccggaagcgatcccgcccgtgcaaggccgggtcttgaccccagggggtgccagtacatcgcaccggagggtttcccaccttccaaagagaagcctattgtccctaggtgcttggtgggaagctgccaagtgactaacccccttctcatggagccaaaagggtggtggacagactacctcggttggacatggtcccacccataggtgatttggtacacaccaagagtgtctcaggccggggagcaggcctactcgcccgtagctgcatggcggacagtttccaagagtaggaaactcctcccatttttcaccagcacagcgtgtgttaaaatgcacgtcagcgaggtccactcattgaaaccggacgggtgttttgcgtcccgcagccagtcccgtcacaaagtggtcgtctttgtgggcccccccaaaggggtgagggtgtggaccccacgggagcccataaaaggacggattagagggccgtctggtagtacacccttagtagacaacccctgttttggggcgagtaaaagtgcctgtggtacctctgtgccctgagtggtagtagtgcttgggtactcggagggtctagtcacgtgagggccatttgcgctgtggccgcaccttgtgtttggcgacacgggtcgattagggccgtcttcgccacgcggctgctgttggggcgccaccttagggggcgtggctttactggccctaaagaggttactctcactgcctttgaggtgcagttgttacgcggcgaccagtgtgtcttgtgtgcgttttgtgcgacaccccagcgtgttggggggtttcggcgccactccaggcgttgcgctccgtgttttggn

SEQ ID NO: 557590 - DNA, 108 bp, Homo sapiens
gtggttgatctagaggaccctgagctacatgcccagccaataaatagaaaactttttcactcaaaaaaacaacaattgtagtgaaaccatagaccagtgtggagagag

SEQ ID NO: 557591 - DNA, 952 bp, Homo sapiens
  misc_feature (27)..(27): n is a, c, g, or t
  misc_feature (213)..(213): n is a, c, g, or t
  misc_feature (228)..(228): n is a, c, g, or t
  misc_feature (241)..(241): n is a, c, g, or t
  misc_feature (245)..(245): n is a, c, g, or t
  misc_feature (254)..(254): n is a, c, g, or t
  misc_feature (258)..(258): n is a, c, g, or t
  misc_feature (261)..(261): n is a, c, g, or t
  misc_feature (266)..(266): n is a, c, g, or t
  misc_feature (275)..(275): n is a, c, g, or t
  misc_feature (284)..(284): n is a, c, g, or t
  misc_feature (297)..(298): n is a, c, g, or t
  misc_feature (343)..(343): n is a, c, g, or t
  misc_feature (374)..(374): n is a, c, g, or t
  misc_feature (385)..(385): n is a, c, g, or t
  misc_feature (392)..(392): n is a, c, g, or t
  misc_feature (398)..(398): n is a, c, g, or t
  misc_feature (405)..(405): n is a, c, g, or t
  misc_feature (408)..(408): n is a, c, g, or t
  misc_feature (432)..(432): n is a, c, g, or t
  misc_feature (460)..(460): n is a, c, g, or t
  misc_feature (464)..(464): n is a, c, g, or t
  misc_feature (483)..(483): n is a, c, g, or t
  misc_feature (495)..(495): n is a, c, g, or t
  misc_feature (524)..(524): n is a, c, g, or t
  misc_feature (567)..(567): n is a, c, g, or t
  misc_feature (627)..(627): n is a, c, g, or t
  misc_feature (629)..(631): n is a, c, g, or t
  misc_feature (633)..(637): n is a, c, g, or t
  misc_feature (651)..(653): n is a, c, g, or t
  misc_feature (655)..(655): n is a, c, g, or t
  misc_feature (657)..(657): n is a, c, g, or t
  misc_feature (670)..(670): n is a, c, g, or t
  misc_feature (761)..(761): n is a, c, g, or t
  misc_feature (781)..(781): n is a, c, g, or t
  misc_feature (937)..(937): n is a, c, g, or t
ctctttccttttttataaagtgaagangttcaactatccagagagtcccatctaactcaaaaaatgtaatggctttggttggattgcatcttcagtcagtacctgccatggcttaatcagtattttaagtgaatgaatcatgtttccccactagatcattacgagtaagcagtaagtaataaatagagaatattaagtattgaacattattanatgcagctttttctnctgcatagaaganagangaggctccnggcnggnattgnggccacgangagcttccnagacacccacggnnatcagatcttcttcttcctgcaggcagtgccttctggtggaaggngctcagtctatcagagaataaaccaggagcntgaaagcagtnctgtgtntctgcntttaatnagntgtcacttattctctccccaaganagggaaataggtctcagcagtttctgcnatcnatcatgaatcaatgaaatnatttcattaaanatttttttgtatgaatgtgcaaaattgcnaactaggagttcaatgggaaaaataaaaaaaacttagtttgtnaacatgatccatagacgagatgatcttcatgtgttccaaaggcagaaaggtgagaaaaanannnannnnngtctctgtccctcnnngncngaagaggtcaggnagtccaatgggcgatgctcctgtagataaggccaaagcaggagagctgagggtgtccaggttccatgccctgcatcaccaagaaccttctncctggcttgaaatctttggnaattcctggtttgagtcacagagaagcattgtcatgggctcagtaaccctgccacccctgtttatctccattctccctttggtcacagcagctgtcttaagacacaagaccatgcctgggccctatgtaggctggctgagaaggaaggttgctgcnatggcttcgaactca

SEQ ID NO: 557592 - DNA, 486 bp, Homo sapiens
gccagtgtggtggctcacgcctgtaatcgcagcacttggaaggccgaggcgggcggatcacgaggtcaacagttcaagaccagcctgaccaacagggtgaaaccccatctctattaaaaaaaaaaaaaaaaaaaaaaaaaaaaaatgggggggggcccgggcccctcgagagaaaggcgtttctataaacccattccggttggggcgcgcgggggcgccacaggaaggcgtcagggaaaacatggggcgcaataagcgggtgtccctaaggggagaacccggggccaaagagaccaaggggcggggatttctccaccacaatataaaaagagcgccccgggggggaaacacgcggagcgggtttgggaaaaaaaattccgaagagggagagttccgaggggcctcatatacagggggattcatattcacggggggggttccagagggagagacgcgaaatttaaaatttaggccccgcaggggggt

SEQ ID NO: 557593 - DNA, 344 bp, Homo sapiens
catcccggctaacacggtgaaaccccgtctctgctaaaaaatgcaaaaaaaattggccgggcgtggtggcgggcacctgtggtcccagctactcaggaggctgaggcaggagaatggcgtgaacccgggaggcggagcttgcagtgagcgagatcacgccactgcactccagcctgggtgacagagcaagactctgtctcaaaaaaaaaaaaaggaagcttgctgtcttatatgaggccagtagcacttgtaaatagctcctgtcgtgttgtgaaatgtgctataacagagataggtgtaaaatgctgcactccagcctgggtgacagagcaagactctgtctc

SEQ ID NO: 557594 - DNA, 110 bp, Homo sapiens
ttattacgatctagtatttgattgcgtaatcgggcactgtagtaaataataattgaccatttaaaaataactaaaagggtataattggattcatgcaacacggtctctca

SEQ ID NO: 557595 - DNA, 159 bp, Homo sapiens
agtctggcatacacgatgagtgaaaggatgatactagatctcttatactattatccttgaatcattttgattgccacaactaatcctcctcggactcctgtcctcacgcatatacaccaaccacccaactatctataaacctagtccatgggcatcccc

SEQ ID NO: 557596 - DNA, 219 bp, Homo sapiens
  misc_feature (123)..(123): n is a, c, g, or t
gatcaaaaggcacagactagccacagccccacgggaaacagcagtgattaacctttagacaataaacagaaagtttaactagagctatactataccccagaggttggtcaatttacgtgccangccaccgctggtcacacgattgaacccatagtcaatcagaagccggacgtaacagagtgtttatagactcactccccgtctctcgcctaaatgcag

SEQ ID NO: 557597 - DNA, 362 bp, Homo sapiens
gacacaaaccattatgataacccacctgtggtgtagagattgcctatgtttatttaaaaggcatttctcggccgggcgcggtggctcacacctgtaatcccagcactttgggaggctgaggcaggtggatcacgaggtcaggagatcgagaccatcctggccaacatggtgaaacccgtctccactaaaatacaaaaaaaaatagcccgacgtaatggtgcacacctgtagtcccagcctacttgggagtctgaggcaggggaattgcttcaacctgggagtcggaggttgcagtgagctgagattgcgccattgcattccagcccggcgacagagcgagactccttgtccaaaaaaaaaaa

SEQ ID NO: 557598 - DNA, 214 bp, Homo sapiens
gccatgtccaacatccgtgggtcacgtccaacatctgtgggtcagtccaacatcctggggtcagtccaacatcctggggtcagtccaacatcctggggtcagtccaacatcctggggtcagtccaacatccttgggtcagtccaacatccttgggtcagtccaactatcctgggtcagtcccaaaatccttgtgtcagtccaagtatccttggg

SEQ ID NO: 557599 - DNA, 426 bp, Homo sapiens
aaaggggcttttgggaggggcctgggcccaaatgtttgttcaccaggggtgtgggcctaaaggaaaaaccaaagcccaaaaatgttttttgcaggcccccgttttgacttaaagcttttgggggcatgttgccattgggttttgcccctgcaaaggcttcttaggtttccaggggccccccaggacccagggtcccaaattttgtttggggatgtgcacttctggccgccggccttacagtctttttcccctggggaggaacagtggcttttcaaagcctggggcaaccaaaaaaaggcaggagtttatttttgtgttgggtttggggtttttttgtccccaagggactgttttgtttttctttccccccctgcttttttttttgtaagccttcccccgttaaataaactttgggtgttgtttcca

SEQ ID NO: 557600 - DNA, 123 bp, Homo sapiens
aaaaagggtcccctttttttttttcaggggcccccaccccccccctcccatggtagaagttttccccccagctcctttggggggccccctgatgagtatttaaagcccgtttttaaatgccca

SEQ ID NO: 557601 - DNA, 767 bp, Homo sapiens
aagcagtggtatcaacgcagagtggccattatggcggggaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaagaaaagacacgaacaaaacacgaaagcgaggagggtgatagcagcagccagacgaagctgaggtagcaagcctcccccacaatgtgtgctagggtgcgggcgagcggacaacgagcccgtgtcggtaaagagcagagatgggcggaaggctagcgcagagggggtctacccgcagcaactgtaggggatggtggcagcgacaaaccatggtacttttaggcacgccgcaaggaggccagagacagagcctcactatcgaggctatcaccgcgccataagacgtacaacgtgcgtggtatgttattgcgtagaagaacctaacacaatcaatcgtgcacaatccattccatattaaaaatatcaaaaataattacgaccgccaccccaaccatacttttacttcagttatttatttaatacataacaacactacaacacgcaaccatacgtcgtaatatcgcatcaaaagtcaatgaatcaacaacccacatcaacatcttcatatattcatcaatatacaactcaccctaaaacataacgatcagccacatgtaaaactaacttcaactagataatccctaccaacactcaagaaaatcttactatcaaatgactcacatactcacctatat

SEQ ID NO: 557602 - DNA, 168 bp, Homo sapiens
cctggcccaatggcagcatgaaggatctcgtatgactggactgtgtgcagtctgtgacataaagccttcctcggagctcagataatctgctagaagacaggacaaaggctgttgaggatagaaaattatcttcgcttcttgaacgatgtttccacgtggccattcgca

SEQ ID NO: 557603 - DNA, 332 bp, Homo sapiens
tcactctaaactggaaggtggaggttgcagtcagctgagatcacgccactgcactccagcctggacgacagagtaaggctccgtctcaaaaaaaaaaaaaaaaaaaaaaaaaaagggatttaattcttggcttttttttacctggccaagagcatctcctttacattcagtgcatgtggaaggtttttacccaagttagcagtttccccggggaattaataaaatcccccgaggacattggtctgggttgtggtgccctttattggggtgcgatttttccaggttcccttccccttccccttttctcacataaacaagaagaggccttaaac

SEQ ID NO: 557604 - DNA, 1079 bp, Homo sapiens
  misc_feature (288)..(288): n is a, c, g, or t
  misc_feature (292)..(292): n is a, c, g, or t
  misc_feature (297)..(297): n is a, c, g, or t
  misc_feature (321)..(321): n is a, c, g, or t
  misc_feature (324)..(324): n is a, c, g, or t
  misc_feature (332)..(332): n is a, c, g, or t
  misc_feature (335)..(335): n is a, c, g, or t
  misc_feature (344)..(344): n is a, c, g, or t
  misc_feature (350)..(350): n is a, c, g, or t
  misc_feature (370)..(370): n is a, c, g, or t
  misc_feature (385)..(385): n is a, c, g, or t
  misc_feature (395)..(395): n is a, c, g, or t
  misc_feature (409)..(409): n is a, c, g, or t
  misc_feature (443)..(443): n is a, c, g, or t
  misc_feature (451)..(453): n is a, c, g, or t
  misc_feature (721)..(721): n is a, c, g, or t
  misc_feature (767)..(767): n is a, c, g, or t
  misc_feature (771)..(771): n is a, c, g, or t
  misc_feature (791)..(791): n is a, c, g, or t
  misc_feature (797)..(798): n is a, c, g, or t
  misc_feature (961)..(961): n is a, c, g, or t
ttgccgttactggcgtctgtcgtttgtttggtctgcggcgtcgtgtttgtctccgtctctgtttttttggcggcacgtcttccggtgtgccaggccgtgcttgttctcttctagtccgcgttggtggtcacccattttctgggggccacatgggtgtccacaggtgtggagtcccctcccttttcgggaaggctcgtgtctggggcacaacccccctagtgcgcaggccttcgggccctgtaccccccgcttgggaactctcccttcattccggaattttggccttgngttnccccngggggccctccgtggtcagggcanttnctgcccanaanggccacctntgcccngtctgggccactgccccatnggaagtccctgggcnagcccaggcncctgtcttcgggcnccgagagacctcccttttcccgcctttaggtatncccccctnnnatctcccgggcccccttggaatcctgagtgatggcccgctgatccagactggagaccaagtgggaacccgcgaagccccgctgcttggacctgctcaacaatttcccccttttcccttggcctggtcatccccccggttttcgaccatgccagcatttaccaccccgaagtgcttgatgatccccgaggacactcttgccattttcgcttcctggagggtgtcccccaatgttgcccagtgtctgtcttgccagattggcgtaccccnactgttgccatccgtacccccattcttatccatccaccgggtaccnaacngagtccctggcccttgtctnttggannaccggattacccccttccccccttgctgaaaaggtccaggccctttttggctgatcccatctgccctttgtggctgctgcccccgtggctgctgcccccccagctgctcctgctgctgctgcagcccccagctaaggttgaagcccaggaagagtcggaggantccggacgaggatatgggatttggtctctttgactaatccaccccaaaagccaacccacttagccccgttttatttgccaaaccaggaaataaaggcttactttttttaaaagtccca

SEQ ID NO: 557605 - DNA, 147 bp, Homo sapiens
tttacatctcatcttcctgatggaagcttctcctgacccctcctatattcatcatgtccatcttacatgtcacttcctgatggaagctactcctgaaccctccttatccatcatgttccaccttacatcttattcatcatgttccat

SEQ ID NO: 557606 - DNA, 202 bp, Homo sapiens
cggatccactccggaaaaaaagaaccatttggatacataggtatggtctgagctctgatctcaattggcttcctagggtttatcgtgtgagcacaacatatatttacagtaggaatagacgatagaacacacgagcatatttcaccatccgactaccaataatcatcgactatccccaaccggacgtcaaagatatttcagc

SEQ ID NO: 557607 - DNA, 128 bp, Homo sapiens
ctctagaggatcctgtgcactgcttcggatgcccagaaacgcacgatcttcagttcctgtggggctgggaggggtgtggaagagactggtgtctcaccagcaatggctgcctcccccacagcctgtcc

SEQ ID NO: 557608 - DNA, 963 bp, Homo sapiens
cttccgttgggccccgcgcgtgtttgagctccttctccaattttccgccgcgcacaagcgttgtttcctctcggtggacctcgaccccgcccttttaccattgcgcccgtggtttaccccggccccgctccgggaacacctaccccccttggtccacacctatgtccgggggatatcacaaccccccccttgtcgccgttccctccacagtgggttaagtactccgcacccggccccctttcgaccagggcggccaaccctacttgcggtccggaggacctccagccgcccgtgcgtgtggatttccgccccctcgtaccagtagggcgccgttcttctccggagtgggtccaccacccgcacgtacggccccgctttttgtcaccccctcgcctcgaatgtccacccggggaggaattgtgtggccctctcttcaaagaatcatgcggggggccccaaagactcctttctcgtccctctcacgaattctcgcagaacgcccccagacctacaacaggctggtaccattttaggactaggatgcgcatgttgatagaacaccggcgggtccctctcgtgttatactggctaccatccctctcgcagtagtacgcctcccacgtcggtcccctccggtgggagattttttcaaataactatgtaggttgctgggatactcccggaaccgaaacatattgtagcacccccgctttggaaaaagagtattgcgagatcccactgcgacgtacccagtcgcataacggatgcaaggggtaaccccatggtgagtggggcatcctcctactacgacacgaccgcctcgagtggcgatgagtcacaaaaatctctggaggaccatacctagcctcccgccacccctcagacacaattgcagcatccagcgtttttcccccacccgcaccaaaaaaaatttctggctttgggaccccacaaacaaaaaca

SEQ ID NO: 557609 - DNA, 951 bp, Homo sapiens
cacttgtcatatagctaagtgtggtgtcctcgcatcaatctcgttttgttggtgacactcgctgttcgccgtcgtgtgctatagtcgcgagtcctcgttggggccgccctcatagggggccataacaacgtttgggtacaccagaggctctttccccaccaggggccgacataccggccaattttcccccggcgctgggacttctcccctaatggtaacatcttaatccgtgccctgcggggtcaacaccctcccagtccacagtcggtgcctgctgtttcccccaatccgaggggggggccttttccccgtttaccccggcgcggtgatgtacaccctctggcctgcactgcgtttaaccgcccttctctttctggccctaagtatcttccccggcgcgcccgtggacattggacacctcccttctccgggggccccccttcgcaagtgggtcccaggggtaaccctcattggatccccctgggcttttcccccccgtccccaggtttcgcaacgagtgtggctccaggggcgcacccccctttattggagatcccgtaaccacccgcgggggtcgccttatagggcatgtacaaggacattggtgggcccttctcatgactgtgaacagaccccttgtggcgggaagaaacccgagctagccccatatgaggacagggaaggtcaacactcaccccagacgcatttctagggcgcctcaaccaacagggcagagactgggccgcaatcaaggcaccctcgtaccccctctctctgtagacgctgtgacctccgcaaacaccaagttcaaggggcgcccaccagggcggaacacgcggaaggcccactgcctcccgtgctccccccgcatgacgcacttttccctcccgggagatccccgcccgaacttttcaagggggataaaaaacaaaaaaaaacccccacataaca

SEQ ID NO: 557610 - DNA, 197 bp, Homo sapiens
agtgcagccgaccgaattgtttgcagatggatggacaatccccaccttcagcaggggaggccaaggccccaacacaccagcggagaagagctgtgggcagcgaatggctgaggctatcttggggagctgccccacctccatcggagatactacctgaggaattcacaggctcccagcaggggggagagtgagcacta

SEQ ID NO: 557611 - DNA, 131 bp, Homo sapiens
tacagcagggatgcgccagcagttattgtctgggtgcgcatgaaatctgcatacatctccagcaaagatcgcttctccaggataaaggtgggaagcaccaaccctgtgtccaatccattcaagtttgagtg

SEQ ID NO: 557612 - DNA, 1220 bp, Homo sapiens
gcgggtggtgtctctcgtcggggggggacgcgcgttgttggttgctgtttgtggcgggggttgtccgccctggggtgttgtgtggcgggggggggtggctgtggtgtgtggacggcgtttggtgcgttcgggggcgtcttttgggggtgcacgcgcttggggcggcggtgggtggggcggggggcgcgggtggtgtgggcggggggcgagaggttttcgccgggggggtgtttgtgtggacgggcttgtgggggggccgtgtgttttgggttgtgttgtggtgtgtgggggttgtcgtctgtcgtgggtgttgtgttcctttttcctcggggggggggggcgccccgcggggtgtttctctggccgcctgttgtcagttgtgggggttggtcctgcttttggacttgggctcggcgctggtgggtggttgttgtgtgaggctgctggtttttggtggtgtggcgtcgctcgcaccctccgctctcgcggggggagcgaccctgcgcgcgggtgggggcgacgcgcgtcgcggtggccgcgcggattgtggtcggcagcgttttttgtgggggtggaatcgggtgatgtggggttgtcccccccgcgcggggggggggcgcgtcttttgtgtgtgtgtcgccacgccgccgcgcgcgcgtgtgggccccggcggggggacgcgcccctctctctctctgtctgtaggtgccgcgcgcgctagataagaggttttttttggtgttgtactccccccccgctctctctcgcgccgcgccgctgttgtgtgtggctcgtccctctctctcgtggggtggtgtggtgtgtaagactctcgctctcccgctgtgcgcacacctcacatgttgtgtgtgcgcgcagagaggtggtgggggtgtgtacacacatatatgttggtgcgtacccccgctcgttgtgggaggcccccccggcgggaggagagagacaccacccccctctttgttggggcctcttcactctcctcccctctctgttaagacacacccccgttggtttgtccgcgcgccctcctctcgcggggcgccccgcgtgtgtacccccgagggcccgcgggggggtgtgtttagtctctctctcttgagggagcgcgtctgttttttggtgtgggttggcgccccccccccccccccccccctctttgttctcccccctcatgaccccccctctttttccccccccca

SEQ ID NO: 557613 - DNA, 809 bp, Homo sapiens
  misc_feature (50)..(50): n is a, c, g, or t
  misc_feature (66)..(66): n is a, c, g, or t
  misc_feature (68)..(68): n is a, c, g, or t
cgagaagaagaggagagaagaacgatcaaggagaaagaggacaatcgagnaccattggaaatgacnancgatgtgtaggacaaggaaccagggggggaaggaaaaatgggaataaaaggaaagggaaaaagtatagaatgaaaatattaggagaaaaaaggaggggggaaaatagggggagaaggaggaagacaaagaggggaagaaaaaagagaaaaaaaaaaaaagaagaaaggaaagaaagaggaaaaagaaaaaaagagaaaaagaaaggaagaaaaagaagaagaaaagaagggaaaagaactaagagggaaaaaaaagagaaaagaaggagagagaaaaaaaagaaaagagaaaagggaaaaggtaaaaaatgaagaagaaaaaaaaaagaaaaaaaaggaaagggaaaaaaaaagaaagagaaaagaaaagaaagagaaagaaaaagaggagggagaaaaagaggagagaaagaagaagaaaaaggagaaagaaagaaagaagaaaaaaagaaagggaaaaagagagaaaaaaagaagacaaatagaagaggaaaagagggagaaaggaaaagaaaaggagaagaataaaaagaagaaagacagaaagaaaagaaaagaaaggagaaaaggagaaagcagaaaaaaagaagaaagttaaagagagaaaagaataaaaaagagaagagaagagaagagaaaaaaaggagagaaagaggagaagaaagaaagcaaagaaaggaaaaataagaaaaaaaaacagaagataagaaagagggaaaaaagagagaagacaagggaaga

SEQ ID NO: 557614 - DNA, 151 bp, Homo sapiens
cacgtcagcactccttgctcagggtgtgcttgtcatcctccctgctggagtacttgtggaagatggcacgaggaggccaatggcctgatccaggggcatgccatggctgagggctgggtgttttagcatttttataaatcatcttaatctt

SEQ ID NO: 557615 - DNA, 399 bp, Homo sapiens
tcccaggaaaaccattttaatgtggagacgatgagacaataggggcatagggatgcaaattgaactggggttaaagttgagatagtcgagatagctgaaggttggattttatttcaaaagcatctccttactatatacttagcagttacaaagatttcacaggggagaagctggaaggcagcacctgaatcaggcacgtaaggtgcacataaccactaaggggactaactgaattgtgcaccacctattaggatgcagagaagaacccagccacctccttgaactgttccagccagaggcgcaaaacctagatctattcaaagggaatcaccaaccaatcccacattaggggaccccacaaaataactgctgggaatcattataagtgtcaagctcagg

SEQ ID NO: 557616 - DNA, 744 bp, Homo sapiens
ggaatagcatcaacatcaacaaaaaggacttccatacaaaaaccccatccgaaggtcaccaacatcaaagaccaaaggtagataaatccatgatgatgaggaaaaaccagtgcaaaaggctgaaaattccaaaaaccagaacacctcttctcctccaaaggatcacaactcctcgccagcaagggaacaaaactggatggagaatgagtttaacaaactgacagaagtaggcttcagaacgtgggtaataaactcctctaagctaaaggagcatgttctaacacaatgcagttaaactaagaactttgagaaaaggttagaggaattgctaactagaataaccagtttagagaagaacataaatgacctgatggagctaaaaaaacacagcacgaaaacttcatgaagcatacaccggtgtcaatagatgaatcgacttgtagagtttctgcagacagattctgtttcaagcagtagaaacggatatcagagatcgaaggtcaacttaatgacaactaccgtgcagaagacaagattagagaaaaaacagaatgacaaggcacgaacaaagcctccaagacatatgggactatgtgaaaagcccaaatctatgattgattggggtccctaaaagtgacgtggagaatggaaccaatttggaaaacactcttcaggatatgatccaggagaattcccccaacctagcaagacagaccaacattcaaatcggggaaatacacagga

SEQ ID NO: 557617 - DNA, 186 bp, Homo sapiens
agcaaagatatatctggcaacaatctggatccacatcggagcagggagatactgatcgcttcgccgtggagttgttctcgacgtcaccctactaggactggagaagaggagccagaatggcttcttgtctggtgatattattgccttcacttggggtggtggagatgatgacctagatgggctctg

SEQ ID NO: 557618 - DNA, 733 bp, Homo sapiens
gggtttcatcatgttggccaggatggtctcgatctcctgacctcgtgatccacccacctcagcctcccaaagtgttgggattacaggcgtgagccaccacacccggccagaaatgctttcaagcttcctaaatcaataagaaataaggccgggcacagtggctcatgcctgtaatcccagcacttttggacgtcgaggtgggtggatcacttgagcccaggagtttgagaacagcctgggcaacgtggggagatcccgtctctaaaaaaaataaaatgtagccaggtgcgatggtggatgcctgtgagcccagctactcgggaggctaaggcaggaggatcacttgagcctgggaagtcggtggtgcagtgagctatgatcacaccactgcactcaaccatgattgcaccaccacactccagcctgggcaacagagtgagaacctgtctcaaaacaaccaaacaaaccactaaggccgggcgcagttggcttcacacctgtaatcgcagctcttcgagaagccaaagtgggcagatccgcttgcagccacgacgtccgagaccagcctgggcaacatggcgaaaccctgttctctaccaaacacataccacaacttagccgagccgtgctgggcatgccccctggtactcccaagctactcaaggaggcctgacggccacgaggatcactttgacgctgcgcacctcgacgctccagtaaagccatgatcgtc

SEQ ID NO: 557619 - DNA, 253 bp, Homo sapiens
atatgagccaggagtcgaggctacagtgagccatgacacatcactctcccaacagcacaacagagcaagactcatttttttggagacggactctggctcggtggcccaggcgggagtgcaggggctcacggcaagctcggcctccggggtggaggccattctccggcctcagcctcccaagtagcggggaccacaggcaccggccaccatacccagctaattttttggtattttaagtagagatggtgcgtgg

SEQ ID NO: 557620 - DNA, 294 bp, Homo sapiens
gggcaggcttcagaaagcacaccaaggtgaaaaagagtaactaattatgttcaaagacatatggaaaagtgccaggcatggtggctcacgcctgtagtcctggcacttagggaggccaaggcgggcagatcacttaaggtcaggagttcaagaccagcctggccaacaaggcgaaatgctgtctcgactaaacatacaaaaattagccagaaatcacttgaatctgggaggcggaagttgcagtatgccaagatcgtgccactgcactccagcctgggcaacagagtgagactc

SEQ ID NO: 557621 - DNA, 795 bp, Homo sapiens
ctgcggcactgcccggtttgagcgtagccaaacctgcccaccgtgctttgtagccccgattctctgtgttttgctcccgtctccgacgagagagtgcggcgacgtgtggcgtctgcgacggtgagacagtcgcgtctgtgatgctgatgatgagctgctgctgcctgcctgcctgcccctaacatgctgtgatgtgctgcctgcctgccatctggtctgtcaccatgacctggagcctgcattgccctccctgatgccctggcccatcctgtgcccctgctccccagatctctatccttttgggaccatgctgctggaggagggctttggggacctgtggaccgggatcgtgacctgtggagtgatttggaggcaatgagtgtgtgtggtggccttcccccgaagaaattttggtaatcctgggtgagcgtctttgcgtaaaaacacaagtgggattttgacgtgagctccccaagtttgagaaaaatttttcatgtggaacatcctggaagtagcaatggctgacaccatatgaggttgatgagctacgccgaaagaaggagattacagtgagggggggagatgtttgtcctaaacccgtgtttgccttccatcatgctaacttcccacacatatgtactgtgatgtgttgatggatcagcactttacaggaaccaactcccaattcagtgccagggattccgttggctcttattgccggatatggttggcttggccagactggttctggaacagtggcgaattcctgccgcatttcctttaaccccgcctatg

SEQ ID NO: 557622 - DNA, 245 bp, Homo sapiens
cccttcgggtgaatcggttactgtgacttacggacgtacgggttaggactgacgtgggaccgaccgacccgacgacggacacgtaaacgtttaacttacttgccttttaggggttgacggtgactgactggacggtggacgactttgcgtggctgtgaacacttgttttacggtaactcagcttattctaggtcagtgttaggcaccgaaggctgatgagggataccgacgctcgacattcgtaa

SEQ ID NO: 557623 - DNA, 359 bp, Homo sapiens
gagctgtagaggcctgagcgggcagaccacttgagatcaggagtttgagtcgtttggcaaacatggtgaaaccctgtctccaccaaaaatacaaaaactagctaggcatggtggcacacacctgtggtcctagctacttgggaggctgaggtgggaggatcacatgagcccaggagttcgagattgcagtgaactgtgattgcaccactgtactccagtctgggtgacagagagagaccctgtctaaacaaaaaagagagagagagagagagagaggaggcagagtgagataactaaatagaagcctccactgattggcctccctgcagtagcaccaaatttgacaactgtctacacag

SEQ ID NO: 557624 - DNA, 165 bp, Homo sapiens
  misc_feature (103)..(103): n is a, c, g, or t
cataacatctttccatgttaggacttcttccacctcaaagatgttatgatccttgttctgctggccccttaaaccaagtcttacgtgtttacatgaatccccnggtgacgcgggatccctctagtagtacgacctagcagcgcatgcacagcttgagcactaggc

SEQ ID NO: 557625 - DNA, 148 bp, Homo sapiens
  misc_feature (66)..(66): n is a, c, g, or t
gagatcccccgactagcccgacaggcaggagatcctactctaaggagcgacatctccaaggccagngaaaggcgacagcggcatcgaaggctcacggaaggccggccttacttaaggtgagcagatgcagctgtcgggctagtcgggg

SEQ ID NO: 557626 - DNA, 442 bp, Homo sapiens
  misc_feature (249)..(249): n is a, c, g, or t
atggatcacctgaggtcaggagttggagaccaacctgaccagcatggagaaaccccgtttctactaaaaatgcaaaattggccgggcatggtggcaggcgcctgtggtcccagatactcgggaggctgaggcaggggaatcacttgaacccgggaggcagaggttgcagtgagccaagatcgcgccattgcactccagcctgggcaagaagagcaaaactccatctcaaaaaaaaaaaaagagtactanttgatccagaaggtgaaccagactagcctcactggagataaatagggtgacattattatgcaaaaggtggttttacagttccccttgtccttgtttttgggaatagtattaagaaggcctaccataccaaattaaataaaggccccatcacaaagccctcacccaaagggacaaaaacctaattcaacttctt

SEQ ID NO: 557627 - DNA, 184 bp, Homo sapiens
  misc_feature (17)..(17): n is a, c, g, or t
tccccccgtttttaaanccctgggggggggaaagacccctctttcttttttcccaaaagcggggccttttttttgggttgttttttggggttggggttttccccttttttttttaggaactttttttgggatttttttgcctttgcccccccctgttaattaaaaaaaaggggtggaaaggcca

SEQ ID NO: 557628 - DNA, 190 bp, Homo sapiens
cgccgggcaccgatctcgccaagatcctgagtgatatgcgaagccaatatgatgagctgggctaacagaaccggaatgattctgaagcctggttcaccagccggactgatgaattgaaccgggagagcgctggtcacacggagcagctccagaataaggtggtccgaggtaactgacctgtgagttcacc

SEQ ID NO: 557629 - DNA, 648 bp, Homo sapiens
atgcgggctggtaaaatgtcaaacatacgtacatgccggctcaggcgcgcccagttcgggcccacacgcgcctgagtttaccggtgcctactcatctctaatgttcttgcgcgtggcactacgctccatgagtagtgtggccgggcaccatatcctaagttctagaagcagcgacagccagggtgcctgctgtacccggcttttctagggcggtctcaacctcggtccccgccgaataagccttgttggggaactattgtttgctccagcgcggtttgctaacaactttgcgcgcgtatccccccgctcttttagactccgtggggtggacccacttctaggatatatatataccaccgttttcccgctagtcgcaaaaatacgcttttctccactcttcactagctgcctcaacatgtatttgccgccctaaacatcccttgaacacaatgattgacccaccgaccccactgggggtacactactcacccacccccccactgactaaacagaagataccagcctcacatttacacaccgcaggacacaccaccccccctactggtttaatacaccaccattccccccccttttccccgatgtccccaaaccccgaaataacccgggttttcctcttaacacaaaaca

SEQ ID NO: 557630 - DNA, 504 bp, Homo sapiens
  misc_feature (1)..(1): n is a, c, g, or t
  misc_feature (30)..(30): n is a, c, g, or t
  misc_feature (38)..(38): n is a, c, g, or t
  misc_feature (395)..(395): n is a, c, g, or t
  misc_feature (407)..(407): n is a, c, g, or t
  misc_feature (417)..(417): n is a, c, g, or t
  misc_feature (473)..(473): n is a, c, g, or t
  misc_feature (493)..(493): n is a, c, g, or t
ngctcttgctcacgcagtcatggcctccgnaacgcgcnaatcggaaagtcggctcctgacttcacggccacagcggtggtggatggtgccttcaaggaaatcaagctttcggactacagagggaagtacgtggtcctctttttctacccactggacttcacttttgtttgccccacggagatcatcgcttttagcaccatgctgaggacttccgaaagctaggctgcgaggtgctgggagtgtctgtggactctcagttcacccacctggcgtggatcaataccccacggaaggagggaggcttgggcccctgaatatccctctgcttgctgacgtgactaaaagcttgtcccagaattacggcgtgttgaaaaatgatgaggcattgcttacangggtctctttanaatcgatgcnagggtgtcttggcagatcacagtcaatgacctacctgtggacgctctgtagacgangctctccgctagtccagccnttaagtatcag

SEQ ID NO: 557631 - DNA, 760 bp, Homo sapiens
tgggatactttaattacgtgtgtcccatgcattgggttcagggaaagtcagtgattggaaacgaatgcagttcaagactgattaatgttatttaaacatagtgcaatattgattctctgcggttatctctgaatgatcacgacctactatagatgattttagcggaccttaactgtttccccactttgatgatagttataaatagtatagtgttaagatcgcaataacgtctctccctggcctttaaagtctagttgctctcttgcacgactatgcaaatcgacgctcttaacgcgacgcacctaatggcgatacactgaatacccaactgacagggtataggtctttagctgtagatcacaagccgtgaacaatatgactgtcggtgtgtactccacgtacagattagttctcttcttctactcgaagcatggcagctcattatataagagttgtcgatgttttcttaattactgtacacatgtgtatagtgttttttgcttgtgttgatgcttctatgtgtcttctaataggttttcattgttagtttacttaaagttgtgatagctagatttagattctgatgctaactgcaaatcaggttggtctctgctgggtctctcctgcttttatttgactttaaggacaagtgtagttgtcgtccaccacctttcaaaaaatgtgaaactgcctgcgtcccctttagtgctgacaacactgtgtacattgaccacttcctaccatactttatgtcgttact

SEQ ID NO: 557632 - DNA, 326 bp, Homo sapiens
agcaacaaggctgtttatttcacttgggtgcaagtgggctgagtccaaaaagagagtcagcaaagggagataggggtggggcagttttataggatttgggtaggtagtggaaaattacaggtaaaggtggttatatcttgtgggcaggggcgggggtcacaaagtgccaaggtgctgggtggggagatcatgagactcactgtctggggcaccgtgaatgacacaatgtcgattgattacttggggtggggcaggaacaaatgtcagtggtggaatgccatcttttgcgggggttcagttgctccagatcatctggttgtatacag

SEQ ID NO: 557633 - DNA, 306 bp, Homo sapiens
gtttttttggggggggggggggttttttttaaaaaaaaaagcccccccacccgggaaaaacccccaaaaatttttccttgtgggggggggtttcccccccccccgggggggcccccatggggccctcccttttttcccgggggcccccggcccccccctttggcccccctttttttttggggttttttttaaacgccccttttccaaagcccggggggttccctttttgctttgggcccccccttttgttttttaagctttttggggccccaaaaaaagggggggggggttcccccccctttttta

SEQ ID NO: 557634 - DNA, 152 bp, Homo sapiens
actctttaggatccccactatcgctaagaaaccctatctctactaaaaatacaaaattacggccagttgcagtggctcatacctgtaatcccagttactcaggagtctgacctgggaggtaatagttgcattgaaccagtcagcattaacca

SEQ ID NO: 557635 - DNA, 292 bp, Homo sapiens
caagtcatttgagtgtaggcaatacagcagcaagactattctttcacctagtcgtgttaacacatcaggctcagtctcacctccagagagaaccaatcatgacattacctaaccagccacaggccggcaacttaatatgcatcgatatggtacaacgtctcgtactgtagtacaatgtataaatctttctacagctggtcattaaagccagcagaggacgtcaccgttgccactctatcgtcgacagggtagatctgactgcctcccatctgctggcctcgtatgaactatg

SEQ ID NO: 557636 - DNA, 255 bp, Homo sapiens
gacggcttcaacggaacttaaatagtgtaggaagctgaataattaatgaaggagaggggtcagggttgattcgggaggatcctattagtgcggggcgtttgtattgatatatgggcgttgattagctagtagttactgggttgaacattgtttggttggtgtatatattggcaatgtgagattgctcgggaggaattaggttatgtagattagggagtagggttacggatgacgtgagaacgaagaaacgagagg

SEQ ID NO: 557637 - DNA, 162 bp, Homo sapiens
tgtatcccccaggcgccagcttggcttgggagaattccacaccaccacgatcttgttcaggtcagggagtgccactcagcctctctaaagagattcataagcacttcctcccgctcataagtcatcatcaccaccgtgaactgctctcggggaacattgcct

SEQ ID NO: 557638 - DNA, 488 bp, Homo sapiens
cagttacctttgccatcatctgttcccttccagtaaaggtgtggtgtggatggaacagtatagattcagacccattgctagggaccccagctcactgcatatgtgtccagtgcattaagaggttttgtctagggcaaataagtgataatacatcatctaatggaatattctgcaaattctaaaaagaatggatcaatttgaattgatatggaaagatgtctgagatacaataagtcaaaaaagcaagtgatagaacaatgtacagtgtcaaatagacaaatcatacacatgtgctgtgtattcacagaaacaggggctacctgtagagagtggagaaggaaatttgtttttaatgtactgtttaataaaaaaaaacataaacatgtatttgttcaatatttaaaaagttttgaaatgtttatcctctttgaaactccttttatgatgttatcctggagaaataaagatataataactaaaaaaaaaaa

SEQ ID NO: 557639 - DNA, 607 bp, Homo sapiens
tatgcagcttgagggccataagtatgctttgagataatatatgtgaagatctaaatagaatgtagggaatgaaatagtactcattcagtgtacagtttaatttttttctagtatgaagcattttacctgagttgtatgcaaaatgaatgttttatgccaatgttaatactgatgactgcaggaattaagtattgatattttatgtataatttatttgttttattagtctcaagaatataacagcagtttttcataaacattctattggctatgtgtgtcatatctagatttaataatcatattcttttcaataaagtttatcagtttgtaggaaacgatgggtagtattgtgggtaagactgtggaacaaaatgcttgcacctttatccccccttgaatgctttgcggatttttccttggtttaagattttttttactcatactggaaaaatactgttactttagatagaagtagattgctattcaaaattacatgtgtttcttttgaaaactttccttttctcaacattcgtttttacaaacttgtagtaacttatattacaactgaatgtgaaataaaatttactgttgtagttatttcagaaaa

SEQ ID NO: 557640 - DNA, 126 bp, Homo sapiens
gatctagaggatccacatgatgctcacgctctcaacagatcaacgcccccagctcccgctcacattggccagcagcccccccaactgctctagtcggccccgggcagcaggcagccagtgggagcg

SEQ ID NO: 557641 - DNA, 203 bp, Homo sapiens
ggtttttggccggtaggttaatccaagccaaaaaatccttttccattttacttaagtggcttgccacggtcccggcccaatccgccttttaactggaattcgggttcttaaccaaccccaaccttggcttttctggtggcccccagtggcccaaccatccgtttgtaagtatttttggcaacttccccttctgtcgtcttctc

SEQ ID NO: 557642 - DNA, 678 bp, Homo sapiens
ggaagcctcagaatcatggtgttaggtgaaaggtacttcttacatggtggcaggaaaagtaaatgaggaagatgcaaaagtggaaacccctgataaaaccatcagatctcgtgagacttattcactaccacgagaacagtatgggggaaactgcccccatgattcaaattatttcccactaggtccctcccacaacacgtgggaattatgggagcacaattctgagatttgggtggggacacagagccaaaccatatcagtactcaatatttagctcccacttataagtgagaacatatgggatttgctattctgttcctgtgttggtttacttaggataatgtcctccacctccaccaatgttgctgcaaaggacatgacctcattcctttttatggctgcatagtatttcatggtgtgtatgtaccacattttctttatccagtctactgttgatggtcatctgggttgattccatgtctttgctgttgtaaatagggctgtgatgaacatttaggtgcatgtgtctctataatagaccgattttatctttttcttgcctttttgcatgcctagtaactcttatattgaaagtgtggagaataaagatggcggtaaatacattttaatgcctggtgggcacattctttccttctggtagttcttctggtctctgcc

SEQ ID NO: 557643 - DNA, 752 bp, Homo sapiens
ccccccatgtactatgaacagtggtaaagcacggtacggtcgatcgggatatcgcaccagcgtcgaatagtatgcaccaattagcaaggcatctaaagagtatacctgtattgcaaatagaatagttcactaaactactgaaagaagttccgagtagcagtgtagggcagtctcttggattgaatccctaaattcataactacatttttctggttccagaataaaattatgtgtggtattaacttagatggtctagtgttcaccttgaaatttattttctttctgttggccaaactaacgtggataattacatccagagaaaaagtttgtctaaaagttactactggtgtctaatgcaaattggacttccatagaagtttttagctatgttatttacaatgcaggattttacagataaatagatgctgattcatgcagatgtagtactaagtctgagatattgaaatactgactactttgatgaaactgctggtttaaaaatatttactgatatgcaaatgtcatgcaaaactccactttacaatcttatatatctataataatcgatacctataacaattagtgttctataatgatatgcaattaccatttgcattcttaactgtttggtattaaaagtttgcaaacaaaaatacattgcatgagccatttatgatataagccaagtactgaaaatattcatgcatgatgtactgtgtgcagactattaggtatgcataatgatatattgg

SEQ ID NO: 557644 - DNA, 277 bp, Homo sapiens
tgtaaatattacagtaggctaacgtacctatcaggtgttatctatgttagcacataggtatatctctatatttcttatcatattagaagaactctttactatttcttgtaagatggttctgataggtatgtggatatctagtcagtatattgttactctgagaaagatttatctctgcttcatattttaagaatggctttgctggatacagtatgcttagatagcagttgttttctttcagcactttgaacatagttgttctaacatccatatccct

SEQ ID NO: 557645 - DNA, 343 bp, Homo sapiens
  misc_feature (16)..(16): n is a, c, g, or t
  misc_feature (195)..(195): n is a, c, g, or t
  misc_feature (201)..(201): n is a, c, g, or t
  misc_feature (249)..(249): n is a, c, g, or t
  misc_feature (308)..(308): n is a, c, g, or t
  misc_feature (332)..(332): n is a, c, g, or t
gagcaagaatcctggngcacagtggcacaatcatggcttactgcagcctcgacctcctgagctcaagcagtccttccacctcagcttcccaagtagctgtaacgatagccatgagccaccacatccggttaatttgtgttttttgtagagacagggttttgccatgttgcccaggctggactcgaactcctgggntcaagncatccacctccctagggctcccaaagtgctgggatcacaggcatgagncaccacaacagggctctatgtccttttgacattcatcaaaaaagcagtttttaaggcanggcgcggtagaattgcctgcaatnccagcaatttt

SEQ ID NO: 557646 - DNA, 825 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctgggagcagggagccacgggatgctgagagaggaggcccgagaggacaccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctcaaaaaaaaaaaa

SEQ ID NO: 557647 - DNA, 102 bp, Homo sapiens
atcactctagagatccctcccccagagcggctgctggacggctgcacgcatcttacagagagacacccatccctggctgggagtgcccgactgggtcggacg

SEQ ID NO: 557648 - DNA, 968 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctcaaaaaaaaaaaa

SEQ ID NO: 557649 - DNA, 112 bp, Homo sapiens
attccatatttcacattcatagggtcctgcagtatactttgtagacaccaaatagaaagagggtcctgttaggtttcacgacagctagcatactatagagtacatagggacg

SEQ ID NO: 557650 - DNA, 822 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcagttcctacagctcccacttgtctgactcagtgcaggatccgcctgtctcaaacctcttcttggaggaaaaggtagca

SEQ ID NO: 557651 - DNA, 1276 bp, Homo sapiens
caaacaacatccggtcagctgctgcagcaagcttccctcctgagcagacttcacaagctcaggagcgccgttctggtctgggccctatcgctgtccacacccgactcacctttgactgtcaagcaaatcccctgcattcatggactaatgctgactggcatgcatgccgagagcgcgtgtttgctccatgaacgcatactggtgcatgacctaggcgtcatcaggacgcgagcttgctgtggcctacagttcgctgcagctctgtgcatcgtccccgacattcatccccataggtacgtggccgtccatcgatccgatagattctccttgacccatgcgtacgcttgcaggatggctgccttattgccctcctgatatgagtagtagcatggtcgttacttacgtagcgtagctcaacaaggctcatcttcctggcccaagcactctaagacaagcttcctctgtggatttcatagactgatttccctcgcaatttggactattcgaagaaagagtcatgattgtaacccgcgaacattttactggtgatcgcgtatcccaccattccgatggttcgtggcgaattctcaatacccattcccgaggggagcagctataataacgtcagtgtaccaatttactcgtgtacttgtcgaggaaccgctgtgactacccgagaagaacgctccatatgcatcgagttcttcgctcacgagagcacatcggacttccagttctcccaatagcccgattttggctccaacgtgactgcaacgatgctatgtccagttcgagcttcgagcccttatggtagcttgcttcatcgcgtagagcaatggttaccagaaccgcgcctatcggtcgccacgcgggcggcactccctgtgcaacggcgcctttggtatcgttcactatttaccacaagcgaaactcttgggattgtttcccattcatcaatcgttgttggagcccccctattgtatcctgttgttttccgtgacacaggggaatagttatcccttccctagaagatacccccccccgttttgtcgccgagcctaacaccagcaggtgacgtacgatccgccagtgttacgcctaacttgaaagtccacacacgtaagctatgtggaaaccagatttgcatgacagggaatctatccagactttatcggacaagggggcataacccaacaagctgtggcaccgattgggcatgggctcgcgttacatactatggggctcgtgaatggcagacgcaaatatgcgacatccc

SEQ ID NO: 557652 - DNA, 1598 bp, Homo sapiens
  misc_feature (14)..(14): n is a, c, g, or t
  misc_feature (23)..(23): n is a, c, g, or t
  misc_feature (595)..(595): n is a, c, g, or t
ccacacgggcgggntcacactangcgctgtatagtgggacccaccgtacttttagcggcacgcccctaaatattttttgtagcgtgggtcgtccccacagctcttgattatagagtgcagcacaacgatggtgttggttgtgttcacacaagccgagagaataaacgcaaacggacgccgttgggtggttgtcagcccccggaggtctgtcccgctcgcggggataagtattctccccccccccggggggtggatatataatttcctcgtggtcctctgcgaaactcgcctccactactacggcgcgtcgttttctgcacggcctcccacatacaacaggcctgtgcgtgctccctcgacgacaagatttgataggggtttctttctacccacagaaagtagaaccggtcgttttatcctttgtgtctctccgcccccttggattcctctcagtgataggaagaaggagagccccttataaattgcccgcaccccgcgctggttttgaacacatagggaagtttcacaccccgtccccccctctccaatgaaaattgacaactgtgtgtgtgccccccgtctgaaattgtctggngccttgtttccccttcaaggtttcccccttcgtttattaggcccccctgcctgttgttgtcgctcagagaaccacacgtgtcaccgcccagactccacagaatcctgtataagctcgataatgaatcgtcagaacccacattgtctctcaaagaaaccgcgctcttcaacgggaaatattatgtataaacccccgccttttctgggaaaacttatattccccttgtgccccggcgcccacttatcacatctcccctaatgttcccctcccacatttcgcgcccacttctcgccaactttctccctaatacgcacacttcccgcgtgtgtacaacaacttattacccacgcaaccgcagagggggtcacacaccggagtttcccccttcgcgccctcgtatggccacgttcacaaagatgcacacatgtggggggcccaccacccaaacatgggtgataccttgagagacctcttatctcgagtgtatcacaccccgcagtctatctcgcgctcggagactatatatattttttcacaactctcctcacacacatatactttcccccccactctatatttcctcatgagacaccacgcgccgacacctctgcgaactctcctctgagacgcttgacacacaattcgagagtatatatactctcccgagatttagaagccccccactttgtaatataataattaacactcacccaagaacgcttcttgcacacttactgaagcttgtccccaccacattaaggcttatataaaccacagagatgcacaatttcccggagacgtttataacacacacaccacctttcacccgctaaaccgagccgcggggtaataactacggtcacatgcttctgaaaattctgtggaggcacaaccaccacgtttcaatgcccactcgtcctagagaattaaattccccttaaaaatctttgaaatagggcccgtatttaccctatagcaccccctttaccccctttagagccca

SEQ ID NO: 557653 - DNA, 152 bp, Homo sapiens
gttggggtcttcttgtgcgagatgggtgctgctgaatggaatcctcaaaagacattaagaatatgtggactacacgctacctatcttctttttgccatatgagggtatagattaattaaaaattgataattagtcaaacttctgctcagatt

SEQ ID NO: 557654 - DNA, 666 bp, Homo sapiens
  misc_feature (471)..(471): n is a, c, g, or t
cgtgcctgttacctctcatcattgcgttaacggggaagcacagcgattgctggacgcactctgtgagatattttcgcctgtgcgtgttggatcccatgcatggggtccctgaagttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcacatgttcaaagtggaactgaagcgcctacagaggcactacaatcacttagggtctcacacttaccagagaatgattggctgtgagctgctggaggatggaagcaccacaggatttctgcagtatgcatatgacgggcaggattttctgatcttaataaagacaccctcttctggctggatgtcataatgtggctcacaccatccagcangcatgggagggcaatccacatgaggtgcttgatgaaaaagatatgctggcagaacaatgtattgcctggactaagagaattctagagtatcgggaccctaccatagacatgtaagaggaggaaggcctattccacattggctgaacaacctggtttattaccgacactttgtgatttggatttccccgtgttccc

SEQ ID NO: 557655 - DNA, 530 bp, Homo sapiens
tcgtgcagctttctcctgattctcttgagatgcacttgaccacagtcctgacaaggtagtgttagctaagggccatcttccttctttctcttcccttgtgggaggaagtggacatggctggggccgtaggcctgagttttgagttacatctctttttctgtttagtctcttataaaagggctaacaaagatgaaggtacaggcaaatagataggtatagggccagggtactacacatgcatgatggattattcttagttaactggctgaaatgtacacttgacttttcaacaacccctgcacagttgaccctttacacagtcaaaaatccaagtagaacatttgacttcccaaaaacataactactattatgattaaccactaatagcatactgttgactgaaagtcttactgataacataaacagtcagttaacacatactttgcatattatgtgtattttatactgtgttcttacaataaaataagccagaggaaaggaaatgttattaacacaactataaaaaaaaa

SEQ ID NO: 557656 - DNA, 150 bp, Homo sapiens
tgtgctccttcgatattgctgccataaaggggtttggggaactcgattgtaatagtcccaggttctaaattaactagatgtgtacagaaatgaacgtgtaatgtaatgtttctacatgtgtctttgcaacacaaatgtcactttctgtct

SEQ ID NO: 557657 - DNA, 174 bp, Homo sapiens
tgatcccgcctccacacgtacggtgatgccgccctcgcgagtaatttgatagcgttgctaagcaggttcataagaacctggcgaagtttgccctcatcggcatagatgtactgcggagtgtcaggtgcaatatcaatgatgagtttcagccccttgtcattggcgcgcatctgg

SEQ ID NO: 557658 - DNA, 175 bp, Homo sapiens
gggaggctctgcacccctgcatgcagtgcccttcctagagtctatgagtctctgattctgtttctcagtagtcctttcagaggcttgctatactttgtctgcttcaaggaggtcgaccttctaatgcatgaagaatgggatgcatttgatctcaagaccaaagacagatgtcagt

SEQ ID NO: 557659 - DNA, 279 bp, Homo sapiens
tcgataagggccaatgttacgcacctgttctgatgacgtcgatggtcgctgtagttcagcttcagtcatggacttacaagtagcgcagctgttggccgagagggcgtcgaatgagacctcaaagttcatggaactggtgggtcagaggcccagttcttcttgtcgaaggtaggcagaagctcaatctctgtgctgatctgcgattccttcatgcctgccatgcgcttgatcttccacacgagggcattctcgctggccttgtacttggccttatcgagg

SEQ ID NO: 557660 - DNA, 1161 bp, Homo sapiens
gactcaagtggaccctacaatgaagcctacacatcccaatagaagccccattcattatgctgagggaagcagccctcagaacatgatagctatgtatccagcaagagtggcactgtgctaggcacacaccgtccacagaagccaccctggaacctgtgatgcctgcaacctcagcaagcgtgcagatcccagagggaggacagacataccattctgggatggtcctaagcatggaatacctaactacctgattccgtactcctattacttgacttaggctacagccagatatacccaaatctaggtaagaatgtcacatgcaccatgtgactcctgcctagggcaatcaatatacagagctatgatctgacctactgaagtacaggctacacatctagctatacttggactgtgctgacaacttgatagtatctatgagaagtacgttcaatcccatgcaacatccaagctacatactcaccctaagtagatcactgatggagcataagagtacagactgcactgatattagataatcattaagcaattgctagttatcattctaaaccagataatggcacagcaggacatacttgcatgaaccaacgtataaagacatatgatatgtaaacgacactctaggtcaatcacatggcatgagcaagggacgactgacgaccaacacaacaggagtacacatgcagtataaaaagcaaaaacaaaacaggaaaaaactggaaaccagagcagcaaacgacgaccaacaaaaacacacgtaacgcgaagaacctggataacaccaaacaaacaacaaaacaccgaaatacccagacaaagacagcgcgcaccaccacagcgagaccacagaggaaacacacacaaaacaacacgaccatcacaaacacaacccaccaaaggcgcacacctagaccacaaagaccaaacagagacaaacttgagggatagcaaagcaatatagaagaaaaatgcggcacaagagaagacaccaatcgcgaagcgaaagagcaacatgaaaaaacgaatagaagacagcaagggaaagcagataaaaacaacacgaggacaccgacgtgacagaggagaagaggagaaaaagagaacagggccaagagaaggctacacacctagtacgcgaacaaa

SEQ ID NO: 557661 - DNA, 109 bp, Homo sapiens
cgttttttttcccccccctaaaaaagccaagcatttaggcccaagttttggaaaatttttgttttaaaaagcaaaaaaaattccccaactgcggctttttaaaaaccca

SEQ ID NO: 557662 - DNA, 460 bp, Homo sapiens
  misc_feature (4)..(6): n is a, c, g, or t
  misc_feature (15)..(15): n is a, c, g, or t
  misc_feature (39)..(39): n is a, c, g, or t
  misc_feature (414)..(414): n is a, c, g, or t
  misc_feature (459)..(459): n is a, c, g, or t
tttnnntactctttnattgacatccacttcttttttatnggaatgcccctgaagagagggcaggaacatctaaaggtggcagaagggccggcatccaggctctgcagggcagtcacaggcctcccagcaggtagatccctaccaacaagcaaattctcaataaacaaataactgtttgttttagtttaattataatttgaaatgtcatgcagtttgtttcatccacaaggaacttaatatttttcattaaaaattaatcaagggcttctacaagtcatgttgtggtaactaatatgagacttgtcctcccatgaaaacaactggaaaatggacaatatttataaagtatctattttcagacactagatacaagtgccccagggagaggagaaacaaagccatgtgccccacatnagcccaggtaaagagatttaccactttagacagcagaagccaggna

SEQ ID NO: 557663 - DNA, 453 bp, Homo sapiens
tcggcaaaggggaaacaggaagagaaatagaactggaagtaaagcattgaagatgtgactgaattgctgcaatctcatgatcaaatttgaatggatgaggagttgctttttagggatgagcaaagaaagtggtttctcgagatggaatctactggtgaagttgctgtgaacattgttaaaatgccaataaaggatttaggaattacagaaacctggttgataaagcagtgcagggtgtgagagagttgacttcaattttgaaataagttccactggctgggtgtggtggctcacacctgcaatcccagtactttaggaggccgagactggtagatcatttgaggtcaggagttcaagaccagccttgccaacatggtgaaccccacctctaccaaattagccaggtgtggtgcacacctgtagtcccagctacttgggaagctgaggcaggag

SEQ ID NO: 557664 - DNA, 306 bp, Homo sapiens
tagcagaacttgagtccatattgtccactgttcaagaagtctggaaacttgaagagccaaataaaaataagttatcctagcatttgtagctatcctgaaaatacctaataacaaacaaaaaaaacttacaaatcaggaagaaatcaaagaatttgataaccctaactgctggcagggatatgaaaaaacagaaattgctggcaatatcctataaatatcttataaagtgaaaagtatttatatcctaggacccagcaatttgacagccagctatatgacctgaagaaactatggcatgttgcttca

SEQ ID NO: 557665 - DNA, 147 bp, Homo sapiens
tattagccactgttactggaattggtttatcagttcaaatagtcttcaggtggagtatttatgatctccaactagtcgttcatattatctgcgaagacataggataattcggttgctgcgtatctacaactgtctgtgcccgatttc

SEQ ID NO: 557666 - DNA, 344 bp, Homo sapiens
  misc_feature (2)..(2): n is a, c, g, or t
  misc_feature (223)..(223): n is a, c, g, or t
tntctttctttttgaacacccaaaagacaggcgataggctatatataatattagactctcaggataaagaacaaagtcagttaatgtaatcccagcactttgggaggcagaggtgggcagatcacaacaaggtcaggagttcgagaccaacctgaccaacatggtgaaatcccgtctctactaaaaatagaaaaattagctgggcatggtggcgcatgctgtnaatcccagctactctggtggctgaggcaggagaatcgcttgaccccgggaggcagaggttgcatgagccgagatcgcgccactgcactccagcctgggcaacggagtgaggactccatctc

SEQ ID NO: 557667 - DNA, 1024 bp, Homo sapiens
agccgagtgagaccagttggataatgtcaagggcgatagtatccaagaaaacggaatggcatccctctctgtaccatgtcacgcaggttgagtcattttagacctgtgacaacaccgagctcgcgcataaggatggcgcttcgataaccctgtttctgacattaggaacccatcttgaagaaaagaagtcacaccttggcaaccgtggtgctgcgcgtctctatgatggttggtgaattgcaagatgcttcaggtgaaagacctctgtagcattggtagagagcatctaagtctcgcatgtggttgcgcaccgtccgaaagtgcatcagccattcgaggatatcgttcagaaggctgaagatccagtcgatcaatggtactgcgccatcctcgtcgcattgatcaaaacaaggtaggtttgagtacgtctatagcatggtggagtacaacgctgggacaaatggagacctctaccactagtgcatggaaattatgagatagtaccagcaacatgagttccgatcgccctgtcactcttgggtagtcgtaccggatcctggagatgagtaggaatattggctaggagtcatctacgatgcaaggaacccgtgaatcttgggtcataggaggccaatcaacttctacgtaacgttcgtgaagcacagagatggagcacctagtttgaagcaaaatgatcaaggtgggccaagaaaatcctaaacgaaattaagcgcataggggctatccacggtccattggcaggacgatgtcaccgcagagatttggttcttcgtccggactatgtgtgtactaggcagtctgggggaaaagcattggggaatcgcgagaacacttggggtccttggtaactccttggaattttccctaagtaactcgaatatctagccaattggccgggaaaccccctgggataaactgaccttggtttgcactttactggttgcggtgcttacccaagatgtggggtcgcttgacataatgcccgttacctgagttcttaaag

SEQ ID NO: 557668 - DNA, 240 bp, Homo sapiens
ccatgggattgatgtctcaggttagttaacggataacacgtgtccacatcaaattaatcgatctcttaaacagtctcgtgcaggaccgtactttacctgacaacgacagtatgagaaaagtattcaggtaacactttagaaaccagttagcccataaatctgattagaagtataaggtgctctgaagtgtcctaaatattaatatcctgtaataaagctctttaaaatgaaaaaaaaaaa

SEQ ID NO: 557669 - DNA, 346 bp, Homo sapiens
ccttatatgctgttagatttctgaataatgcatgtaggtctgctccaggtagtgatgcctgactattcgttctagttcactctcgttaaagctatttcctcactgtgtcgggcatcagtggtggtcttggcagccacgttaaggttacttatcacatgctacccttatatactaagatcatgcaactggctggtctctcactgaagtatgaggttgaccttcataggtgctctgtactgctcacgggggtttgggttgctccagactacaccttctgaccagacttcccagtggtttggagcccatttccacgggtaaactgcttgatccacagtctaccagcctg

SEQ ID NO: 557670 - DNA, 466 bp, Homo sapiens
ataggctagatacagaatctgggttcaaataattttcctcacaatactgaaagcttgttttgctgtcttttaacatctaagtattttgaaaatgaaattctgatgttagtgttgtcattctatggtagtgacccacttttccttcttagtagctattataatcttatatgggccattttcattcatcctacttcgtaatttgtggactcttttgacatgaacatttttctctctcagctttacaacactttccctcctccatcttctctgttgtttctggaattcctcttaataggctattggatttcatgggctgatcctctatgttgcttatcttttctcctccctgtttttctatctttttactgtaattctgagaaagaggtggttaggagataaaactgtgttattagaaaacaaactgaaggcggccgagcatggtggctcatgcctgaaggagaaatct

SEQ ID NO: 557671 - DNA, 381 bp, Homo sapiens
cagtcgttgtgctattgtatgagacgtggtcttgtactgctgccaggttgtagtgcatgtggctgatcacagctcacttgccacctccaccttccaggttcaagctatactccagcctcagccttccaagtagctgggaataacagtgtgtaagccaccacacgcggctatttttgtgtatttttagtagagaccaggtttcaccatgtcgcccaggctggtcttgacctcctgagctcaggtgatggtgagccacctgcctcagcctcccaatgtgctgggatcccaggaatgagccaccgcgcccggccatatggtcggaacatttatgctcctaatgcaccctgaaatgggtctgaacactaagcacacgggataccg

SEQ ID NO: 557672 - DNA, 891 bp, Homo sapiens
tccttttggggattcgccccccgcgccgctgctgattgggagctggttaccggtgcactttcgtgggcacggtaatccacggaacttgggtcacacccggagttatcagcgtgtgatggtccccactgaaccatttacgtctcttgtatgaacggcgcaaatctaggggcgccgcctagtttctcgccccaagtatgtgaccgtatagcgtgccgttccccccgacaatatgccgcgttgtgaacggtgcccccctggttatgtcttttattaggataagggggggaccccaactctgtgatgtctaaagagagtttgtacagcgtcaaataggaaatgtttcccgtcaagattcggctccccctcgggtaccgcgaaaattcctgtggaaccgagttcgcacagaatttcgtcgaccccgaaatctcgattttagcaggtctcgcgggaaattagttttgagaggtagcactctccatgaggtatcttttcctagcattcgtaataaaagggtgtgagcccgcacactccaccgttcccaatggagggatttatacacgagcgctcgccacttccttctgccagtgccaggctagtaaaaatgtgggccaaacgctctattacaacgtccccacctttattcagcacttgcccaatagcgtgtcgagcgcttatttcccacccagtgtccagcagagtaaaatatccggcgtattcagcgacaacgtttgccccaaatcccgggatgtgcggggggagtctctccccataccttttctgcaaggctcccgaacattgccctttaatagttcgcccctacccgcaattatgattttattatggggttgcaaagaaactcaaataggaaggggtcaactccacccaacaagc

SEQ ID NO: 557673 - DNA, 827 bp, Homo sapiens
atccttattatgattagctattgttcctttacgtagctacgaacatgtatgttgacgtgtgcggaatgtagtaagaaaagttttctgtaatattggtatattatatttaacgaacatatttggaacctggcgttaaaatggtaggagtaaaacagatgatcagctttataaaaccatccttccaagcgtggaacatataattttggacctcgagaagtgcaaaatccagtcctagaggtctttgcttagtattccttcaatcaactttctagtaaaaatatcctatattaccataattctcaaaaccagttatacaatcattgtgtaggatatctataaagtactaatcttattgtggatttgacgaatttttacatgttttttttcttttttagtttgtacttctaagaagttgtattacatgtacagattcgtgtaaccactgcaaccacattaaactaatgaacacaaagtccctcatgctaccttttaatgcttacactccatccaaacctaactctgccaaccacttttctcctatcagtataatttcatcattgttcatgaatatgataaaaataaaattgtttgtgtgtaaatggttatcgtatagattttatataaataagttatatgaatttttattgatagagagtatgtgaagcttttggcactttttgtcactcagcaaattactcctaaggtgtatatgaggttgatgaatagttgtatttagtatttttcttttaccaccagaccatcctaaccagatgaaagttgtttatatcttgagagtactatacatatctgactggtaagtagtgtat

SEQ ID NO: 557674 - DNA, 1452 bp, Homo sapiens
gacaccgagagagcttgctcgactgcgtaggattgtcgtcgcgctccggcgcctagaatctcgcttaagaaggcaggaggcttgggacacgtggctgcaatgcgcctgatgcgcatcaagatatggacccttaggaagtagaagggcgctttgggtagcgagagagcgaggctcacgcgcacacatcaggacgagcgtcacgctcggcttttgttgacaatgtgacgccatgatattactcaggggctgtggatgctggtcatgaggattccgagttcctcctactataggctggcctgatacacgctgcgcgtctcgtgcacgagttactccaggtatcctatccgcgacgggggccgtgtcagactcggactcacagatggtatagggtcaaggtcctggcgtttctcgacctgtgtcctcgacaatcgtagcatgagcccgacgatcaacatatatagccaaaagcaaggaatcgcaaagcacaggatgaatgttaggggcctcaggcggtactgtaactataggacagtgcttgtggtgggctaagatgggcgcggaactgtctgcctaaatcggagaagacaggaaccccagcacttggatgccttttcggacgcactagagtcgttgtacaggaactcggttggaggctgaccatatgagcttggagtgaacctcatggtaagagtcgtacgagcccttgcgcgtgggtgttgcgagtttgtccaccgacgtactcggtgggaatgcgccaattccgacagtcgtgtgttgagctccttttcttttatggccgttgctcgcgttggttcgctcagcgaaagacacgtgggagacgggtcccacggtttatctttgacacgtatagtccatacggggggagatacgggggcaactgaacattgggggaaccaggttcgttaaggttccccactaaggggaaggaagcactccattggaaatccaaccgttgttacggcccgttttcgtacaacaaggtgttggaaagctccgggcataggaactcaaagcggcgggctttttgcgcgttaacagccttggggtgggggaacgacttaatgcagggaatccgaattttagcgaacttgtaactcgggagttaccggaattgcagcaaattccccggccccggttcacaccttgagagggacagctttgagctagacactcggctcccggttgaggggattccccgttaaacggtttcatttagatggtggcctttccggttaagttctgccccgataggcgcgtcaggcaaacagagggggcaaagaagtggccgttagcaacggaaaccctttttgtccccacctttaagaagcgatgtggggggtattaaacagtcgttacgcaccgtaggtattgaacaggttttatctcgggttcccatttacatataccatatagctgttcggagccaattag

SEQ ID NO: 557675 - DNA, 477 bp, Homo sapiens
cgtgctgacctcctgtaggccaaattatgggggttgtgctgctgggttccagagtacagggaggcagccagggttcttctgtctataaacttgggcttaatgcatgctgttcaagaggatttggtttgggtcctaaattaatccattgctatgcgggcttgggattgagataggttgaaagagaaactaaaaacctaaaaggtatattgacttcccacagaggaacccgtgtgacttaatcttttccccaacgcagggtgtcctttgtagtttgacatagccttatgttaattctcgatatacttagcaattttaagccagtgatttaaacaatggattgggatggaaaagctctgaaaagttaaatttgtggctgacacaaagaactcgaatatttaccaaaagtaatagaaatgtgtaaatgtgttttggtggtaaactgtccttcatttagaattagttgagaagctggtgtat

SEQ ID NO: 557676 - DNA, 292 bp, Homo sapiens
caagcgatcatgcgggatgtttctaatacttaagaaaacaagatgtttccagtcattttaaaagaatgcctaggttgaggagttccttttgtggtgtagcagaaatgaatctgactaggaatcatgaggttgcaggttccatccctggcctctctcagtgagttaacgatccggcattgctgtgagctgtggtgtaggttgcagacgtaggtcggatcctgcgttgctgtgtctgtggtgtaggctggtggctacagctcccattcgacccctagcctgccgcatgttcgct

SEQ ID NO: 557677 - DNA, 239 bp, Homo sapiens
aactgcgattgtgtgggagacatcatgtgtccccatggcattgaagagttgatttgaacgatgacgtccccattgtgggtgaaaagtcttatcctggataactcctggaccataccattccgctactggcatttgtccaaacatatcaagcagtcctccaagttgggtcctatccattttcatcctgggtggcattaacggtccctccagaaagaagttcacttcttcattccttaagc

SEQ ID NO: 557678 - DNA, 341 bp, Homo sapiens
ctcatcgatttatatatttgctcttttaacaactaatttattgagtgtcttttatgtactatactctactagaacattgccctaaagaagcaacattctattgacagatacagataagtaccatgcagatacctacaagagggaggaaaaatggctacattatgggcattatgagatgctgtggtagcccatgggaagggtatctggtctgctcttggacagggcattatagaagcaaatgccttcaggtagcctaagaaagagtctgggcctcatgtgtagctcagtgtggctaagagggcagaatgtgaccttcagactactgagggggaagagtgggg

SEQ ID NO: 557679 - DNA, 112 bp, Homo sapiens
ctcactcacccaccacattaacaacataaaaccctcattcacacgagaaaacaccctcatgttcatacacctatccccctcgtgctgtccacctcctcttgccctcctctgt

SEQ ID NO: 557680 - DNA, 112 bp, Homo sapiens
acccttgcaatctacaaagagactgttcataactgctctataggaagaaaggttgaactctgtgagttgaatgcagagatcacaacgtgtgtttctgcgaatgattctttgt

SEQ ID NO: 557681 - DNA, 212 bp, Homo sapiens
cggcacgagggcagctaactgtaaaagatgccacattcagccatatccaattgccacctatgaagagagaaaagggggaaagacaccaactaattttctccttttctcttccaccccttctacccatctcttacataccctggattgagggggaaacagtaactgatttagactgcactctagcctgagtgacaaggtgagaccctgtctca

SEQ ID NO: 557682 - DNA, 639 bp, Homo sapiens
ctggggtcacctaagctggtggtgtgcgggatcatttcattgtttcggtcatgtggagaactggtgaagggaagcatgggagctggaccggccttcccagcccgtaccgtggtcatgtccaggctagaggctggaggggagaaacacggccccaccgcagcatgactgaggggcagaggcacaggtgggagggccagcggagatcagcgtggacaggagcgacgcactttgtagcactggctgtggctgtatgctgttgcgatttctgtgtgctcctgttgcacagatctgcttgtttcacactgatccgtatgtcacctgcggtgtgcacaacagtggctggagtgtggggcatttaggccatgctgtgctctaccttcaattgagtaaaatcgagtgagaggttccgggcagacaggatcgacgcccagtccagtccggcagagggaacacacgggtccttcattgtcctgtaagggtgttgaagatgctccctggcggcccaccaagcagacatagatgggaggaggcgccgcatcagcccctcacccctgccatcatctgaagagacggcgcctctgcagcaacgacagggcttcaggaggtgcccgctggcacacagctacgtcttccgtaaga

SEQ ID NO: 557683 - DNA, 1486 bp, Homo sapiens
ccctgttcatactcatcattgctggtcagcctgtccaaccacatgttccgtgtggcaatcatgcatctcaacagttgcatgcagcacactttgcacttgtgtcagcaggccagcatgcatgttgcagggccacacacattcagcacacacatccattccaacctgggccatttctgccaccaaaacgactgaacatgcatttccatatctcctctctcactgggcacacacagggcacagctccgccatttttccaaaggccccactatcggggcacacccctctcacgttctccagttacccgtcaccttcacaggctatctttcacaggatcgccacacccagggacaggggcagcaacaacacacgttttatcacccgctctctcgaagcaatcattcattcaaaggggcctcgccacgagtggcaaccccatggctccagcaagtggccttatctcgggcaagccaaagtccatccaaattgcgcccacaggggccttcccgaaggccaccctatattgcctcggggcaataggttggcgctcctctcattatgcgccacacaccttgtgccatccaggccacttctcgtcaactcggggcccgagcttagggccattcggcactggccacacacgcaatggcggcaccacagttcaactgttatattccgtcacaggctcaattatctcggcgaacccaccacgttccatccaccaattcaacagggggccattggggcacaggcctttccaagcagccccttcccgatcttgtggcgcctgacaaacccacgcaggtagaaaggacgagccttcaaacctaaatttggtacacaccgaacgcggtcccttcaacttcaacgcagtttttacacccatttacaatttggcgttctggactacaaacaccccacaactaggggacactgcatagcaccaaaccatacccacctccgggttggcccacccacaccatgattgccggtctgacaacacaggcgttcccccacacggtacatatcggtccttcgggcactcttactccttgctgtgcggcagcgcttccccaccaaacagtatatgctagcacaccacacagcggggacctccccaaaacaggctgtggccccacctacactttggggggcctccgggcccattacccgaacaagcaacttttagtccccgttgtcgcgatcacacactactccccaaccaggactatgctcctaacctactaagccaactgtatacccgccttacatccaccgcgcgctggggcagccagtgtatgctaccccgattaacaaccgcagcgcgctcatcgcgtattgcggccactctacatttctacaccactagtgccggtgcggcgcaatcagcgacaactgtccctagtgttcccccgacatcacctgagcgcccactccacctggctgctgtggacacacaccagtattcacgccgctaccgcaaacactt

SEQ ID NO: 557684 - DNA, 942 bp, Homo sapiens
  misc_feature (851)..(851): n is a, c, g, or t
accggggcgaccgtttgataagaagtaagactacacacatacagtgtatggagcgaggaccgacaccagatgggataaaggatctcgcacgccgtgacaacgcgaagggcgcgcaaaaggaagccgaagagatagaacaaatcgcaagcgaaaattcggcagtacaaacagggcgatcgcagcacaattgatattaatatagtacgcgggtgggtggtaatagtaggctaccgtaatatggagagatcatgcctaaaacagcacttacatagttaagactaacgttatctcacaagtttggcgacgcaaccaactttgattgaaggagcgtgtacgaagcgtaatggagcgcggaattgctgggcagggttttttcctatcggttaggtcgacgcaaaagggaaggatatcactggagtcactaggtccggtgttgggcaattctaattctatacatgagaaaacgatattttaggaattaaaggaaaataaaagcattctcatataaataaaacaagaatttgttgttactagacctagccttaatgaatggctaaaggaagctattcaaacacagaggaaatgatgacagaaacaatcttggagaatgagaaaggaagaaggaacaatggaaagatgaaaaatatgggtacataacatgagctatccattatcttgtgagttttataaatcataaattatgactagaacaaaacgtatagcagcatctgatattcaaagcagtgatatgtaaaagtggggatggtaaagggtctaatacaaaagtgaagtttccacacttcacttggaatagtaagatgctgacaccagtaaactgttataagtcacantatgtatatagtaaccacaacagaaaccagtataaaaaaaacagagagcggccgtcctttttttcaatgacaaacaaatcgaaacaaggaa

SEQ ID NO: 557685 - DNA, 276 bp, Homo sapiens
  misc_feature (7)..(7): n is a, c, g, or t
cttatgnttattcaggctgaggaaaagagcatattattcacttggaaaggaacaagtaagacatttaatttattggggtgtttcagtaatgtttttccaatagtatattggttttctttctagtttgatatggtttagtggatcctgaaccctgggattaagcagatttagctcttcatattggtgctgcacagtggcagctggctgggcaggcagtgacttggaaacaggaaagaaggcagagactggaaccaagtacctccagtttattctttt

SEQ ID NO: 557686 - DNA, 215 bp, Homo sapiens
aaaagccaaattccccatggtctgggctctgaaagttttgaaaaaaaatttggcccatttgaaaataaattcctcctttaggcccccaaaaataaacagccttggtaagattttcagatatctattgtgggtcttttaaaggttttgccccttttgttatgaggaattaaacatggatccccttccctatattaaaattgcccttttttttttta

SEQ ID NO: 557687 - DNA, 376 bp, Homo sapiens
  misc_feature (48)..(49): n is a, c, g, or t
  misc_feature (164)..(164): n is a, c, g, or t
catgagctggtaccctcacgctacatttggttttcacaaagctagccnnggcagtggggaccgggcaagctcccagaatcaagtcacccagttaagacaccagaaagggccacaactgccgtccctgggctccagggaggaaaccggccacaccaggcagagcngctcgcctcccaagacagggtccgggggaccgtcccgtggtgacacacacagttgtggccacaccgcccatgccctaatcaaacacaccaggctccctgcaccatcacccccaccccgggaggtgggtcccaacttgccgcctatttaaagggaggaaacagggaacggctgctgaccattccacagggctgtccctagcggtgagggcggc

SEQ ID NO: 557688 - DNA, 662 bp, Homo sapiens
cgccgagtcccctcgctagattccctccgtcgccgcaagatgatgtgcggggcgctctccgtccaggcaagccggtcgaccgccgagacctcagcacatcgcacgaccagggtgaggtcgcccaggcttgaatgaagaagagaaaacgacaggacagtgccctgtgtttaaggccgcggtcatttcagggagccaggtggtcgtcggtggaccaacatgtacttcactcaaggtgcacgctcggacgacgagcgagcttcgtacaccgtgcgagatgttccaatgcgtactccctgcatgagaaacgaagcgcctggaccttatctaatcgtaccagagccaataaagcgcaagcatgatgagctgacctatttctgatccgtgactttggacaagggccccttcagccagaatgacgtgacagcccgtcagtcctccgtctaccagagcgtgcacttgtgattcctccagtaagcttcagtctccgggctgtgccccttgcgtgtcggaacggcgcgcgggattctgcagctgcgttttgcattttctcttcctaacatttcatcggtgtctgcttacttgtcccttccccaagtacggtgcatctctacattacttttcacgaatatttttgcacaatcgaatataatttttcggaaatt

SEQ ID NO: 557689 - DNA, 1133 bp, Homo sapiens
gttgcagagatggtggagctagaataaaaaaacaaaaaaagcccttttcagtttggtgcactgtgtatggcccgtgtagaattgatgcagattttctgaaatgaaatgtttggtttacgacgagatcataccggtaaagcagggaatgacaaagcttgcttttctgggtattgttctaaggtgtattggtgactttaactggttatatttaattggccaatataaggtaaatatagattatatattgtcatagggtgtttcacaaaagcttagaacctttaacctttccagaccaccccaacaggtgctgtgaatatttcagaagtcagtcatgggttatacatgttgatagtcccaaagcacataagctagaagaagaaattatttctaggagcactaccattcgtgtttttcaacattgaaagtgccacacacattagaactccaacaacattcaatttctcatgtgccacagacgtgacgtgtagtaaatattcggtcacagaatctatggactgaatctaatgcttccaaaaatgtcggttcggtttggcaaatatcaaacattggtcaatgcaagaacattattaattacaaaatgaagattatatacccacttggggataaagctgtactagacctaaatctgtggaactgcattgagaccggtaagagcaagtactcataaggctatatgacttacaaaacaaacaaaaaaacacacaaacaaaaaaacacaaaacaaatagagaacacaagcaagacaggaagagaggaaacacgaacatggaggcgaacataacagaaaaggagaggaagcacacgaacgaacaaaagagagaagagagaaaagaagaaacgaaaacacaacgcagggaagaaaaacagcagagaaaaaaagaagagagaggcacaaccggcgcgagcgaccacaaaggggagacgcaagaagaccccacgccaggaaagaaacacgagaagaaacacgaacacaaacaaacagaggggaaagcacggaacaaaaagaatagaagaaagacagaagaacgcacagccagacgacggagacggcgcgagcaaagcgcgcgcacacgccgcgagcggccgcagacagacaccagaaaggacggcaa

SEQ ID NO: 557690 - DNA, 132 bp, Homo sapiens
gtcgaggctccagtgagccatgattacaccacctcattccaacatgggtgacagattggagaccctatctcagaagagaagaccaaaaaagtgttgagaagacaacttgacagattgagagaggtatttcgc

SEQ ID NO: 557691 - DNA, 137 bp, Homo sapiens
tacaatgtagtatcattgtgatgttgagcagttgtagtgcagcaggtcgcgtgatgtgagatgcagcagataaccggaaaatcacacctcttatgtcagcatttcgcaaggggtcatgtaaacagttgttcaagtat

SEQ ID NO: 557692 - DNA, 212 bp, Homo sapiens
acactggcgacacctcgacgaatctaactacaaacgctaatgtctgaccaaactgaccgacagaccctagatcaccacctatcagagcatatacaaggtacgactaggacaaatccgagtgcgcgttaaggtcgtgtacgtaaagcctactgacggtaaccgagaaccagtcgtctatctacttcaaatctcctgcaaggcagaaaagccta

SEQ ID NO: 557693 - DNA, 240 bp, Homo sapiens
ctttcttctccagtgccccccatggtgaatgtcacctgcagcgaggtctcagagggcaacatcaccgtgacatgcagggcttccagcttctttcccccggattatcacactgacctggcgtcaggattgggtgtatctttgagccacaccacccagcaagtggggggtatgtcctgcctataggggtatggacctaccacacctgggtggccaaccggatttgccaaggaggaggcgcag

SEQ ID NO: 557694 - DNA, 139 bp, Homo sapiens
caggttctgttaggatttttctcccagtgaaaaagcactcaacactgtagttgctttaaaactactcgatgaccttggcgtattgataacctgttttgcttttgccaaagcattttcaaatgccctactttggaaagtg

SEQ ID NO: 557695 - DNA, 339 bp, Homo sapiens
  misc_feature (9)..(9): n is a, c, g, or t
  misc_feature (18)..(18): n is a, c, g, or t
  misc_feature (164)..(164): n is a, c, g, or t
  misc_feature (174)..(174): n is a, c, g, or t
  misc_feature (190)..(190): n is a, c, g, or t
  misc_feature (200)..(200): n is a, c, g, or t
  misc_feature (236)..(236): n is a, c, g, or t
aaccataanattccctgnctctcggaacttgaaactcctactgtaaactgttttccttgaaaatgaaagctgtacaggacgattcactgccatgccagtcaggcgggcttgtcatgttctgtgaatctcgaagtgaagggtgccacccgcccccataccctccnccaccggccnctgtcggggatgccanagcctgccanggtcgcagccagacgtgagcttggcattgaagttgncaaaaggccctggccgggcttgccgtcgctgtcccagggccgtgtccggtgctgtggctgtaaagctgtaggaccctttttaataaatagagaattattaata

SEQ ID NO: 557696 - DNA, 391 bp, Homo sapiens
tgctgttgcgcccttaccttccccagcgtcccagtttttggcagttctggaatggaagggttctggctgccccaacctgctgaagggcagaggtggagggtggggggcgtaaagtagggaattagggccatgcctgcccccctcatttcattcaaaccccaccctagtttccctgaaggaacattccttagtttcaagggctagcatccctgaggagccaggccgggccgaatcccctccctgtcaaagctgtcacttcgggtgccctcgctgcttttgtgtgtggtgaacaaaagtggaacttgggggggtggaaaacccgggggccctgccaccttccttacccgttttaaatataaaaataaagatgtgtttaagggttgaaaaaaaa

SEQ ID NO: 557697 - DNA, 1328 bp, Homo sapiens
tcccctaaaaaattctctttttagggggaatgggaaacggacacctcataaggggttccaaagactcactcaattttctcgtgactttttaacatctcattatctcatttattatattttacaccttaacaaaaagtgccgtgctagtgcatttcttcgcgggccggattggcaacatattttttcccagtggctccataaacaaaacaaacaaaaaagaggggggacgcgacacacaaagatactcccacgcggagggcgccaaaggaacaggaggctacaccagaggagaactccgggacacacaagaggggcacccttacagaggagaacagcagcaactcataccaggccaagaggacaacagaggcacgcgcagcgacaataaacacaggacggagcgcaccgggacaacacggagctaaacaatgggaacacccaaagagcagaacagagacaatcgtctaaaacaaacgagagagaggagagagcaacacaaaatgcgggccacacaaaagacaccaaatagagaggagacaataacaacaaccacacactagagggacacacactccccacacacaccaacaacaggcgataaacacgagggaaaaaaacaaaccaagcgaaaaacaagcacagagacagcgtcattagaaacacgccataagcaggatctcacacgtaaaaaaatacaaatataatagggaaaaacaaatgctataaaacacaaagacgaaaatactactcaagaaacgaagaatcaagaagaaagacacaaaaaatcgacgaccaacacagacaacaaacaaagacagacaaagacacacagtgaatcaacgacaaaagaagaagagaaagaggaagaggaaaaagaagcaaaagaaaaagcaaggagaaaacgagaaggagacaaacagaacagaaagagagaggagaacagaaaagagaaaaaccaaagagagcgcaagaagcagagtagggagagcggcgcgcaggcaccaggtaagaaacaaccggccaacagagaaggatggcgcgtcgaggcggacaaaagaggacgacaaacaaagacgaaagaactagaagcgagcgcaagggtgggaagagatcgaagacgcgggagcgaatatgcgacagtaagagggaatagaagagaaaaggtcaagacaataaataaagacagagatggagaggacaggacacgatagaggctgcagaagggacggagagagcgcgtgaagcggcgacgcgcatacgcgagagcgagggaagcgagacagcgacggaacgagacgagcggggggagggggcgaagatgaaccagc

SEQ ID NO: 557698 - DNA, 127 bp, Homo sapiens
aggaacgatgccagactgtccatagttcatcatgccattggtccatagaagttcatcccagccatctgctgggtcatctgagataaggttccattgcagctgctgagctggctggaccccatacaca

SEQ ID NO: 557699 - DNA, 101 bp, Homo sapiens
cctagtcttagaacgtttcaacttgcaaatgtgactacggactttatgttagataatagcactgtatcagtgttaaattctccgaatttattttttttttt

SEQ ID NO: 557700 - DNA, 831 bp, Homo sapiens
  misc_feature (793)..(793): n is a, c, g, or t
tgagcgggtgtcacgcctgccgcaccgtagctcccggggcctccgcggggagcgcgtccccgcatccagccgacccccggggctggcacgtgctgcgcccggtccgtgctgatgggggcgtgatggccccgatctccccgaccccgccttctctgcttagaggaggaggagcagtcgtgcagcggcgagctaggtgaggctgactgctgcctgccgagtacggcgcggcggacaggggactgcagtcagctgctgtccacttggggctgtgcgggggtccgcgtcccggcgagtgttccctggagcactccctgagtagctggcagcttatccccactgtccgctagacccgctcctggtccccggactctgctctgctggttggcgctggcccccgtgcaccggtctgggttcggcccccggccgaggtgtagggcggacgcaaagggggacgcacgaatctggggggaattgacgccgggattttgcagggctgaaactcgacacgcgccaagggggggccccctggcaggagacacccttgagcgctggacattgagatatactgcataccaggaaaattcacaactagcgcccggtggcaccgcatttacgaaattttggacaaatcatattaatcgccaacttccctaacattagaatgaagcggccctgtggtgtcgacaacttagtggaagaggaaaaaacaattgtccccaacaacaggagacaaaaacctggagagcaagactgaggagagcacatataaattcatgaaaagactataactccnttgggagaagcaaagccccccatcgatgagttcatacc

SEQ ID NO: 557701 - DNA, 968 bp, Homo sapiens
  misc_feature (1)..(1): n is a, c, g, or t
  misc_feature (564)..(564): n is a, c, g, or t
  misc_feature (568)..(568): n is a, c, g, or t
  misc_feature (580)..(580): n is a, c, g, or t
  misc_feature (590)..(590): n is a, c, g, or t
  misc_feature (718)..(718): n is a, c, g, or t
  misc_feature (733)..(733): n is a, c, g, or t
  misc_feature (740)..(742): n is a, c, g, or t
  misc_feature (744)..(745): n is a, c, g, or t
  misc_feature (747)..(747): n is a, c, g, or t
  misc_feature (749)..(749): n is a, c, g, or t
  misc_feature (764)..(764): n is a, c, g, or t
  misc_feature (787)..(787): n is a, c, g, or t
  misc_feature (826)..(826): n is a, c, g, or t
  misc_feature (829)..(829): n is a, c, g, or t
  misc_feature (858)..(858): n is a, c, g, or t
  misc_feature (869)..(869): n is a, c, g, or t
  misc_feature (871)..(872): n is a, c, g, or t
  misc_feature (882)..(884): n is a, c, g, or t
  misc_feature (886)..(886): n is a, c, g, or t
  misc_feature (888)..(888): n is a, c, g, or t
  misc_feature (890)..(890): n is a, c, g, or t
  misc_feature (892)..(892): n is a, c, g, or t
  misc_feature (894)..(894): n is a, c, g, or t
  misc_feature (912)..(912): n is a, c, g, or t
  misc_feature (914)..(914): n is a, c, g, or t
  misc_feature (917)..(917): n is a, c, g, or t
  misc_feature (925)..(925): n is a, c, g, or t
  misc_feature (934)..(934): n is a, c, g, or t
  misc_feature (936)..(936): n is a, c, g, or t
  misc_feature (939)..(939): n is a, c, g, or t
  misc_feature (947)..(947): n is a, c, g, or t
  misc_feature (968)..(968): n is a, c, g, or t
ncccctcagcaacagctcacccaccgttcgccttatgtgtgttccgtcctaaaaccaccccttttcgtgctttctatgctcgagggctcatttctcacgcatctgttccaggcaggcaaacagaaccaccaccgcctaccacatcccacacaccaaagagcccctggatctgcgacccgcgccagggtcaccctccggccccaccgccccgcatgaacaacgccgcactcgttgccgctctcacggctctgtgcccgcggacttgattctcgcgcataaggtttccccccttctcccttgaggggcaggcccctccctcttcactcccaaataacggccccaaccccgcattggccaaacggtggccactttcttaaccggaaaaggtgcccaaccctgttggcgcccaacgagctcaacgccattcccggccttttatttggatacagatccaacgtcaccctgacgaaaacaaaaaacatggtggtccgggcctgtggttcccactagttcctccgagaattaacccctatgggccaagtttttctgatcctccattgctcncctnggcaggaaccancagaccaacngccttttgtgagaccttcccctccctatccccaactttaaaggtgtgagagtattaggaaacatgagcagcatatggcttttgatcagtttttcagtggcagcatccaatgaacaagatcctacaagntgtgcaggcaaaacntagcagnnncnncnancaacgcataaagaanaatggccgggcaggtcattgctngaagtctcagccatgacggactcgtttcagaggtaattntgngcgcccaccagccaggccacccagccgtnggaggaagggngnntggcaaggcnnngncncntngntgtctgtgcgaaaggaanantgncccggaanttcctgtantnaangtcacaanaaatcccgagtccggccggan

SEQ ID NO: 557702 - DNA, 272 bp, Homo sapiens
gtcatttctctttagagtcttttatctggaacagtttgtcaatctttaatggtgccgacatttttgaagtgtagaggccacttttacctatctctcgagttttaaaaaaatgtggcgtggcatagtggctcactcctgtaagctcaacactttgggaagctgaggtgggtagatcacttgaggtcaggagttcaagaccagcctggcaaacatggtaaacccagtctctactaaaaatacaaaaattagctgaacatggtggtgtcgacgcg

SEQ ID NO: 557703 - DNA, 357 bp, Homo sapiens
gactctagagcatcccctctgcgtaactcataatagcatgtggaacttgagtgtccaaggtctccagaggatgaaagcaggagtctgtcagggtcctactgagacagcacagccaacctagctagcaacatttgtcatagtctgaacaatatatacttatagaattcagtcaaagatacacaatctagaaacagcttcatggggtggactctaacagtagttgcaatgttttagaatgagacttacttctctgctatctagatctgaactccttggcttctttacttagttcaagccccagcctaggaaagccagttacctaaaagttggctcaggagtctaagagcttaacctaaa

SEQ ID NO: 557704 - DNA, 215 bp, Homo sapiens
gaggaagccaagagctcggacagaggcggagaggggcgggaagcgcaacaggtcacctggaggaagccccatactgacctcctcatgctgctgacacaggcaggatgtgcattgaactcagggtcacctccaggaatcggaccttgctatgagaaccacgggtatcagtctgagcacatctgtcctccgagaccaccagtggctcccaatggcta

SEQ ID NO: 557705 - DNA, 803 bp, Homo sapiens
agacgaggggtggggaatagaagccggtggccggggcgtgtgaagtgttacaagtcggccggattgggtgaaacaattgcgggagaggtgagcgttccgaggataaaagagggtagttgccgtgtggcaggagcagtagagtctcgcggggcggacgtactgtgcaagtctttggtgtagtagggaggacgtgctagtagtgctactggtagagagtaattgaccaggagggtgtggccgctagcccgacagtggcctggggcaaatgtcaggtcgtccgcgccgtgtcagacagagggccacatgtagagggattttaagcctgggtcattcggggtgcggggcgccgtctgaggaccagccgttccttgtagcctaatatgttggtttaaatatgcatagctacaggggttccgtaagaatgctgtcgcagtcacgtcgaacagttatgtgttgttggtctcgaccagtttctgaagccgttctgtagaggtcgtttatatccatgtcaccttaccagccaggcagtggcaatggtctcgacacaactataggttccgtagtaagtcttttcatacgcagtgctgggcgcggggggcagataagcaataggagtagggcagtggagagtagagtaatacatagaatgaattgaattgcagtattctgggaaagaaccaagaatacagaaagacaaaagaaaaaaaaatagaaaaaaatagaagtaaaaaaataaaaatagagaacacagacaaacatgagagtaaaggaagaaaaaaacaagaaaaaaagaggacatacgc

SEQ ID NO: 557706 - DNA, 700 bp, Homo sapiens
  misc_feature (23)..(23): n is a, c, g, or t
  misc_feature (26)..(26): n is a, c, g, or t
  misc_feature (33)..(33): n is a, c, g, or t
  misc_feature (39)..(39): n is a, c, g, or t
  misc_feature (42)..(42): n is a, c, g, or t
  misc_feature (44)..(44): n is a, c, g, or t
  misc_feature (48)..(49): n is a, c, g, or t
  misc_feature (63)..(64): n is a, c, g, or t
  misc_feature (68)..(70): n is a, c, g, or t
  misc_feature (87)..(87): n is a, c, g, or t
  misc_feature (89)..(91): n is a, c, g, or t
  misc_feature (131)..(131): n is a, c, g, or t
  misc_feature (134)..(134): n is a, c, g, or t
  misc_feature (142)..(142): n is a, c, g, or t
  misc_feature (157)..(157): n is a, c, g, or t
  misc_feature (179)..(179): n is a, c, g, or t
  misc_feature (188)..(188): n is a, c, g, or t
  misc_feature (191)..(191): n is a, c, g, or t
  misc_feature (196)..(196): n is a, c, g, or t
  misc_feature (246)..(246): n is a, c, g, or t
  misc_feature (280)..(280): n is a, c, g, or t
  misc_feature (397)..(397): n is a, c, g, or t
  misc_feature (399)..(399): n is a, c, g, or t
  misc_feature (434)..(434): n is a, c, g, or t
  misc_feature (495)..(495): n is a, c, g, or t
  misc_feature (587)..(587): n is a, c, g, or t
  misc_feature (672)..(672): n is a, c, g, or t
aatccccggggattttgtgccanggnatactgntaactnatngnattnnaatttttctctagnnactnnnatagctaagcaaatgangnnncatgccagtctttcttcttttatacacaacagacaaaagngtnggggggcnagacaccaaccagcnattttttcccctggaaccagancatcatacngcngagtnccttcaaaccatcaaagtacagccttccttccaatgttgcataatctgtncaaaatcacagtataaatacaaagttcttccatncattttacaaaaccagcaaaactcttcaataaaatcctacaggaaaaagtagaccaatcttcatttacaaacagcatttttaacagttattattttaaattgttacaaaacataagngncaaaatcttaaatccttaaagtcacacgatttccnacagaaataagaccctcgccccacccatattacttatgactcaggacagttgttccgtccncacggggacccacgggccaacttttcaccaacccccaccagagggggaggccggccccagcactggccccggcccccagacgggcttcagcncgggcctgggcgcgggcccggggggccgcggcggcgagggcctcacggtactgcactggccagttctgcggttccttcttatgcngtttggccacgaaccccaggacttccat

SEQ ID NO: 557707 - DNA, 143 bp, Homo sapiens
gtgagagacggggaagtgacagtgatggtagtgtcagtgaagtacggttcttagctcttttccgattcattatttgacttgtgttgagttttaatgagttctttatatatgtctggtctcagactcctgaggtcaagtaatcc

SEQ ID NO: 557708 - DNA, 527 bp, Homo sapiens
  misc_feature (46)..(46): n is a, c, g, or t
  misc_feature (152)..(152): n is a, c, g, or t
  misc_feature (194)..(194): n is a, c, g, or t
  misc_feature (204)..(204): n is a, c, g, or t
  misc_feature (218)..(218): n is a, c, g, or t
  misc_feature (335)..(335): n is a, c, g, or t
gtcctgggatagcgagatccatgtctggctgtgtacatggcaggcngctcccaaggcgcgtatgctcctcatgtcccttcctctatctccaagccagccatgtgtggctgagcacctctcacacttcgaacctctccttcctctcacctctncatgacccaactgggtgtcagactaatcgcaggatcatcccncctattttanagggcatatgacanagcaacccttaattcgcctctgcaactttaagttcccttttgttattggaaagtaaccctgttccccaggttttgacggctgaggatgtagccatcttttggagaccattccttggnatccccacagggactctctgcagatctttgggcttctgcctttgtgcagcctcctcttccctggtactgtgtcctgcaaactctcctgtactctcacctctgcctcttcaactcagggagtctgttgggttctgcctgcctgccctgacttcctgcggtgattccctctgcaaggaacccacgcgggtaccg

SEQ ID NO: 557709 - DNA, 1445 bp, Homo sapiens
  misc_feature (33)..(33): n is a, c, g, or t
aagcagtggtatcaagcgcatagtcgccattanggccggggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcctggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagcgagcaccaccaatacacacacacacacacacacaaccctgagagagagaaagagagagagataacta

SEQ ID NO: 557710 - DNA, 423 bp, Homo sapiens
gcacgagcgcacgtaggtctacacgacactactttccctataatatgatcataacactcttatgagaacgccctcataatcattttccttatatggttcctatacctggatgcccttttcctatacacttacacacaactattctggccggcattattctaatcctcattggccttccattcctatacattctttacataacagacaaaggcaacgatccctctccttaacatctcaattggccaccaatgggactgagacctaccagtacacacgactaccggggactatatcttcaactcctacatacatttccccattattcctataaccaagcgaactgggaatccttgacggtgacacatcgagtagtacttccgagtgaagcccccattcgcgtaataattacattacgacggtttg

SEQ ID NO: 557711 - DNA, 1326 bp, Homo sapiens
  misc_feature (33)..(33): n is a, c, g, or t
aagcagtggtatcaagcgcatagtcgccattanggccggggagaagccgggaggactgggtgcgcctgcagggatcggaagccggttggggtgtgagaggttttctcgctctaggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcctggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagcgagcaccaccaatacacacacacacacacacacaaccctgagagagagaaagagagagagataacta

SEQ ID NO: 557712 - DNA, 1328 bp, Homo sapiens
  misc_feature (342)..(342): n is a, c, g, or t
gatctgtttcgcctggccagcgagtcccgagtccgatgagactagtggtcgcgccagatcgggatgtagacctcagcattgctttatgcttatgagtaacatgcgaactgcagtagtattgtattgatccacgactgtgtgagtgcagccaatggaagcccttcatactgtcaggtacccaaatatgcctcacgatgtgacaagtcttgactggcacttgattagtgttggtggtaggataggaatcgctactaggcacaaatcgcgagacgagggcggtacgaccgaatatcgtacctccgttggtgacctcctagaggggggctttgaattcgagttggnttgaggtgtggctttgccgagaaggccgctcgagatttgcttagtcgaggaaacctaacgcgaggaagaacataagccgggggggctacaaagccatttttttttggggccctcgaagggtttaaggttcccgggaaacttcttcccctttgggccaagggaccagggggaagtctttttgccacaacggttttaccggaatggttcgtaggaggaggaaccgcgacacattggcccaaaggggccctttgtgagggtttcgctttaccgcacaaacgcgcaatacgtccgcaccgcacagcgtatgtggcctttcaaagcaacagggcacataacacaccgaagagcggcggtggggtccaaatagagcttaccctttatgagaaagcaaccataggcgactttgcgcgccttgcgccagtcacctcttgttcgagccgccaccttggctaagtcgggtgagggggcccaccccagaagcgggttgcaagggtgcgatagaaggagaatggcgaaagaaaatagcttggccaaaagcacgttggtgaaaaagcgggtccctcaccaactatgtccaaatctggttttggggggttagcctcccccctttggtggcccccgtggtttggttatatgtcggagttactttcgccttttttaaaaaaccgcccaggtggacagggcacatttataggcgcccttttggggtttttccacccgcccccgccccaaaaaaaaaagtgtttaaagacccacaatttctcaaaagaaaggggaacagctggggcttgataaatgtggggttaaccccctttgggggggcaatctttttgtaccacaacggggcccctctggaaacacccggcaacacacaccacctttggtgttattaacaccgggcgccccccggtatagggggcaaactttttaccacacagcgggggggaaaacccgcccaacaggcaaaggtttctcttaaacgtttg

SEQ ID NO: 557713 - DNA, 511 bp, Homo sapiens
caccaaagagtcaaactcgtgcctagaaaccgattatagatcatgcccacgaggatccacgctactggcagcatcgaggatgagggatgaagggtctgtgctagatcaaaaggcaacggaggatacgatgtggcagagaagtcgcatgtggagagacctatgctaataacaggcttatggaaaagctagggaaaagtggttgcccgcttaccccctttccctaccccttcaagcacccgcatggagataagggcttaatagttaagagctgctataaacacagcttgcttaaatgtaaagagaagcccaggggtactacaagcatatccttcggatgcttcactccagaaagagggagtagaggcaagtcctcattactaataaaaatccaggtgatgctaacacttctcttgaccttcggataataacgcttagtatgtctctactgcccacaaggacggctccatggggttgtcctaatttcagcattcggaagcccatagagagggtt

SEQ ID NO: 557714 - DNA, 1469 bp, Homo sapiens
  misc_feature (33)..(33): n is a, c, g, or t
aagcagtggtatcaagcgcatagtcgccattanggccggggagaagccgggaggactgggtgcgcctgcagggatcggaagccggttggggtgtgagaggttttctcgctctagaacctcatagaaattctttctcagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcctggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagcgagcaccaccaatacacacacacacacacacacaaccctgagagagagaaagagagagagataacta

SEQ ID NO: 557715 - DNA, 118 bp, Homo sapiens
tttctttgctcagctccacggtgacggctgagatggagggtttgtctccgcataggctgggatcttcttggatcttcatctggagcaggcaggtggggacggccattcaacgcctccg

SEQ ID NO: 557716 - DNA, 834 bp, Homo sapiens
  misc_feature (33)..(33): n is a, c, g, or t
aagcagtggtatcaagcgcatagtcgccattanggccggggagaagccgggaggactgggtgcgcctgcagggatcggaagccggttggggtgtgagaggttttctcgctctagaacctcatagaaattctttctcagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctggatggtgctgtatgcccgtattatgataagcacctctaaacattctcagtattgag

SEQ ID NO: 557717 - DNA, 1391 bp, Homo sapiens
  misc_feature (33)..(33): n is a, c, g, or t
aagcagtggtatcaagcgcatagtcgccattanggccggggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcctggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagcgagcaccaccaatacacacacacacacacacacaaccctgagagagagaaagagagagagataacta

SEQ ID NO: 557718 - DNA, 220 bp, Homo sapiens
cccgtttgaaaggtggatggaagtgatccccagtgcccccagttttgcctcgggaccccccgtgttgagccccaaagagtttcttgtgtattgatggccggaccccctcgtttccgcagtgggtgctttcctggaagacgtttccttttttttgtattaatgaagcctggtaaaattaccccctgtttgaaaatcaaaaacatggcttccccgcagctta

SEQ ID NO: 557719 - DNA, 168 bp, Homo sapiens
acgtaaaattttagcctatctagtatcttcaaattgtggtctttgtaacaaccaaataacctttggtggtcactgtaaaattaatatgtgggagacagaatccatgtacctttgctaaggttagactgcatactccatcggactgtgaatttgaatgtttgtgctata

SEQ ID NO: 557720 - DNA, 308 bp, Homo sapiens
tcctctccatctctcctttcttttgtcctcctctctccgtctgcccgtctcttttacctctctctctcctctccatctctcctttcttttgtcctcctctctccgtctgcccgtctcctttacctctctctctcctctcattctctcctttcctttgtcctcctctctccatctgcccgtctccttttacctctctctctcctccccatctctcctttcctttctcctcctctctccatctctcctttcttttgtcctcctctctccgtctgctcgtctccttttacgtcgacgcggccgcgaattta

SEQ ID NO: 557721 - DNA, 540 bp, Homo sapiens
  misc_feature (48)..(48): n is a, c, g, or t
  misc_feature (144)..(144): n is a, c, g, or t
  misc_feature (334)..(334): n is a, c, g, or t
  misc_feature (364)..(364): n is a, c, g, or t
  misc_feature (376)..(376): n is a, c, g, or t
  misc_feature (398)..(398): n is a, c, g, or t
  misc_feature (406)..(406): n is a, c, g, or t
  misc_feature (416)..(416): n is a, c, g, or t
  misc_feature (426)..(426): n is a, c, g, or t
  misc_feature (438)..(438): n is a, c, g, or t
  misc_feature (449)..(449): n is a, c, g, or t
  misc_feature (463)..(463): n is a, c, g, or t
  misc_feature (466)..(466): n is a, c, g, or t
  misc_feature (472)..(472): n is a, c, g, or t
  misc_feature (487)..(487): n is a, c, g, or t
  misc_feature (499)..(499): n is a, c, g, or t
  misc_feature (531)..(531): n is a, c, g, or t
tgccgggaagtaaccaaaaaaaccatccccttagggtgggcggggggngtttgtgctggggtcaaaagttttgtactcgtaacacaaggatcatcgatgttgtctacaatgcatctaataccgagttggttggtaccaagcccntggtgaagaattgcttggtgttcatcgacagcccccggtaccgacagtggtacgagtcccattatgcgctgcccttggcccgcaaaaagggagccaagttgactcttgaggaagaagagtttttaaccaaaaaccgttttaaaaaaattcagaagaaatatgatgaaaggaaaaagaatgccaaaatcancagtttcttggaggaccagttccaccaggncaagttttttgngtgcatcgcttcaaggccgggncagtgtgnccgaccaaanggttatgtgntagagggcaaanagttggagttntattttaggaaaancanggcccncaaaggcaaataaanccttgtttggtnttcccccatgtaataaaggtgtttattgtttngttccccca

SEQ ID NO: 557722 - DNA, 1101 bp, Homo sapiens
agagggatagggccagcaaggcaggtatcgaagcgagtgtctggcagccgggagcccagcgaagagagcgagcaacgcgttaggaaaacgagcgaagctaaagggagtaggggagaaccactcataggttcccgccgccatttccctttgacagctagtgattttgcctttcccgtggctgccgatgagagaatgctggagctctggcgactatcagcgcaagctaagatttctcagctagtggacaaacgatcatgtccaagtcctgagaagggggtaaccaaagcacccgcgtcagcagatactcactcatgcgtagcatcgagagtgaagctcgtgttgcgctcagaggacgcatccacaagagttatgctgaagaagatgttctaaagatctctgtaacttagcgatggttggacgcaccattggtcgagggttgtaaaaaagagtacgaaacgtcgaagcaatgaaatgcatatagacgtttcagtctatgcggcccttgggaatgggtaggccgggccatgagcatcacatggaagagcacctaaaggagtggagacgtcacgcatggaatctccgcataggagcccaagtcgcctttggagagcaccaaagcaggaattcctcggttaggaggacgccaagactaaggtaagcacctggtcacgaggagcttggaggtcagaacgtgagggcgtatgccagcaactagtgatgccccagagatggagagatggcagagagcgaagacgcgaaggaaggggccaagaaggcagatcgctagaaggtggggaaactacgagaaaacgggaagcacttaacttgaattaggtgtaaaggaattcactactcgtaagcaagacacgcaatcttgtaggaagacgcacaagagaaattgagcaatcgaaccatggtaccaatgtaaccaaagggccagtggtgtcaatcaaaagatacacgggggccctgtgggaataaggcacgttccagagaggatagagttcccaggaaaggagaagcgagcaacagcgagaaatagctcgaaaaggagacatgacggtaactaggaagaggatatgcaagacaggaggagtcaat

SEQ ID NO: 557723 - DNA, 441 bp, Homo sapiens
ccgagaccacatcagtactccatatttgagcaggccagcatcgtagagtcccttctgcggcacctggggctccagaaccgcagaatcaacctgctgtctcacgattatggagatatcgttgctcaggaactgctgtacaggtacaagcagaatcgatctggccggctcaccataaagagtctctgtctgtcgaatggaggtatctttcctgagacgcatcgtcctctccttctccaaaagctcctcaaagacggaggtgtgctttcccccatcctcaccaggctcatgaatttcttcgtgttctctcgaggtctcactccagtctttggaccggatactcgacccactgagagtgagctgtgggacatgtgggctgtgattcgcaacattgacggcaacctggacatggacagtcttttacaggacattaatcaaaggaaa

SEQ ID NO: 557724 - DNA, 1566 bp, Homo sapiens
  misc_feature (823)..(823): n is a, c, g, or t
catggcggtctcttccttggggggatggtttttctctcggtgggtggggtgcgtattgtatgttctcctccgtggtgtggtgtttagttatcagaggggcgttgtggtggtggtggcctcccccctcgttgtctgccgccccaccacacgtttgttgggtcggcggcccgaccgtcttcggtgtggtgttgcgtcaaacagctgcggcgatagtctggtttggttggggttgttcgctccgtttggttcgtctgtctctgtggcgtggggggaggagtatgttgtttgtttatttgatatgtgtgtgttgtttgttctgtccccgctcttgccgccttctgttttttttattatgggtggtgctgtcttctcgctaaggagggtggtcttcgctcctctgtagtggttgtttttgttgttgctcctcctcctgggggggggcggcccacctcttttttttcttctcctcacaggaggatgtttgtatgaggtggtgtgtgttttttttagaggatgagttgtatgttgtgttccgccgccgcgtggtgcctcgctggtaggtagcgtctctgttcacactcttttgttgctctgcggcgctccgcgtggctgcgcgccccccaccgggggggttcttcacgacggcggccgctatttttgtgtgtcgttttatattctgggggtggtattctactcaacataggggtgctcactcacttctgtgtgtttttttgggtgtgttgtttttaatgagtcgcctccctccacacgagagatgatgtggtgtgcgcccccccccccggccgacacacaacagtcgggnggggcgcgcactactactactactctctgtgcgtctcacagagagtgtttctctcagatggtgtgtctctcccatcatgtgtccctacagagagagcttttttcttgtgggggtgtgcacacacacagagagtcgtcgcgtcactatacgcgcctcacacacactgtgtcgtctccttctctctcacagagaggctcacccgcgcccctgctgtgcggcgtgttgtgtgtgtgtgtgtgagcgctcctctctctctctctctcttgtctctcctcctgcgtgcgcgcgctctgtgcgcgctctgtgtgttctccgcgcaccctgctgtgtgtctctcttagagagatagcgtgtctctctgtgtgttgtgtgtggggtgtctcgggcgggtggtgtgatctcctccctctccccgcgcggggtgtccctctctctcacacccctgtggcgcgcgcttttctccacacagcgcgccaacctcttgtgtgcgccacctttttgtagagagcactcttcccgtgtactctcgtgcccccgcgaccctctctgtgtgaagagagagaaactgtagttttcccccattttccctctctaaagagagagattattcctcggcccaccctcttctctcaaacacccaccccccgattttttctcctctgccccgcgggccccggcccccccggggggcccacacaaaagaggtttttaaaccaaaaaaaaaaaagaggatttaaggggga

SEQ ID NO: 557725 - DNA, 373 bp, Homo sapiens
  misc_feature (201)..(201): n is a, c, g, or t
  misc_feature (205)..(205): n is a, c, g, or t
  misc_feature (213)..(213): n is a, c, g, or t
  misc_feature (217)..(217): n is a, c, g, or t
  misc_feature (219)..(219): n is a, c, g, or t
  misc_feature (228)..(228): n is a, c, g, or t
agaagggtgagcaatagagaaggaagtgaatcactagcacttcacaagtgctgctgcagaggcctgccatagagagctggctgagacctaggtgctctcctgctgatctgagagggcagaaaaataaataaatagaaatgtcaaaaagaggacagcagcagtgtagggaagggaggcagtagaggaacgaaactcccgggngagnccaacgtngcangngtcaggatngctgtgggtggttcaaatgtgagaaccaataccctccttccctagctaaagttgttcccccatcagcctcagtttccaccatctctgaggcattcacaggaggaataactggtgtgttaaaatccaccaaccacttatatacagg

SEQ ID NO: 557726 - DNA, 374 bp, Homo sapiens
  misc_feature (168)..(168): n is a, c, g, or t
  misc_feature (198)..(198): n is a, c, g, or t
  misc_feature (210)..(210): n is a, c, g, or t
  misc_feature (232)..(232): n is a, c, g, or t
  misc_feature (240)..(240): n is a, c, g, or t
  misc_feature (250)..(250): n is a, c, g, or t
  misc_feature (260)..(260): n is a, c, g, or t
  misc_feature (272)..(272): n is a, c, g, or t
  misc_feature (283)..(283): n is a, c, g, or t
  misc_feature (297)..(297): n is a, c, g, or t
  misc_feature (300)..(300): n is a, c, g, or t
  misc_feature (306)..(306): n is a, c, g, or t
  misc_feature (321)..(321): n is a, c, g, or t
  misc_feature (333)..(333): n is a, c, g, or t
  misc_feature (365)..(365): n is a, c, g, or t
ctgacatctcaccgtgcgacagtgtgtacaattcccactatgcgactgcccctggtccgcttcaaggtaggcaagctgattcctgaaggaagacgatgattgagacaaccctcgagctaaaaaaattcagaagaaatatgatgaaaggaaaaagaatgccaaaatcancagtttcttggaggaccagttccaccaggncaagttttttgngtgcatcgcttcaaggccgggncagtgtgnccgaccaaanggttatgtgntagagggcaaanagttggagttntattttaggaaaancanggcccncaaaggcaaataaanccttgtttggtnttcccccatgtaataaaggtgtttattgtttngttccccca

SEQ ID NO: 557727 - DNA, 501 bp, Homo sapiens
  misc_feature (28)..(28): n is a, c, g, or t
  misc_feature (59)..(59): n is a, c, g, or t
  misc_feature (162)..(162): n is a, c, g, or t
agtaatagcgagaatcgtaacatatagnatcacactagccctagagtaaacaacacaanctactacctgaaatttaaatacccatcacaaacatacaaattttccaacatactaggatattatccctccatcatacaccgcctaccaacataccacaacctntctataagccaaaaatccgcatcatcattactagacttaatttgactagaaactattctaccaaaaataacctctttcatccaaataaaaatatcaatcatagtatcaaatcaaaaaggcctaatcaaactatactttctctccttcctaatcactattataatcagcataacactatttaattaccacgagtaatctctataataacaacaactccaataagcaatgatcaaccagtaacaataactaatcaagtaccataactatataaagcagcaatccccatagcttcctcactaaaaaaccctgaatcacccgtatcataaattactcgatccc

SEQ ID NO: 557728 - DNA, 226 bp, Homo sapiens
  misc_feature (160)..(160): n is a, c, g, or t
  misc_feature (204)..(204): n is a, c, g, or t
gaatctcaaaaatattttgctgagttaaacaagctttgcacaaagtagtatattatgtatgatcccatgtatagaaagatctagaataaggaaaaacaaattatgatagaaaagatgttgcttctggtgattgggtggagctctgatggactgggaaggnagcatgaggggagccttggtggggttggatggtaatttaaggtnccctgaccaggggtttggggtt

SEQ ID NO: 557729 - DNA, 345 bp, Homo sapiens
ggcatactgatagctccacaggtgtccttgactctggacatattggctgtgaccctgtaagatgtcactgacagtccgcattgagaaacaggggataaatcacttggtcagtctctctgtatgataggatcatgagtgtgatgctttggcaattcagatcagcattagactctgggactaaatgaacgaaatgattgtcaactcgagtatgcacctcgattaagtagttgctactatctaatgaacgcggcacgagttctgggaagattcagactcgtgtcacgtcgttcagagaatatgggggatgggcacaggatgaactgatatatttgggaagattgccgc

SEQ ID NO: 557730 - DNA, 870 bp, Homo sapiens
  misc_feature (642)..(642): n is a, c, g, or t
tccccaaaaaacttggggaaaagaagggaacttttttttggtctcaaaaaaaaaaaaggtgttctgtgtttaacccggactgtgtggctgctcacatgtgccgtgtatcccaggacgttggggaggaccgaggcaggttgtgtctcaccggtccagaagttgtggaccctttgtgcccactgtttgttaaccccctttttatattacaattaaaaatatcctctgggcgtggtggtagacaccctgttatcccattacttgggcaacacggggcgaaaaactcgtgaacggcgacaggaagatgttgctattgggccgaaaatgttgccatggtgatcaagtggtggaaaggaaaagaagtcctcttctaagagaaaaggatatcactaaaaaaacattttagtggggctgtcaagagaaagctttttccgtgagaaaataacggggtagagtatatactcatatagtttggaacgtgatcttgcaacgggacaaattggtcttaggacgtgattgtctacaaaaagtgtggttggggggagagataatttgcggcatacgtttcccctttcactaacacagagcggcacacgtggagatttccacaaccactttgtgtagcgtagtggtcccaagtgatcnttggaaaagcaaaccactgttctacaacttccttttgtcaagaaatagaaccgatagtttgttgagcccatattctttctttttacacaagtacgatgtaagcacacagggaaaaaggcgggttcacagcaggcaattaaaaaatgcatactccaggcttaatgctctggtaaacaaacccgcttccgctgtcctcagacccttaactgtacctcaagagacagaaat

SEQ ID NO: 557731 - DNA, 212 bp, Homo sapiens
  misc_feature (40)..(40): n is a, c, g, or t
  misc_feature (47)..(47): n is a, c, g, or t
  misc_feature (66)..(66): n is a, c, g, or t
  misc_feature (68)..(68): n is a, c, g, or t
  misc_feature (103)..(103): n is a, c, g, or t
aatatagtttgaagctgctattagacacgcgggaggagcnaccttcnaatgaatcttcaaattggnanatactgcttcaccacctgttggggataagttgcanatggaataatttagtatggtttgtagctattttgatgaccacctcgtctgggtacctccccctgtgtggtctctctgtggggtatcggacttcgattccgtattctggg

SEQ ID NO: 557732 - DNA, 166 bp, Homo sapiens
tcctcaccgtggatgccactgcaccctgcatgatggcagggaacctaccctttctccagaaccagtctcgtctaacctgctctccacccagggatgcagtagtgcaatgcagaaagcgcatgtcagagcagagccatctggggcaaccttctttcttcaaaactag

SEQ ID NO: 557733 - DNA, 215 bp, Homo sapiens
  misc_feature (142)..(142): n is a, c, g, or t
  misc_feature (168)..(168): n is a, c, g, or t
  misc_feature (185)..(185): n is a, c, g, or t
  misc_feature (193)..(193): n is a, c, g, or t
atctaaggatcccgtattacactaacgggcagatagttgaggtcatgagttcggacagcctgggaacatggtgaaaccccatctctcctaaaattacaaaaatcccggacatggtggcaggtgcctgtaatcccagctactntgggaggatgaggcaggataatcacnttgaacccgggaggcgngaggttgnccagtgagctgagaatcatgcc

SEQ ID NO: 557734 - DNA, 380 bp, Homo sapiens
ggaacgccaaggtaagctcctgagcgtcttcggggcctgatctcagcagctgtgatcacaagtcaaaacgaatcacataggttctctcgacaggtgcagagacagagtcttcccggatcggagtccagatcagaatagctcctctagcggaactgccttcgtggcccaacgcagagatcatagggctgctcttctgcttgccgcagcttgtggccagtctcaatggctgcaaatgcctcctcagcatagcgactagtgacgaaccggtagttgtccccttggactcggaagtggatggtgcactcctcaatctctccaaaagtggagaacctctgtgtcagctctgatcgagtcatgcggccaggtatctttccaatgaa

SEQ ID NO: 557735 - DNA, 3167 bp, Homo sapiens
  misc_feature (16)..(16): n is a, c, g, or t
agcgtggccgcctggngcccgcccgagctgccgccttgtcgagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctggaggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcactgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaaaaaaaaaaaa

SEQ ID NO: 557736 - DNA, 3167 bp, Homo sapiens; identical to SEQ ID NO: 557735
  misc_feature (16)..(16): n is a, c, g, or t

SEQ ID NO: 557737 - DNA, 705 bp, Homo sapiens
gcttggacattctagacttaaaaattaaccttgaaagcccagcatatctaatcatttctagcatgtggagaactgaagatgattcttttagccagaaatttcagttatctcagtgttatgcaagttccctatctgatcttcctcttttgcttgccttactcttgtgagacaactattaggtgtgttttaaatgggttgtcccaaaggagaagagactttcctgttctcagccctctcaagataagcagaactgagattaggaaaaaagcaactgagccagagccaattttcacaggaatttaaaaatatcagtgtgaaaacaaaatgagcagtgaagcctagctatttaaagggcatgcaaaagagaagttggaaaaggaacatgagctggcagctaactggacgagtgtggtgactaattagtttcctatgatgtaaacatatttggtattttatgtcatttattttaattttttttgaccatgactcgcaataagaaataaatattattggatgacccactgtccactttatataatactaaaatgaaaatactttcttccctttaccacctataccttctcttctgtttgtattttaaagtactggtagcaaacatcctgttaactgcatttcattatctactaatgggtcagaccaagatttaaaaaccacagtgccctgtgaacagtgagatttacatgg

SEQ ID NO: 557738 - DNA, 3095 bp, Homo sapiens
  misc_feature (16)..(16): n is a, c, g, or t
agcgtggccgcctggngcccgcccgagctgccgccttgtcgagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaagggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctggaggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcactgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaaaaaaaaaaaa

SEQ ID NO: 557739 - DNA, 3343 bp, Homo sapiens
cggaatgcggtcaccagctccggtaaccgttggttcctgggcattgccccggccaattcggctgcctccacgtttcccgaatcaactgccatcggaattccgctgcccccaaagctctggactggccatgaaggggccaagtgctttccgggctgcctgcttcgaggacaccagcactcctgccacgggccattcgtccatcgcatgccagtggccctccctcctcagggttcggcagtccactccaaggctctaagaagtgaagcaggcggcgagaatgtgcagtcgttgaggccagaggaccgggcctcagcttctccttaagcccctgagtcctcctctggggaccacccccttgtacctggaggtgaaaatgcccgcccaggagggaagggctggcccccggagagcccgctgcgaagtgagtttgcgcactgcggagcgggcgcgggtgactccagagcggccctgccagtccgcggggctggcggggagcaggttcgtgcaccgcgggctctgtgcatgcagaggcgggaagagcccccagcccggcagccggccccgcgggaaggcgcagcccgggcttccgaaccctgtgaacgcgcaggttcctggtcttccagatgggcaggaatcgtcctgcccgcccggggtgggaggccacatgggggcactgcgcccgggcgcggccccaggtgctttccaaatgcccactgccgctctcatccgtaccagcgatgatcaagaaggggcctggtcgcccggggaggtgccccggcccgaatcgactccggagacaacgccgggcgacgccacctgcgcaggtcccggaggccgctggtgtctgtgtacagggcgtgctgtctgtggaaacgcgagggcacactagcactttccagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctggaggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcactgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaaaaaaaaaaaa

SEQ ID NO: 557740 - DNA, 259 bp, Homo sapiens
aacagtgtttaatggacaagcatatgtttatctcagtgaatgttccatgtgcatttggaaaaaaagtattattgctgctgttggtgtaatgttttactacaatgtcaattgggtctatttgggttgatagtgttcatgtttttaaatatccttataaattttactgtctacttgttctattgctgagaggaggcctattgaagtctccaattataatttgggattactgttttacttttacagatgtttttcctttata

SEQ ID NO: 557741 - DNA, 2078 bp, Homo sapiens
  misc_feature (16)..(16): n is a, c, g, or t
agcgtggccgcctggngcccgcccgagctgccgccttgtcgagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggtttgtgaaaaaaaaaacacagtaactgggtattaaatatagtagtgatacatcgaagtattaaaaagagggggggggcttattaattggggggagatactacgcacttttttaaggggccaaggagtattaaaaggggggtaaaagggggaaagaatgttgttggaaccattttgtgttgcccccaaatgaggatattggtgagttggatgat

SEQ ID NO: 557742 - DNA, 318 bp, Homo sapiens
  misc_feature (318)..(318): n is a, c, g, or t
tagagcaccgcggtcatttctctgtagtaagcaaattagaaaccagctgcccatcttccataaacagtaagattaggcagatgatgaaactaacatggcaaatgtatgatgctaagccaacagtatacaaaagagatccctgtgagtactggagcagaggaccccatctttgggagtgtgccagtggggattccctagacagcacaggaaagtaaaggagaatcttagagtttccttgcaccgtataactcccaggcaccctagcccgatcgccgagaaggcaaccatggaagctgaattagcaaagaaggtcataan

SEQ ID NO: 557743 - DNA, 111 bp, Homo sapiens
atgctcgatcgttacagcaagcttgcggggtaacctgagccccccatctctccttcctcaaccactggacgtttatatattataggcaggtatgaaatgggcacctagtca

SEQ ID NO: 557744 - DNA, 1946 bp, Homo sapiens
  misc_feature (16)..(16): n is a, c, g, or t
  misc_feature (1846)..(1846): n is a, c, g, or t
agcgtggccgcctggngcccgcccgagctgccgccttgtcgagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctggtctggttttgctgagtgcgtctccgtggggctgttcagcatcttcctgtctcctgtgttccctgtaacctggcagtggggtctatctgtgtcatttaggaaaacaagctgtgtggcacatcctggcacatcctgctcttcagcccatgaaggaagctctcaaaacactgcggtggggtaaggtgttggcagtgtggattcaccgtcccagcaaggagctaccttagggtcaaggatgagttctganaaataggagaaaagaaagactcagtgaagaggagaatcaggtatggttacccagaggaagggcagaggatgctgaatcccagtagagtgatgcccgctcc

SEQ ID NO: 557745 - DNA, 1736 bp, Homo sapiens
  misc_feature (16)..(16): n is a, c, g, or t
  misc_feature (1599)..(1599): n is a, c, g, or t
  misc_feature (1620)..(1620): n is a, c, g, or t
  misc_feature (1665)..(1665): n is a, c, g, or t
  misc_feature (1725)..(1725): n is a, c, g, or t
agcgtggccgcctggngcccgcccgagctgccgccttgtcgagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaagggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctccccccncgcccaccccccccccccccncccccccccccgcagaccccccggcccaggcccccgacccccccnccccccccactacccccccccaccccactcccccccccccccaaaacaccaccaaccccnccccccccgag

SEQ ID NO: 557746 - DNA, 641 bp, Homo sapiens
  misc_feature (142)..(142): n is a, c, g, or t
  misc_feature (178)..(178): n is a, c, g, or t
  misc_feature (484)..(484): n is a, c, g, or t
  misc_feature (491)..(491): n is a, c, g, or t
  misc_feature (515)..(516): n is a, c, g, or t
  misc_feature (571)..(571): n is a, c, g, or t
gcggagacggtgatcgcacctggggccgcctaacagatggacccccgattgaagccgtggaacggctcacaccggcacgtgctgcacctgcccaccgtcttccatcacctgccacacctgctggccaaggagagcagtctgnagcccgcggtgcgcgtgggccaggccgcaccggagntgtcggtggttgatgggcatcccgaagcgtgcgtgcagcgagtgttgctacctcgctactctgtacttgatcagctctgtcatctcgctctatctccgatgcttgagtccacgcatggtagtaaggatggagctcggtcactcgtgggtgctgatcgtcgcgagacatgatctcacagtatcacttcggcatgtgacagagaacatcaaggccttgttccccacggagatccattctgggctcctggaggtcatctcaccctccccccacttctaccctgacttctcccgcctccgagagtccttnggggacnccaaggagagagtcaggtggaggnncaaacagaacctcgattactgcttcctcatatgtacgcgcagtcaaagcatctanacgtgcagctggagatgacatcgtggccaagcccaactacctgagcaccatgaagaactttgcactgcag

SEQ ID NO: 557747 - DNA, 179 bp, Homo sapiens
  misc_feature (145)..(145): n is a, c, g, or t
  misc_feature (155)..(155): n is a, c, g, or t
ctccattccattccattcctttctttccacaggatttcactctgtcacagaagctggagtgcagtatcacaatctcagctcacatttcttttcaccattccatagtattccattccatcccattccattccactctatttcattncactacactncactccactccattccgttccact

SEQ ID NO: 557748 - DNA, 289 bp, Homo sapiens
gatctagaggtccggtggaattcctatatatctagaaaggctaggtgggcaagtttcctcgggccttatgcaactacttgtggtggaaaagagataaggggacttaacaaactttccttggtcacacagaccatggggcaatatctcctagggtttatagtcagactagtcttaatggaagttttaataccggcttggtcattagcaatcggtgtaacctaagtaagacaattgactttggtgctccagttttcggatcggtaagataagcgcttccattagattattg

SEQ ID NO: 557749 - DNA, 214 bp, Homo sapiens
tgatagaacgtattgatgatcaatgagcatcaactgggccatttctgcctgacacggtgaacgatcatcaacctcctccacctccatcggttggtcttggagtctgggtttcctcacgcatcttggctaattgaccgcacagtaccatcggtacagccaaatcgttacgcttaatacactgtcccactcagataccgagtctcaaattcgttaa

SEQ ID NO: 557750 - DNA, 588 bp, Homo sapiens
  misc_feature (12)..(12): n is a, c, g, or t
  misc_feature (440)..(441): n is a, c, g, or t
  misc_feature (451)..(451): n is a, c, g, or t
  misc_feature (470)..(471): n is a, c, g, or t
  misc_feature (492)..(492): n is a, c, g, or t
  misc_feature (505)..(505): n is a, c, g, or t
  misc_feature (561)..(561): n is a, c, g, or t
  misc_feature (586)..(586): n is a, c, g, or t
acggatagcggntctgcacgtgtgtgcatgtccagacagcatatctgtgcacatgtgtgtgtccaggcaatatctgcacgtgtgtgagtgttgaggcagcattatctgtgtgtgtgtccaggcagcatatctgcgtgcgtgtgtgtgtccggacagcatatctgtgcatgcgtgtgtgtgtccggacagcatgtctgcgtgtgtgtgtgactagacagcatatctgcgtgtgtccaggcagcatatctgcgcctgtgcacgtgtgtctggaagtgtgtgtccaggcagcatatctgcatgtgtgtgcctgtccagacagcatatctgtgcacgcgtgtgtgtgtgtgtccaggcaatatccggcatgtgtgtgtcaaggcagcattatctgtgtgtcaggcagcatattggcacgtgtgtgtccggataccatattgcanntgtgtgcgtncaacagaatcctgtgtgtnntgtgtgtccagcagacattcnatggtgttcctgngtatgttaagcacatgtcttggatgtctggatgcttgtcgtgtgctgctttggcantatttggtccagcggatattgtctntc

SEQ ID NO: 557751 - DNA, 220 bp, Homo sapiens
gtcgacttttttttgaattttaaagatcagatttatttggagaaagcaaaaaacccccaacccaaagatgggattttacatctaagacatctccaagattacaatctacagattacaaatcccggattacaatctacagattacatcccactcctgaatacatgtaaaatgtatacaaaaatatcttctatgaaaatggtttgtaatctggtcgacgcgg

SEQ ID NO: 557752 - DNA, 338 bp, Homo sapiens
agtgatacctttacagtacagcagagggggacttatatggcagctccataatcacattgaatactacacaaccacccagtatcatgcccatagaaaaggagagggatctgggcgcccacacagaggtgaaatgatgcccaaggtcacatatctagaaaaaagaagagccagtataagagccgggtcatctcacccaaagcctgtggccataatcacctccagtcagaagattatctgccacccccagccctcctctcctcaccacccagttactcttcgctgcgtgtgggatcattcgcttggacagcctgaggagaggtgcactcttctagagtcga

SEQ ID NO: 557753 - DNA, 111 bp, Homo sapiens
cccccccccctggggggcttgggcaaaggttttttttggggaaggcttaatgtagaagacccggaggatctaaaaaatgaagaaatggatctcgaagagcaagagggctat

SEQ ID NO: 557754 - DNA, 1683 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacatttactgttagtttgttttgataaggaataaaggaatttctaacatga

SEQ ID NO: 557755 - DNA, 248 bp, Homo sapiens
aaagggagccaagacgaacgtggttgatccattttctaagaaagcattggtcatgcatgtgcacacagccacctgctcatgttccacatcatcacagcacacatcattggcacaagcacgctccgtcacccaggcacccaaggcaacccaacacattgccatctgcatggtctccaagggtcgtgatgtttgcacagtgcagtcttgctgcatttgccagcacatgcatgcacagttgccatttcagc

SEQ ID NO: 557756 - DNA, 903 bp, Homo sapiens
ggtacccgggacccggtgtctgctcctgtcgtcttcctggctcctgaatccctagtccactatagcgggtgaggtgcatctccatccacgtaggccaggctggtgtccagattggacaagtgcctcgtgcctagggagctctagtgcctggaacacggtatccatgccgatggggtcaggatggccgagatgtggatcgaaaggaccatggggggagtgatgatgactccctttcggaaactagcctgtcttcaggtgaagataggggcgtctggacaaagacgacgtgggccgcggggctagttgttcgttaggactatggaaactcgcacaggatacatatgatgtaaggttactgtcagctggacttagcataccgcacagacatctatccagcgccgtgagcagcctcatcataggcagagggaagatgctgcccaaataactatgcccggatggtgcaactacaccattgcgccaggagatcattgaccttgatgtttggaggaccgaattcagcgagctggctgaacagtgctaccggtcgttcagggcttcttggttacaccacagctaaggtagggggaactggttctgggtacacctccgctgcttcatggaacgtctctcagggagtatggcgatgaaaatccaagctggagtggctccatttagccggcaccccgaggtgatacaccaggctgtagttgagcccctagcaaatccggtccatcaacgacaccagagcaaactctggagcactctgattggtgccttcatggtagaacaatgaggccatctatgacatctgtcgagaaacctcgaatatcgagcgccccacctacataacttaaccggcttatagcaagatggtgtcctccatcatggtccctgaattgtggg

SEQ ID NO: 557757 - DNA, 1639 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 557758 - DNA, 170 bp, Homo sapiens
actgtggaacaaggctaatgtggactcaatgcggacatcccacgttgtggcttctcaaagtgctagaaattatatggcatgagccacgtgcccccagacacaagcgtgacttcttgaagctcttaactaacattaggcaccctcaaaaccattccttctcccgcttgagt

SEQ ID NO: 557759 - DNA, 1630 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacatttactgttagtttgttttgataaggaataaaggaatttctaacatga

SEQ ID NO: 557760 - DNA, 1078 bp, Homo sapiens
  misc_feature (920)..(920): n is a, c, g, or t
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaggcaggaccctatactggggtccctcanacggggccgcttaacgcgggcacaaaaggggaggggcggaaatccgcccgacacggcggccagacccgcgcacaccccgggggcgcacgggacacaccgaaagagcacggcgaggaggggacacaaacacacaaaataaacgaaggggccggcatcag

SEQ ID NO: 557761 - DNA, 444 bp, Homo sapiens
tcactccaacgggtgacctccactgggcagcctgcctcaggaatgcctctcctctcatccttcttcaggcacagaggcccgccctccatacaacttccagaaagacagctctgcacacctaaagaacctccacagacccctgcatcaggacaacagcctctcctggcactcaggaccagcctcctcctagctgcctgcaaattgtcacagaacacacctgtcggctctgaccccatgccttcactcttgctgtcctctctgctcagagcaccctcccaccacccctgcctgccagtgccagccacgcacgttggatgacagctgaccccctctgcaaccaaaaccttccaaaccatggccaagcagatggctcccttctctctcccatcccccatgactgtaaggacctcaaatacacagattgatcaagtgtaaaaaaaaaaa

SEQ ID NO: 557762 - DNA, 444 bp, Homo sapiens
  misc_feature (4)..(4): n is a, c, g, or t
cccnggtcaaggactcatagcataagaaaccaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacatttactgttagtttgttttgataaggaataaaggaatttctaacatga

SEQ ID NO: 557763 - DNA, 400 bp, Homo sapiens
  misc_feature (4)..(4): n is a, c, g, or t
cccnggtcaaggactcatagcataagaaaccaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 557764 - DNA, 1031 bp, Homo sapiens
  misc_feature (466)..(466): n is a, c, g, or t
  misc_feature (484)..(484): n is a, c, g, or t
  misc_feature (507)..(507): n is a, c, g, or t
  misc_feature (514)..(514): n is a, c, g, or t
  misc_feature (520)..(520): n is a, c, g, or t
  misc_feature (522)..(522): n is a, c, g, or t
  misc_feature (524)..(524): n is a, c, g, or t
  misc_feature (530)..(530): n is a, c, g, or t
  misc_feature (547)..(547): n is a, c, g, or t
  misc_feature (668)..(668): n is a, c, g, or t
  misc_feature (854)..(854): n is a, c, g, or t
  misc_feature (864)..(864): n is a, c, g, or t
  misc_feature (885)..(885): n is a, c, g, or t
  misc_feature (894)..(894): n is a, c, g, or t
  misc_feature (898)..(898): n is a, c, g, or t
cacgcgtctgccacgcgtcgctgcttctcccttgaaatccttgctggtgtccaccaggatttcctgtgaggtgccgggaatgagcaaggatggtctgcaccagctgacggaaagcagcttctgtacacagatgggagggtgaagggggagaatgaaaatcgaagcaaacttttattctgttgggaatcagaaggaggcagagaagcaggcagtgctcatgtgatgaagagggtagccctttcaggagtgagcagagctgagggttttggtaggagttgggctctggtggtgttaaggactattggtctttggggtttgaagagcctcataggcgagagtctcctggtaaggtgtctatgcgtggggagaacactattgtgggttggaatactcgcggagagagtatgttcctcatactctataacgtgaaagtgtgctctccactgcgagggtgccactctaaggnggatagacagggaccccntctactgaaccttgaggaaaggnggaaggnagaaangngnttagancttggatgcagaccttncaaagggttaaatgtaaccatatggatcaaccacatgcacatccttactacagaatccgtcctttcatttcaacttatagcaagctatgatttttatatataaatattatataaataatgnataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagcccttgttttataatganatacctgccnctagagaaactgtataaaccnttaaattgncagnatttttgtaaggttcccttttgtaaagagaataatattcaaagccttttgtagcatccaaagtgaaaacttgtatctgcgaaactatacttgtattaaatgtgctttttaaataaaagctcgtacccccccta

SEQ ID NO: 557765 - DNA, 484 bp, Homo sapiens
  misc_feature (14)..(14): n is a, c, g, or t
aaccgacgtcgtanagaataattgtaatcactagtactatttgtactgtatttttaacacatcattaattatcatatctctatgttcaatatttttaaaagctacataaataacaatgtattgtattcttggaaactgataagagacattttaggtgttcttaccacaaaaacaaaagataaatatgtgggccctgcgtggtggctcacacctgtaattccagtactttgggaggccaagatgggtagatcacgaggtcaggagatcaagaccatcctggccaacatggtgaaaccctgtctccactaaaaatacaaaaattagctgggtgtggtggtgcgtgcctgtaatcccagctactcaggaggccgaggcgggagagagactcgcttgaaccagggagtcagaggttccagtgagccaagatcgcgccactccactccagcctggcgacagagctgagactctcctcaccagacaaccc

SEQ ID NO: 557766 - DNA, 1940 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacatttactgttagtttgttttgataaggaataaaggaatttctaacatgaaaaaaaaaaaataaaaaaaaacttgagatgcagtggcaggagcctcgggaataacttgcctgccccgccaagcagcaaagtgtctcctctagtgtttctaactcatggactgcacccatttctgcctgccccacaagctctaggcttgacagttcaaggtacgatcctcttcctttcttcttccttcttcctcctaggcaagaagcttgcaaaattctgggcctaagcaagtggcttcttcctgggacccaacagga

SEQ ID NO: 557767 - DNA, 1031 bp, Homo sapiens
  misc_feature (466)..(466): n is a, c, g, or t
  misc_feature (484)..(484): n is a, c, g, or t
  misc_feature (507)..(507): n is a, c, g, or t
  misc_feature (514)..(514): n is a, c, g, or t
  misc_feature (520)..(520): n is a, c, g, or t
  misc_feature (522)..(522): n is a, c, g, or t
  misc_feature (524)..(524): n is a, c, g, or t
  misc_feature (530)..(530): n is a, c, g, or t
  misc_feature (547)..(547): n is a, c, g, or t
  misc_feature (606)..(606): n is a, c, g, or t
  misc_feature (614)..(614): n is a, c, g, or t
  misc_feature (619)..(620): n is a, c, g, or t
  misc_feature (624)..(628): n is a, c, g, or t
  misc_feature (630)..(631): n is a, c, g, or t
  misc_feature (635)..(637): n is a, c, g, or t
  misc_feature (639)..(640): n is a, c, g, or t
  misc_feature (642)..(642): n is a, c, g, or t
  misc_feature (644)..(644): n is a, c, g, or t
  misc_feature (648)..(653): n is a, c, g, or t
  misc_feature (655)..(655): n is a, c, g, or t
  misc_feature (660)..(660): n is a, c, g, or t
  misc_feature (668)..(668): n is a, c, g, or t
  misc_feature (854)..(854): n is a, c, g, or t
  misc_feature (864)..(864): n is a, c, g, or t
  misc_feature (885)..(885): n is a, c, g, or t
  misc_feature (894)..(894): n is a, c, g, or t
  misc_feature (898)..(898): n is a, c, g, or t
cacgcgtctgccacgcgtcgctgcttctcccttgaaatccttgctggtgtccaccaggatttcctgtgaggtgccgggaatgagcaaggatggtctgcaccagctgacggaaagcagcttctgtacacagatgggagggtgaagggggagaatgaaaatcgaagcaaacttttattctgttgggaatcagaaggaggcagagaagcaggcagtgctcatgtgatgaagagggtagccctttcaggagtgagcagagctgagggttttggtaggagttgggctctggtggtgttaaggactattggtctttggggtttgaagagcctcataggcgagagtctcctggtaaggtgtctatgcgtggggagaacactattgtgggttggaatactcgcggagagagtatgttcctcatactctataacgtgaaagtgtgctctccactgcgagggtgccactctaaggnggatagacagggaccccntctactgaaccttgaggaaaggnggaaggnagaaangngnttagancttggatgcagaccttncaaagggttaaatgtaaccatagggcccccccccccgcccccccccccccccgaccccnccctcccntcccnncccnnnnnannccannncnntnanacannnnnntnacacnaataatgnataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagcccttgttttataatganatacctgccnctagagaaactgtataaaccnttaaattgncagnatttttgtaaggttcccttttgtaaagagaataatattcaaagccttttgtagcatccaaagtgaaaacttgtatctgcgaaactatacttgtattaaatgtgctttttaaataaaagctcgtacccccccta

SEQ ID NO: 557768 - DNA, 481 bp, Homo sapiens
acgttagacgactaacaatacaaaactagggggacgcagagcgatgtgcctgtaacacaacgactcgggaggctgaagcaggagaatcgctgagcccgggagtgcacaggttgcagtgagcgaagatcgtgctagtgcactcgagcctgggtgcagagactttcgtctcaaaaatataataatccagtgtgtattttatacttaagtacatctcaattgagactggccacatttcaaaagtgcattagccacatgagggcagtggttgccatattgaacagtatacttcaaagagtccttttggatcttctagtgaagataatcatatggactgagaataataattgttcctttttcactccttatacttttccctccccctgacttttcttgatacacttgcctggcaaggcccttagtgaaaaatcgaatggaagcagtgatactgtcatcttagtctttttccagacaaagggaaaca

SEQ ID NO: 557769 - DNA, 2007 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacatttaaaaaaaaaaaaaaaaaaaaaaaaaggggggggggtaaaaatttccctcggggggcccaagtttagggttacccgtttttttgtcaagggggccctatagggaggtcggaattattaaggctaggacgtgggccggccgtttaacaacccgtcgctgagtgggagaaacctgctagcctggggactctgcggggagaggagaccctttaccttgttggggctgggccttatgtgtggcaaattacctacagaagattaaaaggctccaagggtaaactataacatttttcacgttgtttcctgtgtaaacctacgctgaattatgtggccgtgaaatttcgtacagagtatattttgactatttttcgg

SEQ ID NO: 557770 - DNA, 114 bp, Homo sapiens
  misc_feature (96)..(96): n is a, c, g, or t
tgaaccaaacaatctcttttcaaaacagggtgcttctccatttcttcttatggaagccagaagccaggagaaaaaaatatatatatatatattgtnaaagatcaatccatctcc

SEQ ID NO: 557771 - DNA, 1935 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtatttcaaagaaactggttctagaatacagtcaagctatagtaaacatcatgtacctgaatacgtacaggataaagagattgaaagctaggagtggccaaacgacttcaactttaaacttgtaagtttggcatttctcttcaggcagatatttttaaaagcaaatccagaaagcggttccccataattagcattccttacattttcttcttcctggtcagccacacctctgtgcccaaggtggtagtgcccagctggcatttgcactctctcagttgagccttccttctcctagggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 557772 - DNA, 116 bp, Homo sapiens
tacatagatatacatgtgctgcgtgggggacgtagtaccctagtctaccagcctgtgggaccacagccgaatccttccactaatctgtacctaggaacgaggcggtgatccctcca

SEQ ID NO: 557773 - DNA, 1760 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtatttcaaagaaactggttctagaatacagtcaagctatagtaaacatcatgtacctgaatacgtacaggataaagagattgaaagctaggagtggccaaacgacttcaactttaaacttgtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 557774 - DNA, 716 bp, Homo sapiens
gactgtccctcccagtagcctgaggactccaaagtccaagctctggtttttgaagcctcgtatagagaagtgagtgactttgacgtgggtgccagggaaagaaagacacaagccaaacccattcccgaacatcagactcagggtttctccagtcccttctccctctgggtcttgcccctctgtccttggacacttccacaccacacctcatccacccacacacaatactcagggctggctggtcaaggtatgctgtattgaaggagggtattattgacatagctatgaccaataatgaagccatgctgaggggtggctcagagcagagtccaacccctattgatcaaccatgggcaaagaatatcccatgtgaggttacaggcaattccatgtgaccatgttgtccctcctgattcagggcccattccttaggagggagaactgaaaaccaggcctaaaccattagagacaatgtcccccaacccccagccacttctacaacctttgcttaagcctgtggaccagagccagtgctgctggaagaggcaagatgcttctggacagcaagactagggcacaactctccctcccttagctagctgcagactcagcaaataaagcccttgcaccaggaaaaaaaaagaaagaaaaaatatacaaaatagactctagactagctacaaagcaccaaacaaagcaaaacgaaaaaaacaagg

SEQ ID NO: 557775 - DNA, 771 bp, Homo sapiens
  misc_feature (397)..(397): n is a, c, g, or t
  misc_feature (649)..(649): n is a, c, g, or t
  misc_feature (678)..(678): n is a, c, g, or t
atagaatgtgggaaatgtaccacttttgaaggcgtagactatgaaattacaaatgctgcaaaattttcttcccaatacttacgtggcattttataaatttccaccaataaacgtgtattatttttattgaaaaagcatatttttaacatgcccttctagatgccctcctagccagactgaatcacctcccatttgatttttcttaattttctacctttaggtgctggctcattcattaacatcaatttccattcataagtgctcacaaacccacttttcctcttgcctgagtgcctcacataccctactgcctgagatggttccagaggcggtctcctctctcccttagaaacaccaggcacacacctgcccccagtctcgcctgcactctcctttnctcccgcagagaggcattcctttctcctcctctcatcctacacacactataagagacaactgaaatctggcctccctcagacagcttcttaattcatttgtgctcaaagccctggtttgagctcacacaacatctagagggttgtacaaaatataaaaaattattatcccctgccctgaatattttggtgtgggatgtggggtattttcccctccataaaattggggccttggggagggctgggacctcgtntcctaggttaatggagtataataacctanaataaaatttcccttttcccttttgaactaactttccacttctttggaggcacaattttttccaggaacactcttttcgcttcttttgtgggg

SEQ ID NO: 557776 - DNA, 292 bp, Homo sapiens
gggcttctccgtgatggagacggcgtccagcctcttcggcttgatgctctgcggctagatgctctgtcgaccttgcgtcatgggctcattctctgaagttgttgaaggacagcacgatgcatacgtcggcgccgcgcaccagctggatggctttctgcaggtcgtccttgttcttcccggacacgcggacctgcgcctcctggatgctcgcctgcaccttgatcttcgagtccttgatcatctggatgatcttcttcgccggctcctgggagatgcctcccttgaccttcag

SEQ ID NO: 557777 - DNA, 426 bp, Homo sapiens
tcgtgagtatcagggatattccccgaggcgtctgatgctgggaagcgatgcgccctatctgctaccacgcaccctgtgccccaagccgaagaatggtcgcaatgaaccggttacctgcccgaagtactgcgcgaagtgtccttgcaccgtaacgaaacaatggaagacctggcgctgcacagaaccgtgtgcgcccggcgctttttcggcttgcctgccatcgattgctgcggcgcattgccccatatcaaacgcgctgttctgactatcgggcacaataatggcaccttgccaatatccgtttccgctatcagagaaaaccttccatgcttgcctggctcatgactatctcgctcaaactacccaatttctgggccgtcaatggcggactgccttcatcaccatcctgatgctggtgctagtacg

SEQ ID NO: 557778 - DNA, 161 bp, Homo sapiens
tcgcggaacgtgtaatcctcaaataatgggtgggctcaggtacactggttactacaccaccttaacgtttaacgaaacgtgcttcttgacgtttgaccactaccaccactactgacgacacgacaacgtacacctctgtgaacacgacttgacttttacta

SEQ ID NO: 557779 - DNA, 223 bp, Homo sapiens
tgaacattcgtgtctctcacataccacacacctacacagccatgtgtgcacatgacacagggtcacagtctcacaagccacactccaaatgccacactctcaccacacatccacacacattcttatttgtttcaaacgaaacctggattaagtcactcggtttcactttccagctttcctcattggccgtcatgccttggatcattaaggacacgaatgttca

SEQ ID NO: 557780 - DNA, 808 bp, Homo sapiens
acggggctgggcggacggggagctgcgtagctcccggcgcccgcggccgatgcccaagcggatgctgccccttcgcgtacgtgttcccggtactgctcaaggtccgcgtgagcgcacagggagttgagccgcgacgtgtgcgccgaggcgctactcggcaggaggtctccgagaagaccaagccgactccatgttcctcggggtgccaggtctaggctggaccacgtgtgggatgacgtgctgtgctgtcgtccacctggccagagtccccgaaagcctggccctacaggggcccccgagggggtgcccgtgggcagatgctgattggaaccacagcggccgactgatcaggagcctgtgggcaggcctccgaagctgacccatctgggggtacgcgtccgatggtcctgttcctctagtgcgtgcgattcctggggtatgggacacggcggactgcggtccagggctggagcgagccctgtggcgggcagtggtgtgcgcacctgtctggggctgctggctccggtgtgctgttccctgtgttggtctcgtgggatcggcttgagcatgtgcgatgaacagtgtctgtgcaccagtgtgtgccattgttctggagacctggaggctggactcatggaccgtgtgtcctttcaccggtgagccacgccgtgcgtgggagcctgtccctgacgatcgctcggtgttcacgctcgaagtgtgggcgtcgactgtggggttgccttttaggtgtccttttttggtgtctattgaggtatgaatgaccctggtaatatttcggcatattgca

SEQ ID NO: 557781 - DNA, 158 bp, Homo sapiens
ctagagttccccttacgctatccacccatattcaggcttccagggagtaagacaccaacctataaaatactgcttttagtgcctctggggaatggaggaagccaggcagaactaggtagggatcctcactactactaataatgctccaaacagagggt

SEQ ID NO: 557782 - DNA, 224 bp, Homo sapiens
ttcttacaagttccaggcttaaacaaaggcacaaattacatgcaacaacgtgatacactcataagtgtgcacatatgctccaaggctctttattagactaacaactaaatgctagcactttgtcacgtgccatcagattttcttatagtcttagagtcatgctaataaaagttcataatgaaattcacagaaccacttacattttcccaatcttagatcagtac

SEQ ID NO: 557783 - DNA, 247 bp, Homo sapiens
  misc_feature (50)..(50): n is a, c, g, or t
  misc_feature (212)..(212): n is a, c, g, or t
cccctttccctctacccactgacaggccccagtgtgtggtgttcccctcnctgtgtccatgtgttctcatttttcaactcccacttatgaatgagaacatgtggtgtttggtgttctgttcctgtattagtttgctgaggatgatggtttccagcttcatccatgtccctgcaaaggaaccagactttttagagaaatagctgattactagncctgggcagggaaaattcaagatgtagttggaaca

SEQ ID NO: 557784 - DNA, 166 bp, Homo sapiens
  misc_feature (5)..(5): n is a, c, g, or t
cgtgntaccagagacttacttcaccttttatttattgagattttgaaaggatatatgtgactctacattctgcttccatgttggtgtgcattgttaccctttccggaaataatccttcacgtcctcgggaacatgtgcaaaacgtgcaggtttgtaacatattacg

SEQ ID NO: 557785 - DNA, 720 bp, Homo sapiens
  misc_feature (678)..(678): n is a, c, g, or t
cccgcccccccccaaaaaaaaagtcttaaaatttttccccaaaccaaaaggtctcactacgcggctgggccttggaggaaaaaaacaaaaaaaaaagcgttttcccaccaaagtttaccctcccagagtgtggtttctctttccccttgccgggttccaggaaataccgcgggttaaaaacccccttcaggaggggggggggaaaaataattctttcgtgtttaaagaatttgggggggggggccaacaaaccgccctttacctaaggggggtgtataagaaccccccctttttgtgcaaaaaagggaccccaaaacctctccgggggggggaggcaaaacccgggtgttgtccccaaaaaggccacaaacggggcaattgtggccaaaattgttcttgggtggtttttgaagaaaataaaggcccttgggggttcagttccctttatccagaaggatccttggcccatgccgaggcttggtatttcccccccccaggttcggtagttgagtaaccttcccaaccctcccttaagccactccaggctggtatggagtaacctgggtgatccatcctgagtcctccataagttccggcaaatcgtcctgtggcactgagcagtataaatagcccatgccaatatacgatctccagatctggttttgcttgaaatggcantgcagagttgcaaggatttcattttcacaaacacggtcttcc

SEQ ID NO: 557786 - DNA, 143 bp, Homo sapiens
  misc_feature (17)..(17): n is a, c, g, or t
  misc_feature (61)..(61): n is a, c, g, or t
aggcatccggagctttngaggggagtctggcagcccggctggcccaggcctgcagcggcancgtttccacagggcgcaggcggccttttcgaggccttttctggggggtctgagggagacctggttgggaattggggctccag

SEQ ID NO: 557787 - DNA, 123 bp, Homo sapiens
gtttctgttttgcctgaataaaatgaatttaaacaagagaatttccacagaaagctttgcggcccgtcaagaatgttcctggcagttttgaacttgaaccaccacgtccccatgtttgaccaa

SEQ ID NO: 557788 - DNA, 104 bp, Homo sapiens
atatataccctgtgtatctatacttggaagtgttcaaggttgccattggttgaaaacactagtgtctctggccatcaaagtgatcttgcttagtcgcgtgctgt

SEQ ID NO: 557789 - DNA, 619 bp, Homo sapiens
  misc_feature (619)..(619): n is a, c, g, or t
tggaaactttaaaacccctcaaaaactgtttattatacaagtgagtttggagtcacgatgggcttatacggaaggattcctggtagcgagcgcgggccccaggcctccaaacttttgggactcgcagcgacgagggtcagctaccagcaggtccggtcatacttggatgaggatgtcttggatctccttctgggaagcctcatccacatattcctgggtaataggccaccagggcttgggagatggactggacggatagcataaatctggggccactgtgacccaccaccctttaccagggacacgggtattgttctaccaccagcaatatcgctcccttgccggagaagcaaaactgggctcccagcagcttggtactgtgtagcggtggcggcggctcaatcattctccaggggggcccgcccgttcaccctttgattgaggcaccattggcccgcgttttggcagtggccgcccacaggttgtgtcgctgtactatctaggcggtccagaaagacctgtgcgacagactggcgaggggggccctttggaccggaattgggctccccagagcggtgggactaaaaacaacctcacaatttgtttggggggccgccan

SEQ ID NO: 557790 - DNA, 673 bp, Homo sapiens
agaatcatgcaggtggaggctggtggttatcggccgaggtaacttgaaggtgccttggggcagacactaccgaagatggggatgagaagagcctggagaaacagaagcacagtgccaccactgtgttcggagcaaacaccgcccattgtttgcctgcaatttgacagagtctacatctaccatctgcgctgctatgtctatcaatgccagaaacctcttggctttagataaggatagctcttacagatccatatgctcatagtcgtgttaccatccatgctggagcaaaaccgacgtgagcatcataccattcatacccatgaatcccacgttgggcaccaagagcaattatagttcagatgaaagttgaacatcctagtggggaaccccagatacagtgctacagatatccactccaaagttatcatgggaagcttcttgacaagtgaccaacgtgggcagaagatgactttataaggacgaagcattgttctctcctgtggtgaaactgaagctcagaaatggacatcacacccaagacttctctggcacccagtaatgaatggagacaagcctgcggggatgtacttgtaactgcagagctgattctgaggggcaaggatggctccaaacttcccattcttccccctcagagggcgccaaatctatacaa

SEQ ID NO: 557791 - DNA, 616 bp, Homo sapiens
  misc_feature (612)..(612): n is a, c, g, or t
gggtgactctagaggaccccgtcggagcaagcggggaattaatgtaaaataaatacaaaatacagggtggtgggttaaatggaacactcaaggaagcatctcttcggaggtattcctttcagtcgggtttaatcccagatctttttacttcccctaggaatagtctataaaaccacacaagggatcggtgaactggtagatcaagtgcacggtaaatctgtgaactggtggtttaaattacataagacatatttttggatctcatcatacaacaccaatacaaaagcaccgcccaggcctctcagcacatgggaccaggcaccttggaagaaggcctgggctccttcgtctttggcaatcttcctccagcagtcaacggtcccggggtacataatatcgggccctttcgggcgggacggcatcatcattctacgaggaacagggtcaaaggggtaggacaccagcccggcgacggccgtcacactcggggcaatcatccagctcacaaaaaggtgcacgttcttggggtcaggcagcatccccttggcagtatcatagactccgaagtaggcagctctatagataatgatgccttggacagagacgttgaanacct

SEQ ID NO: 557792 - DNA, 934 bp, Homo sapiens
ggccaaaagctctgcagtccccggcagtgagctatggactttcttccccctcacaaggctgggggcctcctgctctcgtccctgtgccctccctgcacagggcaaagccagtctgggctctggcacacagagttcatgtttgctgccctcgtccactgcccctcaccccagatggggtgacgtgaggaattgaagcggtgcattggtggttaggccgagtatgagctgtcttgaacatgctggagggaatgatgcagggtgtggtgaacgcaggtcctagtgcaagaataagagctcccatggctcttcgtgtcgcgccgacgtctagtcgccttcacctagaactactagattctctagtagcaagacatttatatcattgacactagagaaagctttacggttgataaccctcatgaactcctaaggtagcggaaacaggcacccaagacttcaaggaccatccggagcgaagaggacaggtacaaccacactcacacccttcaggcgataagcacgcaatgagacatcccagagatcgaacaaaacacccaggacagcgtatccgaagagccaatacagaagcctacacacgacacagcatagacagagatatcacaccaagagaaaaagccacatagggagccatcacgcagcgggtcggagcaacgaactagggctcgcgcacccgtaagcgcacgcaacccgaactccacatggcgacccaccactaccacccaagccataggcacccatccccaaaagagccccaagccaggaaacacaattgaggggagaaaattcaccaaggagcgaacttaacaggcccaaagacgcgaagcccaagagaggacaagaaaacggccaagggaggcacaccttatgcccggagcccatccccacattaggggaactaggagggggtacacgagga

SEQ ID NO: 557793 - DNA, 594 bp, Homo sapiens
gcagtggcatgatcacagctcactgcagcctcagcctccctggggtcgaggtgatcctcttacctcagcctcaggagtggctgagactgcagacgcacaccaccatgcctgacttttgtgtgttttgtagagacggggttttgccatgttgcccaggattgtcttgagctcctgggctctaacaatctgcccaccttggcctccccaactgctggggattacaggtgtgagccatcgcgcctgggtgaaacattatttttaaaacttccttggctgggcacagtggctcacacttgtaatcctagcactttgggaggctggggcaggtggatcacctgaggtcaggagttcgagaccagcctggccaacatggtgaaaacccatctctactaaaaacacaaaaatcagatgtagtgttgcgtgcctgtagtcccagctactcgggaggctgagacatgagaatcacttgaacctgggaggcggaggttgcagtgagccaagatcgtgccactgcagcctgggtggtggagcgagactgtctcaaaaaaaaaaaacccaaaaaaccccccaaaaaaaacaaaaaccaaaaaacca

SEQ ID NO: 557794 - DNA, 771 bp, Homo sapiens
ggtctttatatcgctgcgtggcgatccctgacgcatcgacgtgatgcccaggaagacaggtcgacctggaactccagactcacttccttagatcatcagtccagacttatgtggactgattatccgagatactgtttcattcgtggcgcattgcaggacaatgtgggtgctcccaagccacgcatgcatggcatcgcgctatgatccgcttctgctggagggagaggcctgttgtgggtgcctagtattggtgcaatagaacaacacatgatttgccgcgaaggatcattccgaagggcaacctgttacaccacacacatgccactacctcgtggaagaatacgtgtctgtcctcatataccgggggatatcggtcgggctattgtgtggcaagcacgtgatgactctcaccgttgaaatctagggaccgatgttgcttggaacgaataatggtggccacgtcttgctagcaccggtaggctctgtggttgcctaatcttgcaccacccactcgttagaaggatcaccctaggtggcctaggccccgacgatatcaacattgggtcgtacggggccacgaggaaacgactcgtcccgtgtttttgccatggcatttaaaccgtagtcgacaccacctagaagagtctcccaattggggggcaacccctagtttggaaacattctcatttgaagtcgatggttgcgagggcatgaggtcaacacgaacgttggagggaccagaaaatgctcgggggagcccacgcttgaaat

SEQ ID NO: 557795 - DNA, 382 bp, Homo sapiens
tatcgccggtacccccactgatagcacagtgggtgaagatagccagtctgagcccaggtcagcacttgtacttgggtctggtgccttttctctggtcctcagtttactcttctgtccagcagggatagtagcagcatcttgcagggttctcatgagtcttatgtgggtgaacatcaaagcaactggtgcccaacctccagggagtgctcaatatcattgactgtcaccaccaccaccaccattattattacccttccagggtagccgtgagggaggctgatctcagggaatggctgggggtgacatcatagctgtcatagtcctgcagaggggagctcatagcatcatggtggcccctgtgtatagaggcacagattgcagt

SEQ ID NO: 557796 - DNA, 269 bp, Homo sapiens
gtagctccaagagctctcactgtgacagcccacctcgctcgcagacaccacaagataccaacagagcttctgaaacagatacccatagcattggagagaaaaacagctcacagtctgagggagatgatattgaaagagggaaagaagttgaaagcatcttgaagaaaactcagattggatatgggtttgtcaagtcggccggaaatattcccccaggagtcctctttaacacccgagcgacggcacctcagctgaggcagagctcatga

SEQ ID NO: 557797 - DNA, 502 bp, Homo sapiens
agtatgttgttaatttcacctatttgtctttataatatggcttttagaacatttaaaattatatagctcatggttgttgcttgccctgtatttctattaaataatgctattctataccttcacatttactgattactaaattattactatttaaattattttaaattaccggcataccttgttttattgcactttgctttattgtgcttcacagagactgtgtttttttcaaattaaaggtttgtggcaaccttgtgttgggaaagtctattgataccattttcccaataacgtgctcacttttggtctctatgtcatattttggtaattctcacaatatttcaaaccttttcattattatattcattatggttggtctgtgaccagtggtctttgtgatctttgatgttactattgtaactgattgggggtatcatgaaccactcccatataagatggcaaacttaatcaataaatgttttgtgtgttcaaaaaaaaaaaa

SEQ ID NO: 557798 - DNA, 1038 bp, Homo sapiens
ggtccgcgggagccgtcgccgccgccgtcgcggtcccagctgccagccccgacgcggccccgccgacggacaggatgctggaggaagcgggcgaggtgctggagaacatgctgaaggcgtcttgtctgcctctcggacttacatcgtacgttcctgcccgctgtgactgctgctggtgtgcgccggaccgatgacatgccgacgacgaccgcgcacgagttcaccgtgataccagcatgacagcagtacgacacgtgacagggccagcacctaacggcaacacggaaatgccagtgctgaacaccaggacggggcgcacagatggccggcggacggtgctgatgccgccgcatgcggttgatgcattgcgggctacatggactttctacctacagagccagtacccacgaatggcgccttgcagggaagtcggagacaggcgcagcaccagatggtcaaaatcgagttcgcattgccacaggggcccaaactgggcccggcccgggttgtcccccccaaggaggaccaggtcaggtacccgggcaccaattccacattgggacagaactccgcaaggcacaggcaggaaattgcgttgggacacaattgagaaggaacaccaggcccggtacaaccacagatagatacctctgtggccccgagatgcgaagggacacggaacggggccaccttggcatgtacctaatacagtaaccagacaagaccaatgcaacccaccacagggacttgcgcacttcacgggcccatccgcacaaagaaaggacatcccccggccacatcctttgtacaccggcattggaaaaggataaccattgacatttggcccgcctaacaaggcgacccacaacgcttgcaccaaacccacggcacagtttccccagaaatagaggtcaccagccacatgacccgaggagcggatttcccaaagcacctaaaggggcccggatcaagcgtgaccctaggccctcggcaatattgccacaccggcgatccgaaaacgagcagcgcaggctatga

SEQ ID NO: 557799 - DNA, 1027 bp, Homo sapiens
aggacgaggagccggaagccggacaggagtgaggagaaggccaatgcgtgaagcgggaggagaggcggataacggcaggaggaacggagagcagagatgaagacaatgacatgatgaaagtcagaaaaaatatagtggccctgtttaaagaagaaaagccggtatgctagattgtgaaatacaatctaaagcgctccattcaacatcgagatcccgacgcgttcctgatgaggtgcacgcgtccgcagcccagcccatgccgggcagaccacgtgcgctattgtgctggtctcctgaccttggccagtgaacctgccagccttccaggacaggctggcctggagagctgcccctgaacggacagtcctctcgtctttgcagactggtgcaccttctattccctgttcatctctgtttctagatttagtcaacgtatgaccatacagcaacactcttcgcgggtcatcagggcatttacctcatactacttctcagctttgcttgcaaacgcctaactgcacacgaagccgtctgcacggcacccagccgctgtgagactagctacattctcccagtgtcagaaccactgcgtttctctctgtcccactaacaagcttcaacacgctaaccacatggcaagtcgggatttgacttcctgccactgacggcagaactggaccagaccctcactcattcccccactaacacccacggcacagcgtattgtgtgcgcatcttgcactcttccacacctgatggactcacaccggcttacatgcctgcacgaacaccgctgcgacgtcccataactatcaagacatgtcaactggaactaaccggtcctttaatacggctcgccttaagtcctcccaagtggctacatttcaagctcatcgccatttggtaggcaaacgtgtctcaaaacacccttctcagtatcacacgccactttaaattggtagatactagccactcgccggcccctcacacgcgcaatactctacccacagaacacacgctatactac

SEQ ID NO: 557800 - DNA, 1311 bp, Homo sapiens
  misc_feature (491)..(491): n is a, c, g, or t
  misc_feature (601)..(601): n is a, c, g, or t
  misc_feature (750)..(750): n is a, c, g, or t
ttttttgtttttttttcaaattggaatatttatataaaccagggtagtggccttggtaacatggtgcacacacacctcgcacactcaaaaggatcggccggggggaaaaattacataaattaatgtgccttagggggaaaagtgaaaaattaaaaaagatcccgtggtgagggttttcattatagtgtggtgaggcaattagtgtctccacattcactatacaagagctatgtggccaaatctcgtgtctccagaggagagcagagtttggaagtgtggagggctataggagacgaggaatctcttggggaaaaaatttcaagcgaggtgggcatatagcgagagtctctcttcaatatatgtgagaaagagcctgtgaccattaatgtggtgggactttgtgggcgtggtgaaatcttctcctctctttggggcacacacactaggtgggggaagagaggggttatcactccacgaggggcgcgagacanaaatatagagaagacagagcgggcgggtgggtgacacagacagagagcgctctcgtgggcgagcccaacttttctcccctccaccgaggatattggggtgcgcgaggggngctcatctccagagaaaaagagtgtcttataagtctcttctctctctcgtggaaacacccgagtgttctcagaaacccttttctcccacagtgtgccagagtggcttcctataacccctctcatctctcttataggggtgcacaaggancccactctgtggagggaaaagcctcttaaaagggggttcttcaggggacgaagcatgtggggtctccggggggagcgtccttaataagcgagaacgcaaaggggcaaatacatgaggactccgtgtgcggctcccaccaaaacacgggcgggggcgcggggaggatcatataccgtatatttagcctcccagggcaattccgtgtggcctacccaacggggcaagatattacagggggcggggggataatttttcccacacccttccgttcaaaaataacgagcggtgtatacgaacattacttttgccgacgacacaacccgagcagttttaatatacgccgtggtgggacgacgatatagaattgcggacattatgggcgcgctccataaaaaaaggcacattatcgttgggcggcgattcacaaaaattagtggggcgtgcccacaaaataggggaccacaacgatgtttttatgcagcgagctcacaacacagtgtaatacaaacccgcgggtgaggaaagaaaactactccccgtcatcatatcaaaacaacacct

SEQ ID NO: 557801 - DNA, 862 bp, Homo sapiens
tcctaggtaggcctgtgtatcggccgatggcgaacccggctctggtgtaacgccgggctcggagcgccaaacatgctcgccataagccaggatcagtccccgtgggggtgctttggctggccgagggggctttggtgaccgtgtggtcgtggagtccgagggggctttggctggggtccgaggtcgagtgctggatggctttagatgtgtctgttgtgactgagtgatggagtgtggatggctgttgctgggctggtgcggtgtgtgagtgagtgatgtgaacgaggttggtggagtgcttccattcttggttggcaacctgtgtggtctgttgtgtctgtgttgatgtgaacaaatgatgtgaaaccagtcggggcaagaatgtgattggttggagccgcatcgtgcatgagtggtgtcttcatttgtcgatggacacatgtgaatgattgcacttggtcaccaagaacctggtccctggttgaatcagtttattggatgagaacgagagtctcgatttcgtgaaggagatgacaaaatttgagtaccgagccttggaaccccttccgctccaaagctagcagcagcaatcctgggtggtgtggaccagatccacatcaaacctgtgggctaaggtttctctacctcggggcttgcctcgggcaccacgggtctccccatgttctcctgacattccgttggtccggatggtctagtctatgcaggtcgagttctccccagcgctctggccgtgacttcatttacttggccaggaagaggcccccttattcctgtgatcgggtttgttgaaccaccaatccgcttttcttgatggtggtgtgttttgcgtttggccgccaca

SEQ ID NO: 557802 - DNA, 675 bp, Homo sapiens
  misc_feature (1)..(1): n is a, c, g, or t
  misc_feature (114)..(114): n is a, c, g, or t
ngtgttccttccctcatccccgtaaatagctaagctgttaatggcaagttttgggaccagtttagggccagatttggggggcttgctctcaacacaaaagtgccatgtgacccntcagttccactttgggtctatcccccaaagtgctgaaagcagggactcgagtagtatgcccagccatgtcacagcagcaccatccacagcagccaagggtgaaggcaacccacatgtccatcagccaatgaggaataaactcagtgtgccccaccgacgtggagcaacgtattattcagccttaaaaaggaagaaaattcggacacacagcacaacacgtaagaggcttggagttgttacaccgagtggagggaaccagccacgggactagcactgtgtaatcccactacgggcccctggaacagtcaacccatggagacaggaagtagaggggtgggtgtcagggtgggtgtcagggctggcagagaggaatggggagctagtgttgaagcaggacagggcttactttggcgacgagaaagccctagagagccagtgcagaacaatgcaagtatactcaactgtagagctgaaaatgattcagatgggaattttctcatgtgtattttaccaacaatcttaaaaaacaaagctgcactcatctctccctaaagacttgcc

SEQ ID NO: 557803 - DNA, 822 bp, Homo sapiens
tcgatcagcaggtgtcctgggaatttccctgcttgaacctctcgaaacccaaatccagagtccatacactgcaagatgttgcctccatcatgtcacactcttatgcagcgggcacttgccatgtgtacgtgcgaggtccgcgacgagctgctccagctttaacaagatactgtgaagtagcacgctccagacatggtccagctagctgggagagtctcatgaacctcgagcccacatgagctgccgggacatgtaggagtgcagctgccccgagctggatcagctggtggacatctgtcggaagtgttcggggctccagctccacgagcttgactggagcaggatggggaggctgccacagtatcaagtggtacctgcggacaagctgcccagctttctagcaaatgtgcacaaagcttattagccagaggagtgatggaagctatagcaccggagagagcaatacgtatctgtttgtctaccaaacctgcgaggtagggctgtatcggtttccgctgtgaggccagaaaaaatgtagaagaagtctgagagaaactacttagggcacttaggaattggcaggactatttgtgccacaggacattaatcttcgttgtgttttgtattatgatgaacggttgctatgatatcaagatatattttcgaagaggatggttgcaagctctctatgcttcataatgattctatttccatcttaaaagtatggttttactagtaagaaccaagatcatgcttggacagatgttttaagaataacttactgagatttattgatttgaagattttaaagatgaatggtat

SEQ ID NO: 557804 - DNA, 857 bp, Homo sapiens
ggaaataaacagcttaatggctcacacaaagcctgtttcgtggtctcttcacactgacgtgcatgaaatttgttgccatgacttggatcgggggacctccctttggagatcaatcccccatcctcctgctctttgctccgtgagaaagatccaccttatgacctcaggtcctcagactgaccagcccaagaaacatctcaccatttcaaatccggggctgtgttacacatgccggaaatctggccactgggccaaggaatgcctgcagcccgggattcttcctaagccacgtcccatctgtgtgggaccccactgaaaatcagactgttcaactcacctggcagccactcctagagcccctggaactccggcccaaggctctctgactgactccttcccagatcttctcggcttagcggctgacagactggctgctcggttgcctcggaagcccctatagaccatcacggatgctgaagctttagtccaagaaggcacggacatgtcaggcctctgagaccaagccaagcaattcgcattccccttggtgcactgcacgtatacgcccagatggcctgaggtaactgacgcatcccaacaggaagtgaaaacggcctggccgagcctttacactgttgagatttccaccattgtggtttggtccctggcacaacttaaatgcgggtgttaaccccgtgtgaatttcctaacccgtgtgtcaaaagagcctctccactggtgaactgtggttggaccacggagggtggtgtgaacaacagaaaaaacacccctcttgtgctgctgataatacaactaatcatcaccacgacatcttatatagtgggccacacgcgcta

SEQ ID NO: 557805 - DNA, 306 bp, Homo sapiens
tttacgagatggagcgagtgggtttttcaaagattcgcttggagcttagtggagaagggtgctctcctggctcccgcatgtctgagaaaatcctgagggccgctgggggaggccgtgccttctggactcgtgggcaccaaccctggtaagtgtggagggagtcgtgggggcgtggggcctctccctccaggatcccaggctgctccaggccaggactgggctagggtgccacagcagcctctactctcattctcgaaacccacaggcgctgcctagggtttgggatgcacgccacgattttctctc

SEQ ID NO: 557806 - DNA, 136 bp, Homo sapiens
cactctagacggatccccctgcttggcctatttttttgtttatttttagaaacaggtctcgttatgtcacccaggctgtagtgcagtggctatgaacagcctcaatcattgggcactgcagccttgaactccttag

SEQ ID NO: 557807 - DNA, 746 bp, Homo sapiens
tcttgatttgttgcttcgcaaggccagggctatcttccagggaaggcagacagtggggagacgcagagggactggactgcaggcaagcactttgacgaaagacactgggcgggtttccccacctctcaccccaaagcagaaaatctagcagactgtcagctcaagccccgtcctgtgggcacagacacttacacagggagacgcgtggacgttttaagcaatactttataatacgtggtacatagtgtcggatttccatctttcctgtctcattttttgattcataccaaagaaagaggtagagttacacctaaacacacgaaagacctttttagatttaaattccatttcccttctttgactcgggggaaccctgttgtacagtggtgtggcaaccttttaatctcccagaacacgctgtgggctattctccaaatgtacactcgaggcacagtgtaatgtggcttctccagcaacgagggaattttcaaggtttcgcgggggaagtcttcaggggggccaatgtgttgagggagagggtgggccacgtgaagtgccttgagaaagaacagaagatgtttcccagggaggccttcccgtcggaaaggggttcatcgtaccatacagtgtaatcgcggtgggtacctctagagtggttaaccatttccccattgtgtggggaacttcttgttgagtattttgtccctcttataagagttaacggtgtgtgggtcattacacaccaa

SEQ ID NO: 557808 - DNA, 131 bp, Homo sapiens
cacagtccaaacagtgccaatacagtactagcaaactcagtaaaaaggagtatatgatataggagtatgaactttcaagtatgaagatatatattcaccaggaataattcactctcaaagctatagagagc

SEQ ID NO: 557809 - DNA, 1177 bp, Homo sapiens
  misc_feature (1)..(1): n is a, c, g, or t
  misc_feature (544)..(544): n is a, c, g, or t
  misc_feature (690)..(690): n is a, c, g, or t
ngtgtagtttgcttgcggagctgcgcgtgtgttcaatgagtcgctcatcgcttgtgttttgccgggtatctcctccgtgatcgtccgcggtcttgttgggccactatgagctttttcgctacccctggtgtctccgtcgagttctccggtttctcggcccgtggtcgcgagcgtgtcggaccattgcccccccctagtgtcgcgtgcccccccgcggtcttgtgccccccccgcggtgtcaccccaagcagcatgcttataaaggagatgtttaagaatttaaaggtatcttcggcatattgttgaccccgccgtgtgtccgcagaaacgatcgcctgttggcttccccccgtatttgggccccccccctgccccagggacagcagggtttaccgccccgcggtacccttgacccgtgccaaagggtagcataatcagcgtggttccttaaatagggaccctgttatgaatggctcccacgagggttcaactgttctcgtacttgtgtaagcacgtggaaattggacctggcccgtgaagaggncgggcatatacaccgccatgacgatgtaagaccccctattggagcctcttaaatgttagttaaatcgccacaccagtacctgtaccaaccccaccaggtctcctataactatcccaaaccctgcgcaattagaaaaatttccggtntggggcgacacctccggaggcacgagatccccacccttcctcgaggcacgtaacactgctaaagagacttcacccaccgttcacaaagcgagactatctaataactcccacttgagtcccactataacttgagcccaccgggacccacgttaaccctaagggataaccagccccaatcctattttagagtcccataatcccaccaattagggtttacagacctcgatgttggatccaggaccatccccaatggcgccaccccgctattaaaggttcgtttgttccaaccgattaaagtcctacgtgatctgagttccagacccggagtaatcccggtccggtttctatctacttccaaattcctccctgtacgaaaggaccagagaaataaggcctacttccaccaagccgccttccccccgtaaatgatatcatttcaacttagtattataccccacccccaccccagaaccgggtttgtttaaga

SEQ ID NO: 557810 - DNA, 182 bp, Homo sapiens
  misc_feature (17)..(17): n is a, c, g, or t
  misc_feature (79)..(79): n is a, c, g, or t
  misc_feature (147)..(147): n is a, c, g, or t
gtggagacagggttttntcacattgcccaggctggtctcgaactcttgggctcaagcaatccacccaccttggcctctnaaagtgctgggattacaggtgtgtgcctctgcacccagctcagaacttgtacttaagaagtcattttnaatctagagtgcttgaacgcttccataataatttt

SEQ ID NO: 557811 - DNA, 111 bp, Homo sapiens
  misc_feature (15)..(15): n is a, c, g, or t
  misc_feature (63)..(63): n is a, c, g, or t
  misc_feature (76)..(76): n is a, c, g, or t
gggtgtttggggtgntgttcgtttggccttctgggctttctgggggggcttggtggccttgcnggctccggcggcnttcttgtcccctgctttggtggcaccccccgcaac

SEQ ID NO: 557812 - DNA, 886 bp, Homo sapiens
  misc_feature (380)..(380): n is a, c, g, or t
cgtgttctgttggttctggtgtctgctatggattggtgggtgtggtttttgttccctgctgctcttggtgcagtcgtgatgttttgttatgatagttcaaaatgtgtgttggtttggtgttggtggcttccgtgtggtgttcgtgctgttatagttggggtgtctttttttgtgggtgggcgccccccctggtgttttgtcactcctcactgcggttgttttctgctgtttcgcctctggtggcatcacccgcttatacgtctctgcgagtacttgtgatatacccactgagaaatattgagttccccacaatggcacgtatatgttgtttgtgtgtgataaattgaaaaatatattattattgttctcgtgagaggcgngttttccccacaggaacaaaaaacactcgggctcttgaagtatgcgcagcagtgatattctcgtgtcgcgggggggcgctttaacacagcacacccctctcccacaggggggtgcacatattcacagcgcccccctcttgttctcggtctccttctctccatttcactagcgctccacagcccctgtggccttgggctgtcccgaacacaccctgggccacgagagccccttccttgtgagatatggtggctccctgggccttcccgtggtggaatgtaagccacaggcgtctgcccccctcccgggagagcccctggggtgaagccctccggggccctccctgcttgccacagccgtctccccctctctcccaacacatgcaatttcaccgtttgggtggttttggttttttattttttggaaatgtccaattggataacatcttaacagcccctgataggagcttccaactggagaatagccgaaattaaataactccatttgc

SEQ ID NO: 557813 - DNA, 529 bp, Homo sapiens
gtagcacagatgaatatacgaacgtgtgtctagcggaggctgattctttgaaagtgcttggtagttatattgatagctgtttatagttggagctctgtttctaggtagaacaccattttcagcttcggatgcactaactgtggagtcccattggggatctggttttgtgactattttcccgtgtgctatgagaaggaattacagatccaggtgaaccaggctatgctcattatagaaggacttttacaagtattttgagcagtatctggggatggacattcatacgtagtagtgggttctgtattttcaggatcagggtcttccataagtacactgaaagaagggactgggcccttagcttgcaactggggtatgtgatttgcatgagatgaaggtgaagactgagcatgactcggtgaccatgagacacatggtgattctcccccactatactttatcttatcggtgatcactgcgacgataaagcatctctgagaatcctatttctgacttgttccacgaagttgag

SEQ ID NO: 557814 - DNA, 355 bp, Homo sapiens
  misc_feature (180)..(180): n is a, c, g, or t
  misc_feature (203)..(203): n is a, c, g, or t
tgaccttccggattggggtttcctgagtggacttttttttactgatgttgatgctattcctttctgtttgttagttcttctaacagtcaggcccatctgctgcaggtctgctggagtttgctggaggtccactccagaccctatttgccttggtatcagcagcagaggctggagaatagnaaagattgctgcctgtttttgcntctagaagcttcattccagaggggcacccaccagatgccagctggagctcacctgtatgatgtgtctgtcagcctctgctagaaggtgtcttccagtcaggagaaacggggggtcagggacccacttaaggaggcagtctgacccttagcag

SEQ ID NO: 557815 - DNA, 145 bp, Homo sapiens
tgctgcgtggcatcacgaaatatgcagcacatgtgaagcactggatccactgcggcgtcatcgcgctggcacccacgtcaaacatgtggaagttgactttggtcaccttgaaattgggtcccaaagattccagaagtcaggacac

SEQ ID NO: 557816 - DNA, 174 bp, Homo sapiens
  misc_feature (80)..(80): n is a, c, g, or t
gcgggggaagtactccagaggcagcagcccaagagtacctttgtgtttggatggatttaaggcgcaagtacttccattgngggccacactctctgtgggcatgccatatttctggagcactttgttaagggccggtctgggtccctgttggtacctcagaggtatcgtttccct

SEQ ID NO: 557817 - DNA, 172 bp, Homo sapiens
acttagaggatccgtgacagcacagaggagggggaaatcaagactaaccagatcttgagcggctgtcagatctcacagcaggtgctcctccccaaactggccctcgctaaaatactccttgaagcggagtcgagatcgagggaaatcccctctgtgctgtccacctcctctg

SEQ ID NO: 557818 - DNA, 441 bp, Homo sapiens
  misc_feature (18)..(18): n is a, c, g, or t
  misc_feature (82)..(82): n is a, c, g, or t
  misc_feature (323)..(323): n is a, c, g, or t
  misc_feature (338)..(338): n is a, c, g, or t
  misc_feature (347)..(347): n is a, c, g, or t
  misc_feature (405)..(405): n is a, c, g, or t
gtagatgacctgcgggcngtctgctgggtgtctgtcagtgtgttcttctgccggtgtcttctgctggtgtgttcctctcaangtccagctgcttgtgtttgtcccctctagtgtttcagggtttttacaggcacaggatagggggtatggcgggccaggggtggtgttggaaaatgcaacatttaggcgggaaaacagaaatgcctgttctcacataggtccgtgagtataggcccgagggtgggagacctagccaggggaccccgcctttctctacccagcattttccctgccccgctccggtattcactagcagaaacagnttgctgctttttccntcccctcgnggcttttagaagcccatgaagggagctcttggttgtttgggcagaagaattcccagtnggttcaaggggttaagggataagttgggggaacctt

SEQ ID NO: 557819 - DNA, 368 bp, Homo sapiens
tttctttctaaaaactattagaaaaattgtcttcaaaataataaaaatcaccaggcgtagtggcccacacctgtaatcccagtgctttgggaggccaacgcaggaggatcgcttgagcccaggagtccaaggctgccgtgagctaggactgcatcactgcactccagcctaggcaacatagtgagaccctgtctctactaaaaataaatttaaaaaaaattagctgagtgtggtggtgcatgcatgtagttccagctactcaggaggctgaggctagaggatccttgagcccaggaggttgaggctgcagtgaggtgtgattgcgccactgcattccagcttgggcgacagagcgagacccagtctca

SEQ ID NO: 557820 - DNA, 370 bp, Homo sapiens
tgtccacacgtggcgttgatactgtagtttgcagtaagtggggaagttgggatgtatgagccctccaactgttctttttaaagatcgtatggcagtttctgtgaaaaatgcctttgtaagtttaataaggattgcattgactctgtagatcacttaaggtagtatggacatctttaattcttccaatccatgaatgtagatctttctatttatttgtcttcttcactgtctttcttcaatgtattatagttttcagtgtacagatcttttacctccttagttcagtctattcctaagtatttcattttggtaaatgagattgttttcttcatttcttttgggatagttcattgttaatgtatagaagtgc

SEQ ID NO: 557821 - DNA, 691 bp, Homo sapiens
cccggaggccaaccaaagaccaacttgcaacggctcggacatgcttattgccaaagtcatcgatgcctctaccaatcctgtgaaaaaattgtatttggaccaaacgcttattcccgtgagaagaatataatctctcaaccacccgcagtgtcggaagttcaccatgaaccctggcaagtatgcgcaaagccttcaatgtcagattgcgaacagatcaggaagaccattggatagtgttaatagaaaaggccaggatgcgggatgtacttgtcattgcattcgtatttaaaacacaaagctgctagggccacgctgtaggcaaggggtacaaactttcttataaaggtgtcgcaacaccgaggttttatagggtggttggcccgaatccatctaggaagtttccaagctgtcaggaattcgccaaaatatgttattcacacagttgtgtttcaggcccccctttttaaaaggcagggctttgttaaaaaggggtgacaggtggttttgctcccccattaagaaggccttctgtagtgggttaaatacaagtattaacaattgtggccttgacaccaaggaatttaattccttccacccggcagtgtgagtaggggggtccctcttcttaacccggcatgccacggttcccgtcccaaatcaacaaccaacaattttctgtaccccggaaata

SEQ ID NO: 557822 - DNA, 243 bp, Homo sapiens
tgagaaaatcaaagccaagtaccccgactacgaggtcacctgggctaacgcggggtattgagcactcccagcccggggcctgttgcctccaacagccacttcaaagcccccgcctttgcctgcactccttttgcaggggtggccctgcctgttcctggggcagcctttggtgacgtgctgtcccccaggccttggagacaggctagcctggccccaaaattaaacgtgttgccccccctgcca

SEQ ID NO: 557823 - DNA, 613 bp, Homo sapiens
caggcatcatgtgatcaaaggctcggacgcgctacatccacgcgatagactacggcaagacgggtcagccgagtcatcgaagatagacagggggtctggccgtgcgcactatgctgagtatatcaatcttccagtcggcgtcggcagagttggatatatccagacgaattcttgccaatcggtgagcttcgtcctttgtcctagatctaccggtccccagagccagaccaactgcctgcaaagagaaggcgctcgttgcgataaacataaaagccctgctgggctgtccagccttcagggccagcaagcacttcagaatcctcgcaagaaagcatgtccttgtgcggtaaaagatgacatacggcttcaatccccttgagtgtcgggtgctatgagtacggtagggtagtaaggttaccccggatggtccgtcatgaaaggatcccagggtttcacgaggctgtccgttgagcagaattctgagacgtggtcatcttctctctatatacctgtggaaacaccattccacgatgctgctcgaccttgtatgccaggtcacaaagtcctgaaagtgcttccggagtacgatccgatcagatctcctaggccaagc

SEQ ID NO: 557824 - DNA, 245 bp, Homo sapiens
gggccccccccccctttggggggggcccctttttttacccccccccccccttttccgggggccttttttttgggcccgccccttttccaaaaccctttttgtttttttggccccccttaccccccccttttttttggggcccttttatttttcggggggtttcccgggtttttttgggggggggaattgggggccccccccccccccccctttttttttcctttttttttttttttcccccccca

SEQ ID NO: 557825 - DNA, 220 bp, Homo sapiens
agccgcgagagcgagtctttgtgactcttgtatgcatgtgggtgagggtaaatgtctcgggacgccattgtaacggttcctggaagctgggccctctcattagcatatacagtactacaaaatgcagggcactgtcccaccgggatccagttgcaaagccttgtcttaacagccgagggcctcccttagttgtactggattctcagggagccctctgtgg

SEQ ID NO: 557826 - DNA, 271 bp, Homo sapiens
actgttctgtgcaaaggcctggaggagtcactcagagccaacctccttactgtggctgatgagttccccacaaagtgatgtgcgtcacttcctgtcactggaccccccctggttgtcactccccattggcctctggccagtcacacaggctttggctgtgcctgaaagacctaagacccattctttccatagggcctaacctatggctgtttttcccacccataacaaaacacccgtgaatacccgagctcatagtttactacatccgccg

SEQ ID NO: 557827 - DNA, 368 bp, Homo sapiens
  misc_feature (18)..(18): n is a, c, g, or t
  misc_feature (188)..(188): n is a, c, g, or t
  misc_feature (292)..(292): n is a, c, g, or t
  misc_feature (364)..(364): n is a, c, g, or t
tctaatccactgctggtnggaatataataaaatagtacatgctgagtgtggtggctcacacctgtaatcccagcactttgggaggctgaagtgagaggatcacttgggcccaggagtgcaagaccagcctgggcaacatagggaaatcctgtcgctacgaaaaataaaattagcggggcatggtggtntgtgcctgtggtcccagctacttagaaggcggaggcaggaggatcacttgagcctgagaggctgaggctgggttgagctgtaattttgtcaccatactccaggnctgggttgacaaagtgagacctttctcttttttgtatttttagtagagatgggggttttaccatatttaggncagg

SEQ ID NO: 557828 - DNA, 157 bp, Homo sapiens
  misc_feature (59)..(59): n is a, c, g, or t
  misc_feature (118)..(118): n is a, c, g, or t
tatgccctgaaatgaaacctctaagtttgacaaaatacccacaaaaacagaccttcctngttaacactttataagaaggtgtgacatttggtgggtggtcgttctcaatttataaaanaataaatgactttaaaggagaaataaatttatgtcagga

SEQ ID NO: 557829 - DNA, 256 bp, Homo sapiens
tgaagtagattgctatacctgacttctggctatgaaatgatctacagttataattagatatacttcccctcaatcttgactatactaatctgcagagatatctagacaggaacaatcgtgcgagttcatatataactctgcacctgctatttggatgactctgccaagtcacctaaactctggatctcagtcacctttggtcctgcattcctctacccttctacttgaaaattggaatgcgtccgtcgggggatcc

SEQ ID NO: 557830 - DNA, 209 bp, Homo sapiens
gaatggaataagaccacggcgttaagtctgagtgttaaacctagttaatggaatacctagtaaatatagtactaaaactactgtatagcaatctttgccaaaaacctgatgacggaaaccacagaggtaactaggaaattcccaaattgcgcttaaaaaaaatactacgagacttgagaattttttaacagtaacttcctaagtgtaag

SEQ ID NO: 557831 - DNA, 155 bp, Homo sapiens
tggaataagtatattcatttagtttccacccacctttgtttaatttggggatgtggtattgacaggagagagaaagagagagggaattggtgctaaagcggcggggtaagtgcggaaggaagtaaccctcctccctggctacggcttcgggctgg

SEQ ID NO: 557832 - DNA, 473 bp, Homo sapiens
acgccactgcactccagcctgggcgacaagagcaaaactctgtcttgaaaaaaaaaaaaaaaaaaattgaaaaattcgaaagagcgagggtaattttaggcagggccaggtgtgttaatgggctaccttctcagtgatgcctttgaatttagccaggattttgaaaagttggcacttgggggaattgatgagctgcccctttctcgtccttgttaaaggggggcagtaggaaggttccagcgtcaggtacataaaagttggactccaccatttgtctcctggttactcgctcattatggagccaacgtgctctttttcttctgcgtggctagaattgattgagaagaaaagagaggaaaggagtgtgacgggtattggacccaacacagaaccgattgtttaccacgccgacttttccttcatctgaaagaccaaagagaagtgcccgagagattgggcagttgggcttgcac

SEQ ID NO: 557833 - DNA, 729 bp, Homo sapiens
  misc_feature (530)..(530): n is a, c, g, or t
tggtaaatagagaacaaggtctcgctatgtggtccggaaggtgaccctccccactcatgcccccttgggctggggggcccatttcaagagattaccttgtgaagccatggttatcttgtggcgatggagcgcaccggggggtgaaagatcactcgtggccagtgactaccattctgtaaagttcaaaagggccgtagcgccttcatatttattccatacgtggtggacaaacatcagagggagcatgtctaccctgaagcaagagacaattatctatgtgtgaaacaaaaatagcgtgtgaggagtgtggcctgataacccgagggaagatcgatgtgggtgaagacgaacaatatgtgtagcgcactccaaaagattactaacaactcacacgcacttctgctccacaaggaaagaggagacatagtcagtctataaacaaatactatgaaaagcgcatgtagggggaggaacagcccaccaaaggtggggcgtcgtgttgtggtggggagaaatccaccacaaaaacnacacgctcgacgatgttgcagtaaaaatacaccccaaaagtgaaacaatatcttgtcgagagagaagcggggagtagaaaaagcaccaaaaggaagagacacaacaccagtaaggagcacacgcaagaaaagaaccgcaacaagaagaaggcgtgtggaggacggaccaaacaacaaaacaaaatagcaagcaagagca

SEQ ID NO: 557834 - DNA, 645 bp, Homo sapiens
  misc_feature (494)..(494): n is a, c, g, or t
  misc_feature (503)..(503): n is a, c, g, or t
  misc_feature (556)..(556): n is a, c, g, or t
cctaatgtaagtgaaaagctttagtggtacatacattgcctcaaaatcagaaacagaacattggttcactcatcttaaaccacatcatgggttaaagaaaaaaacattgcaaggaagacttcactcttctagaagggcatgatttggtaagtcctttttccatagtttagagttaaatagatacacaacagactaaattctcttgtgaaagttatgatagaattggctgaacagagaagtatctgtgcagttgctgacacttgtggcctatggagaaatacaccaaatgaagattatagagattcagtggtaggggactgataaagagattgcttagttaataaatagactctatccagtgcattctttgatctattcaattttaggggtttggtttatgaggactctgggtaaagagcatcctccaaactcttgggattatcctcccaatagtctaatagtatccctagtggtgcttgatctctcaaaggttntaagtgctntctggcagccatctctagaatgtcaaatggtcacttttcaagtggaatgacangagctgaaagtatgcaaccctgaggataatgaacttattgatgatgtgctgagaccagtaccccacaatgatggaacctgaggggggtt

SEQ ID NO: 557835 - DNA, 103 bp, Homo sapiens
aagcagttaatacagactcaaaagtgaaatggacatttgacaattctgtgaaatttgcctctgggactccctgggctctgggtgtagattggaggtgccacct

SEQ ID NO: 557836 - DNA, 105 bp, Homo sapiens
  misc_feature (105)..(105): n is a, c, g, or t
gggtcaagacgcgcgggagccggaggcgtctccaccgcagacatgacggaggggcccatgtattaggggccccatgcccacgggtatagagatggtctgactgcn

SEQ ID NO: 557837 - DNA, 118 bp, Homo sapiens
tatataacatgaaatgatgcctgcctgtatgccagtgacagccgcaaccctacaggcctcagtaccttgcagaaggtgatggggtagatgagtcatgcctccactcccattccatgca

SEQ ID NO: 557838 - DNA, 197 bp, Homo sapiens
gcggccgcctactactactaaattcgcggccgcgtcgacatacgcttcgggtacccgcaacctgctggtgcatggtcacagccagggtggtgctatcgcctacctgataaccgcatggctgcggatgcaacagcaatctggttcactgcccgccgacctccgcatcaagacctactgcagtgccgcacccaaacccg

SEQ ID NO: 557839 - DNA, 131 bp, Homo sapiens
tcccttcctagtaatcctttaattctcacccccggggtgcaattttttcccactaaaagagaccaaagcctgatctttgctgattagtcataattaactgactgcacccctatccttggccccttatcgag

SEQ ID NO: 557840 - DNA, 301 bp, Homo sapiens
ggagggtgattgtggacagagtgagtgtaaacacaagatgggcgcaaggaggagaaagacaaggcaggaagataaggacagaggaggtgagatgttggtgaggtgccagtgaatagcagagagagcccaaggttccatggcctgaccctgcgcaaggctgggttgggcctcagtatccccatctgtgaaatgggtataggcggaggagttcaagctccactctcgtttcctccttcgcgtggttagtggggtgaggctgctcgcaggacccaggaggtctgattgacggagacgacccatt

SEQ ID NO: 557841 - DNA, 240 bp, Homo sapiens
gataaaacccctcaaaaaatatatatagaaggaccatgtgtcagcataataaaagccatatactacagacccatagctagcatcttactgaatggagaaatttggaagtcttttaacatcaggaacatgacaaggatgcccacttttaccactcttctttaacatagtattggaagttctggctagagcaatcagaaaggagaaagaaataagggcactcaactgaggagcagcagccaa

SEQ ID NO: 557842 - DNA, 179 bp, Homo sapiens
aacagtgcgtcatgcgttccccactcggtgttaatacacgaatgctgtcaagaacgtatccattttgatcggaatggtaatcatgttgtaccacgtggaatgcttgttcgtgatgcatagtatccatcaccaaagcgtagatatcttcatcgtagacttgttttttcttatctgctaag

SEQ ID NO: 557843 - DNA, 142 bp, Homo sapiens
ctactgtgcagtctcccacctctgactgaccccagccttaaacatcgcccctggcagtaggccttgctgggtggagcctctgtgtgactccatacacctcccaccacaacactcatctgtcaaacaccacgcactctcagca

SEQ ID NO: 557844 - DNA, 140 bp, Homo sapiens
aacgagtgcaagctaaaagaagagacgtcgggcccaggggaacaggcacgagctgaactcttgagcctaacccagatggagagggagaagattgtatgggagtttagagcagctgtatcactcctataacaggagcatga

SEQ ID NO: 557845 - DNA, 290 bp, Homo sapiens
actctccctactgtatcctacttgaggctggaaattgacagttgtttcttgaggcaatctcctgctgtgagagctttctggctctggagcttctaagtgagcacagagtcagataagcttgtcctatagggagtgtctggtgaagggaaggtcaaggttataaggttataattgcatttctaaagcgctaagtaggaagtgaggaacatgagaaaagaaggagagagaaaagaaaaaaaataattaaaaccattttctttctcttagaaaaataggatacagtagggaga

SEQ ID NO: 557846 - DNA, 1448 bp, Homo sapiens
aagcagctacctcggaggcagggcgcgcagtgcgggcggcgatgagagtggggcgcagtccgcgagccccgacgctggggagcccaccgacataacccgtgcaacccaccgcaccccgtgcacaagagagctggcgggcgctggacacgtcgccctgggtgacctatcctcggagtgcagaaatccgcccctgcgagcatcctcttcctccataggctctgaaggcccgggggagcgtgagcgatgcccagcatgcacccgggcaagggcagtcgcacattagtgttaagccagatacaggacggagagggctagtcgtcacgcgtgcaagaggggggatcatcacacatgacttcagcgccgagtgtgcgctcatatccacaggcatcccaatgggtgaccgaccagaaaagcacaaagcatccagggactgaggaaaacggtggaccagatgaagggacggaactggccaggacagaaagatactatcaccatgggcccgagataccccaaggacagaagaacggagagagggttgcgaaacgttgcatatgcgcaagcacacggaagtggaacagacagaccatcacatactccataccacaaaaaaacgcgtaaaaatgaacagacaaggaaaacaggcagtcgggaacagcacggaaaagacacggcatggcatgggcaccaccaaaagaggaactcacaaccattaatacatcgtggggaatccaaggcagatgcacgaggggctaccacgatgacatggtacacggagtgcaacttaacctatggggaattaccgccacgtgtgatggaacacatgggaatagtaacaacaggttgcggcgaagagaacgatcagagaggaacaccccacggcaacagccgaaaccaggcaccacccgcgagagagaaggttacccatattggcagagcaagtggcgcaaagacgagaacgacaggggcaaatggggaacaaagaccagacgagaagaccaacccgagtagggcagcagccagagacgaagcgaaccacattggccaccgaggagaaacgagaggaggcgaaagactcacaacataacgaggagcaacagagacacacgagcaaaggaaagacaaccaggcacagagagccccaacgacacacgagcggcaaaccccatacatggagcaggacaagaggagagataaaagaagcgggatacgacgatgagaggcagacacgcggcaaagcaacacagaaagagagagcacgggcggaaacagcggaacagcacgaacccacgaggagagcaaaagagagcaagaagagagcaaaagaggaaaacggaagaaaaaaacagagaatccacatcgagaagacagagaaacgcagagcgaaacaaacaacagcaaaccgaacacagagacgaacagagaccaagcagcgccggagagaggaagcg

SEQ ID NO: 557847 - DNA, 208 bp, Homo sapiens
tggagggcagacagaagatgaagaacaaaggaacttttacaattttcttttagaaataccagtgattgcaggccaggtatggtggctcacacctgtaatcccagcactttgggaggccaaggcaggcggatcgcctgaggtcaggaattcgagaccagcctgaccaatatggcaaaactccgtctctactaaaaatacaaaacttagc

SEQ ID NO: 557848 - DNA, 262 bp, Homo sapiens
  misc_feature (181)..(181): n is a, c, g, or t
  misc_feature (232)..(232): n is a, c, g, or t
  misc_feature (235)..(235): n is a, c, g, or t
gcgattctcctgcctcggcctcctgagtagctgggactacgggcatgcaccaccacgcccagctaattttttgtatttctagtggagacagggtttcgccatgttggcaaggatggtctcgatttcttgacttcgtgatccgcccgccttggcctcccaaagtgctgggattacaggtgtnagccaccgcacccggcctcaaatacattttttttaatgggccttgtctttnccnggtttaaggcccttttccaaaatttct

SEQ ID NO: 557849 - DNA, 253 bp, Homo sapiens
cccccccccccccttttttttttgtttgcccccggtaaccccctggggttttttggtttcccccccgttggggggggagggggctttttaaagttttaaaaaaaaggtttaagggggtggttcccccaggttttttccctttttaccccccatttccaatggggggggtttttcccccccgggattggttttgttttcccaaaagccccggggggggcccctttttggtttttcccttttggtttttggccca

SEQ ID NO: 557850 - DNA, 469 bp, Homo sapiens
  misc_feature (340)..(340): n is a, c, g, or t
catgacctcgtggccccgtcttggcatgtggctgcttcaggaagggtggagggggcggtggctgtgggagatgaggacaggcagagacgggccccacctgggactgctgtggtctggaacgggcgtctaaactgcctgcagtctgcagcctctgcgtgtctttatggaaccgagaaccaactttgatttgtataaaagctgtacccagtgcggcctacgcatgtccgtcacggtctcacagcggtgagccgctgcctgtctgattcagccttagcccggctcttcctcctccttctgcacaacccgcccgtcttcgacagcctgcgctgcacgggggcancgtgccgggcttgctctgcgttccttgtggatttcctgcttctcagatcacagtcatccatttctacactcttgaaactctcaaacctttgaataataaaaacacaccaagtctttaagctaaaaaaaa

SEQ ID NO: 557851 - DNA, 419 bp, Homo sapiens
tatcgtggacacagcgctgttctcatccgtggtcactgagaggtcagggtcacctgatgactccgcatctgcttgagtccaactacactgtccaatcatcgaatccagatcgtcatcgatcttttgcatgttccagaacaagcttctctagttcaaggaacagatattctggagcttgcttctttgctttgtagaagctgttttaactctgcagcattaatactcatcgtccgtggtgtatgagctccctctacttccatgagtccattatcatctccacagcatccaattgtgtcagagttaagaatttgtctcataaattctaagaatgaagatgcaagctctcctgtgtccttactaaatgtgctgaccactcgtttcagtaaactatgcagagaactactgtttttccttaggtt

SEQ ID NO: 557852 - DNA, 823 bp, Homo sapiens
ggggcttatagggccaactttccgtaaattataaattttttggtgggacagaaaaaaggccggcaccttggcggccacaccaccccccttcttggcccacggcaaccccttatacttggagtggggggaaacaaaggggaaaaaaagggccccccccttggggagaaaaatggtccgctgtttggagacaccctgttgaaaaaacttggatggtatattggtggcacccgctatggcctttatattctgagagactttggaggagcccccctgctcggttaaaaaagccaaactttggagcgcccccccagccgctgaggccccacccccccctcggtggtttttgtagccacctaggcccccaactgtgccgcacagtggagctgctccccaagatttgcacatcatgtgtttaaattgccccaaaacttctctcgtgtggagagggcccctcttttagcctgagaaccgctctagtgagcccctcttttggcctgaaagacacttttagaatgttcctaacacgagtttactgttgtttagacatttgcagggcttcttttccgccaatgccacccacgccgattataattttgtcagccaagctattatctctaatgtagtgccaccccgactacgagcctgtgatcacttcactggtataaattttacctgcttgcacacataactaccatctctctcttaaacgagatcaggttagccaatgatgtaaaagaagctttattgtctagttgttttttttccccccagaccaaggcacagtttccctaagtttgagttgatagttatttaaaagaaacca

SEQ ID NO: 557853 - DNA, 102 bp, Homo sapiens
ggggccgcctactactactactactgctcgaattcaagcttctaacgatgtacggggacatggaaataaagcacatatcgctaccctgggcccctgcaaaaa

SEQ ID NO: 557854 - DNA, 140 bp, Homo sapiens
tgggtgcggaaaaggattggagcctacttccctccggtcagcctggaggagctgaggccctacttcaggcgacccgtgggtgtggcctttgcccgggcccctttagacgtgcaccagaaataaaggcgaagacccaaaaa

SEQ ID NO: 557855 - DNA, 132 bp, Homo sapiens
gagttgttgcggcggtttcggttactgcggtggcagctctgtcttggccggcccttgcactgctcgatttggggcttctatcgtggctttccgaggctgctgctcctgttcgcaaaatgagaccatggaaag

SEQ ID NO: 557856 - DNA, 161 bp, Homo sapiens
gccggtgagcccccatcctgcccctgcccaccaggtactgtgggcctgtggcggcaagatagggggagagagacccagagatgtgagagagagtcagagacagagacagagagagagagagagagacacagagagagacagagagagagcgagcgagcgcg

SEQ ID NO: 557857 - DNA, 351 bp, Homo sapiens
  misc_feature (77)..(77): n is a, c, g, or t
  misc_feature (116)..(116): n is a, c, g, or t
ctggagtaaagtgggtccgtaatccagtatgactggtgtttttataaaaaagaatgtcacatggagagacacatacnaggaagaatgaaatgtgaacaggaaggcagagatcaaangtgatgcctctacaagcaaatgattgccaaagattgccagcaatcaccagaaactaggaggctgacatggaacagattcttttttatagccctcagaaggaaccagcactgttgacactttggtctcgaacttctagcctccagaatcatgagacaattctgttgtttaggccaccccatctgtgttactttgctatggcaggctttggaaataaatacactggtcaatagaaaa

SEQ ID NO: 557858 - DNA, 1194 bp, Homo sapiens
gagcaaaactccatctcaaaaaaaaaaaaaaaaaaaagcttacaattctgactgggaagatgtcaaaacctgtgaaaagctaatttagcagtattaaggcaacacaaacatttagtgtgccaaagtgcatgtgattaagggcttaaagaaaggccagagcattatatttactgtgtagagttagaatagttaggggaagactttgtgtccttatagataaagagataggagggtgggcctgggcccttgaaaataagtaagtggttaaggtaagaatgctggtggtaaggattcctggataaagaagcaattggaaaagaaaggagaaggggaagtaagtaaaggggacaagagaaaacaattttttttttgggaggagaaccataaggcaaatttattaggttggaccaagagacaagagattggggggacatttttcgggttaccaggggaatttacctcttatggtggtgaataattctttaaattattaatttattcctcctggggaaaaaggagtaacctctgggaaatattcccttaaaaaggtgtgggaaggcaagtattgtccctcttgggatggggacaagaagggggggaatattcctgggcccctctccgcgggttatgcggggacaagatacactttaactaagagagaacctatttgggcgaaaaaaacgtcttgaaaactcttctttcccctataaatttaaacagagggtctcgccgttggggtcaaaccacgcgggggcgcaaatttcccaacccccaaattaatctaacatcgggaacaccacaattaagcggcaccgtgccccaaggtataaaggggccccgtgttccccatggaagtggcggactcctctggcacgacaacaaggacattcttctcgggctttaaaccaacccatttttactccgtggccgaactcctcggagccaccctttttaatccccttttttttttcaccccctcaatttggcggcctcaaagtcggggcgcagaacaaaccactccctcacgcgtgttctccctcaccacaggcgggccaccgtgggccggctctgtccattaaaacgattatgaacctggcggcaaacatgtcttctctccaacaccaacgcacagtcatcacaacccaacagcagaaacacactcactcagccatcaacaaaccacaacggcggggg

SEQ ID NO: 557859 - DNA, 313 bp, Homo sapiens
  misc_feature (22)..(22): n is a, c, g, or t
  misc_feature (40)..(40): n is a, c, g, or t
  misc_feature (62)..(62): n is a, c, g, or t
  misc_feature (107)..(107): n is a, c, g, or t
  misc_feature (132)..(132): n is a, c, g, or t
  misc_feature (169)..(169): n is a, c, g, or t
  misc_feature (276)..(276): n is a, c, g, or t
  misc_feature (304)..(304): n is a, c, g, or t
  misc_feature (311)..(311): n is a, c, g, or t
gccaaccatcctgaaacgccantgctcttggtctcctgantgtaccccaggtcctccccagntgcggtgtgcaccaaacgcgcctgcctgatgccctggcctgtganctggggaattcctgggccctgtgancccctaggcggcaggcccaggaatggctgggtagganagggaaaacctttgccccacgtctggctgtgacctcggtgaaagccgacaggagagagatgggaccctcctcctcagtagtggctgccagtccctcgttgcaagganagggtcatcataaccataaataaccctncccattncc

SEQ ID NO: 557860 - DNA, 475 bp, Homo sapiens
cagccaacatttctaagtcctttcctttgccctctgcttccttagaacttgccccagaccccaaatcagggaggaagatttgaacctgcctcctgtctccttgctggctggtcttgcaataaagtctttcttttctcaaaggcagtaccatggtattgcttccgtgtacattgagcagtgagcctgaggcaggaaaatagggtcaggaggcagggaacataaggccaattcacacttcggctgtaacaggaaatatccactccatagggcgtatgctgtaagtgactttgtaactttacttcatcctctgcatttacgtagagggtaagtgaagtaaacaatggaatcatctaggggatatttaaacttccaaaaattctgtatacgggcctttgagcccctatgttcgggccgctcccacactgtggaatgtaatttcgttttcaataaatcccttcattccttccttgcaaaa

SEQ ID NO: 557861 - DNA, 421 bp, Homo sapiens
  misc_feature (14)..(14): n is a, c, g, or t
  misc_feature (40)..(40): n is a, c, g, or t
  misc_feature (66)..(66): n is a, c, g, or t
  misc_feature (83)..(83): n is a, c, g, or t
  misc_feature (112)..(112): n is a, c, g, or t
  misc_feature (116)..(116): n is a, c, g, or t
  misc_feature (252)..(252): n is a, c, g, or t
  misc_feature (276)..(276): n is a, c, g, or t
  misc_feature (320)..(320): n is a, c, g, or t
  misc_feature (390)..(390): n is a, c, g, or t
  misc_feature (418)..(418): n is a, c, g, or t
attatctcagccantttggaaaggcagttttgagatttcncaaagaacttaaaacagaaccctccntttgatccaacaattcncactactggatgtttactcaaagggaaanaaancattttacaaaaaaagacactttggctgggcgcaatggcatcacacctgtaatcccagcactttgggatgccaaggcaggcggatcccgaggtcaagagatgcagaccatcctggccaacctggtaaaaccccatntttaccaaacctacaaaaattagntgggagtggtggcacacgcctgtagtcccagctacttgggaggntgaggcaggagaatcgcttgaacccaggatgcggaggttgcagtgagtcaagatggtgccactccactcncatcctggcaacagagggagactccatntca

SEQ ID NO: 557862 - DNA, 470 bp, Homo sapiens
  misc_feature (13)..(13): n is a, c, g, or t
  misc_feature (52)..(52): n is a, c, g, or t
  misc_feature (72)..(72): n is a, c, g, or t
  misc_feature (156)..(156): n is a, c, g, or t
  misc_feature (195)..(195): n is a, c, g, or t
gcgcacacacatncacacaccacacacataaatatacgtttgtacccgtaanatcccttcccattatcccanaggtttttgtgaagtcctttctggggggtttaggggagagtgtcccccaggaaatgtcccttagccacttgccacccccatgcntcccattctatataacttgaaagaagaaggccgggcacnaggtgtcacgcctgtaatcccagcaattggggaggccgaggcgggcggatcacttgaggtcaggagtttgagaccagcctggccaacgtagtgaaaccctgtctctactaaaaatacaaaaattagccagacatggtggcaggtgcctgtagtcccagctactcaggaggctcaggctggagaatcgcttgaacctgggaggtggaggttgcagtgagctgagaccgtaccactgcactctccagcctgggcaacagagcgagacttcatctcaa

SEQ ID NO: 557863 - DNA, 302 bp, Homo sapiens
ttcagagcggtgagtccttgctcagaaggcgggtagactcgggtccccgcgttggagctacctcctgagaacgggaggcccagccttcaccttgcagcggggtgtgtaggaggtggccttgcttgtcatcactgtgcccttcatccagcctccagccaccagagtttggtcttatgtctcccgctcaatccatcccactccaaactcagactgatatgtcttgagatgacccctgctttcctgataaagaggggctgggcatgtgagcttgtgtcccgaggtctttgggaaagctgagatgg

SEQ ID NO: 557864 - DNA, 971 bp, Homo sapiens
tcgcgccgatataataaattagaagaagtcacacaaacaatatgtacacaatttcacatacgatctgctcatacaagtcttctcacagtcttttcaccccatttggttccgctacatctttatgttgcttgaaacaccttcactcgaaacgtcatcttaaccccgcccctggaatatctagttggcaccgcctacacccttaatgtctaacccggtcccctctacattgactctttaccgtgtccatacactccacgttccccgcttgtgtatgcccaattcccattcaccccgccttaacagtaatttttcagccgcgtttggcacgttcaaccctcttgcgggttctccaacgaagagaagttgtggtcccaagaaatgggaacccttgtggctttccccgccagaggccggacgcgctcttttgcgctgcccccggtgacggctttgtaccccccgtcccgagggtgcgtttcgctggtgtcccccgctcttcacgggtcaacccgtctctgtatggttgctccccgggaatgcaccctgctttgaagcttggtgctttccttgggaccgagcgtgtcaagaccctgggagggtcacatgtttttatttatgttcacgaacatggggaccaactgttcgatccttgaggtatacgcctgctccacagctttgggggggccgtcccatcccctatgggtccccctcatgaccactgaattttatcttgagagggagctctatgcaaatatggaatttctgtgcacttctatggagaacccgaatgcggccataagtttctttaaagggtcgccaccacagaaatttagggtatccatatgggtatccgatatatacatacagcggtgtcccttcagtattagatcttcctgggcgccccctagggaaaaaaattttcctttgggccccccaatttaaaaacctacccataaaaaccggcctcatgtcga

SEQ ID NO: 557865 - DNA, 247 bp, Homo sapiens
ggtcaaataataggcgttcaaagtataatggcatttcagataaatcaagattggccatggattgatcatgttaacatgagttcattatggggggtgtccttttacatatacctgacatacgccattaatttatttaaaaagcactcactccggatgtctccctattgttttacgaaacacaaggcagcttggcagcgaacttaaattggtattcaactaaactttttcattaaattccaagaagtcg

SEQ ID NO: 557866 - DNA, 126 bp, Homo sapiens
ggctgagggtcaagtacgcagagattatggacaggcagacgcttatagatgtggccagaacatctcttcgtactaaagttcatgctgacactgtgcagtatgtcttaaccagaggactgtagtgga

SEQ ID NO: 557867 - DNA, 966 bp, Homo sapiens
ggagacaccgggatagagaacgggacggcaccactgagaaaggagtctggttggaagcaaatgtttttgtctaatggacttgcatctcctcacgcttgatcaggacttaaaggacggaggccgccccacgcctcttccctttcgctccaaatgcgccttaactcgcgctcgcgagatcgacccagggtaataccctctggccccacaggatgtgaagactggttggcagtcctcgccagatgcgccgacacctcgctgtcgccaggggaaagaactaaagacgtcgtgtgattgggaggggtggctagacaggaagaaaagcatgtccgaggcccctggtctccatagagaatggtgcttcgtccatgaaaacgtatgagtttctgattctccgggagccgttcaatggtgaggtggatgggacagacttccgttccgcaaaggagaaatgagatcctccatgcaggatctaggagagtgactgtgctgtgccaatagatatgcccagggtcctgccctcaggactagatttcaatgggggcatagagggtccaaatcctcgttgctaacataccacttcttggttgtaactccttgaccttgccagccttggaggagggaccatgagaacagaaattaccttgatgaaaagctacttctgtttcctgctttcccgtctcgacgtattgacggtgactgtctttgacctcccagagggcgtgaactctttcaactcgtgctgctgacctagcttctcagtggacttgccctcctaagcagagaagggctatgaggttgtgtgctgctggggaaggctggcagagcgaattacaccctctgctgttagtgtttggggtacctcattgaataacagatcttagtgttcctttccctggggcttaccagttaagcacatggagccttccccagaaggtacttccctgtttagaggaaggattggcatgg

SEQ ID NO: 557868 - DNA, 396 bp, Homo sapiens
agtcaggttgaggaagtaaaaacaggtcatctattcacaaaactgaaatacttcattaccccgaactaaacatacaaacgtgcttacagtatttgcatgaaaattgtctcaagtttgagctatcaagcttcatttcggttttccgtcaatattctgtgtaaaaacaaaaaaaacccactaaacttgccatctaacaatttctccgaggactggagaagtctgggccgtcaaaagcttcagcacaagattcatggagtataagccgtgaaaaagagaaccctacaacaccgggaaatcggcctacgtccccatttaattccctttacacctcagtacgaaactcccccattatattagaaaataattcaagggttaccataagtaagtccagaaaaa

SEQ ID NO: 557869 - DNA, 798 bp, Homo sapiens
  misc_feature (11)..(11): n is a, c, g, or t
  misc_feature (13)..(13): n is a, c, g, or t
  misc_feature (17)..(17): n is a, c, g, or t
  misc_feature (264)..(264): n is a, c, g, or t
  misc_feature (294)..(294): n is a, c, g, or t
  misc_feature (530)..(530): n is a, c, g, or t
  misc_feature (681)..(681): n is a, c, g, or t
  misc_feature (688)..(688): n is a, c, g, or t
  misc_feature (690)..(690): n is a, c, g, or t
  misc_feature (697)..(697): n is a, c, g, or t
  misc_feature (701)..(701): n is a, c, g, or t
  misc_feature (703)..(703): n is a, c, g, or t
  misc_feature (715)..(715): n is a, c, g, or t
  misc_feature (720)..(720): n is a, c, g, or t
cgaggatccgngnaccntggagagactatggcgctcaacaagaatcactcggagggcggcggagtgatcgtcaataacaccgagagcatcctaatgtcctatgatcacgtggaactcacattcaatgacatgaagaacgtgccagaaggccttcaaagggaccaagaaaggcactgtctaccttaccccttaccgggtcatctttctgtccaagggcaaggatgccagtgcagtccttcatgatgccattttatctcatgaaangactgtgagatcaagcagcccgtatttggntgcaaactacatcaagggaacagtgaaggcggaagcgggaggtggctgggaaggctctgcttcctacaagttgactttcacggcaggggtgcgccattgagttcggacagcggatgctccaggtggcatctcaagcctccagaggtgaagtccccagtggagcctatggctactcttacatgcccagcggggcctatgtctatcccccgccagtcgccaatggaatgtacccctgncctcctggctacccctatccagcgcgccccacctgagttctatccaggagccccgcatgatggacggggccatgggatacgtgcaggcccgcaccacgacctaccctgggcccatggaaactccggtcagcggccccgatgtcccctccantcctgcntngcgaagncaangnccgcagaagcangccgncagcgcctattacaacccaggcaaatcctcacaacgtctacatgcccacagagccagccgccgcacctccctataccc

SEQ ID NO: 557870 - DNA, 387 bp, Homo sapiens
ctgataatgctgtctcatctctcaccctgcctccagtcacactggctttttatcagctcctcgaatctccaagctcccttctacaaggggccttgtatcaaatccaagtgtggaaaggcaattaagcatcataacaattcaatgacttaggattccaacggtattgctaaagggacctgctatataaaccaggaccggattctggatgcattataacaattattcttacattactggggtcacaagaaggtaaaggaaaatggggcagagggacgaaataagaacaaatacaagctaagatcctggtagaagccatgggctgtaagatacaggaacagaggacatgtatgctctcagctggctgaggactgaccacttctccttact

SEQ ID NO: 557871 - DNA, 420 bp, Homo sapiens
acaatgactgacgaataggctcatgatgtccagcttcaatgtacgattgtcaagtcagtctacatgctccacaatgtcatgcaatcagcatcaggtagcatcattgcagcaacacagaggtctaccgtcacgtccaacagtgtgtcagatcagtcagccgtgcagcaatctcagcgtcatctgggtaatcatccatatcagctctcagatgatcgactgtcgctcagagactgtggctcacgagctcgctaagtccagttcatatcaacaagctttacactattcgagctcgtatgctggttccccatcatgatccatacagcatggtcgcgtgtagaccatgaattatgcacagcgtctgggcactctgtctcatgctcatgatctttgctgtatcgcacgtccaggcgtctggatcac

SEQ ID NO: 557872 - DNA, 111 bp, Homo sapiens
tcgctttatcatgttacagctacccaactgggtagtgactaagggtggtgatgattccagccatcaccatcggcccaactgccttcagttgaaaaggtagactagtagact

SEQ ID NO: 557873 - DNA, 81 bp, Homo sapiens
aaatgttgaaccctccccaccaccactttttttttttaaaccagggatgtctgttgaaataaaacattcagtctgacaaaa

SEQ ID NO: 557874 - DNA, 195 bp, Homo sapiens
cggacctggaatcaaagcagcaggtgtagttatatcagataaagtagactttaagcaacaatagtaaaaaaaaaaccaaagaaagtcattacataataattaaaggatcaatccaacaagaggatattacaatcctaaatttacatgccccataactctgtgagctcccagtcttcatacaaccaattactactt

SEQ ID NO: 557875 - DNA, 148 bp, Homo sapiens
tatctgtgtgctccttagatctttatttcgtgatgcgttgcctactcttcttgaaaagcaagaaatttatgtaaaagtactgtatgactttatgtcctatatcaaagcagatgtatattcaagttattaaattttaaaatttttgtca

SEQ ID NO: 557876 - DNA, 349 bp, Homo sapiens
agatccctcctttcctgcctgcctttgtatgatttgttcctggtcaagcccatgtgtgttgagagcttctcagactatccacctttgggtcgctttgctgttcgtgatttgagacaccctgttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttca

SEQ ID NO: 557877 - DNA, 216 bp, Homo sapiens
acccaccgccaggttgtactgagcttgggaagggagccttgctaaaacaccacacttgtgaaatcagaaaaaaaaaaaagcaagtgatggttcttacagggggggacggcgttcctgctggtttaggtcagaaaaaaaacctgagagagattcctaaaacaatgagggctgtaaggggactggtgaaaaaaatccagtggaaatattttctcagga

SEQ ID NO: 557878 - DNA, 1093 bp, Homo sapiens
gcggaagaatgccaaaggttccacacaggagtgggcgagaagggcgggagcctggccccacacctcgtggcccgaccccgtggccccccacaatgccccatgaggtgtctgcggagctgaatgatgttgctcctggacaaaaaccatggagccccagtggctgggagacagctcgctggatcaaatttgaatgaggacgtggaggaggagactgagcgctgggggaagccccactgtggcctccctctccttccgcagtctcctggagctccgcagtgacacctgtgcccatggggctgtgctcttggatctgtgaccagcagacacctgcccggagtggcccaccaggtggtggagcagatggtacatctctgaccagatcaaggccgaggacagggccaaacgtgctgctgggctctgctgttgaaacaccagacatcccaagtgatgagaaggacttctccttaccccgcaacatctcagctggcatccactgggcatcccatgctggggccatcacccatggtcagtgtggcttgagagtgacccccaaggtcaccgagacactcttcattgggagggtgtaccatgagaacccggctgcgaggtgagagcgagaagctgtgagacttgcctgcctccagagcacaaccgagactggcattcaacccgtcctccaagtcccaataccagtcgcctgacaccttcgctggaagaaccgaatttccttgtaagaaactgccgcgcagcgcccacctgcatgcgacacatgtgcgtgcgcttgcgtgtgatgttcccttcttcccggactcccaaccattggaaccttatgctgccggaatccggcgagagcatgctgacaacaccgcgacgccaagcctggatcggaccggttgcccggatacccatgatgcggttgtcacgtctaccgtgcctagcatcggcccctacgtgttgctcgccaaataattgcgcccacaccacagaaacacggtacgcctacactctccatgccacactgtgcgcaacacacatatccacgcgacccccctcactggcgtcacaaaggcaagaacgcataacggcccctcac

SEQ ID NO: 557879 - DNA, 211 bp, Homo sapiens
accagagaccacctctcctgggcttctcagtgtctcgctggcgggctccggcctgacgctggattgacatagcccttggcagggatgtaaacacacctaaccattaccgcagtacagctgcctcacaacctttgggatttccagacatgactgacactgcctgcaagttgttccacaagtttgcaggagatgtttgctcagtagattcacc

SEQ ID NO: 557880 - DNA, 155 bp, Homo sapiens
cggcatctggaccttctgaagaaggtcctactattattttctgtctcatactaaggagtccaatttattgatgcacaagagtaagaacataattgctgagcatgaaattcgtacatatctcctgtgctgcccaggacccataaggtccaggtatg

SEQ ID NO: 557881 - DNA, 139 bp, Homo sapiens
tcgaatcgacggttctcggagagggggatgtgtcagtgtcataggataatagtggagagaaggtcagcagataaacacatgaacaaggtctctgcatcatagaccatgtaaagaattaagtgctgtgctttagataaca

SEQ ID NO: 557882 - DNA, 297 bp, Homo sapiens
tctggagcaagctggggacaagggggagccagcgaagccacgctgctgaacatgctcaacatctcccccttctccttggggcgggtcatccagcaggggttcgacaagggcagcatctacaaccctgaagggctggatatcacagaggaaactctgcattctcgcttccgggagggtgtccgcaaggtggccagggtctgtctgcagatgggctacccaacggtggcatcagtaccccattctatcatcaaggggtacaaacgagtcctggcctggtcggtggagacggattacacc

SEQ ID NO: 557883 - DNA, 270 bp, Homo sapiens
tactagacagtgtagtataacattacacacgtggttcctgtactaacatgtatcccattgagtctgctgcaatttcgaagaatacaaacaaacaaaaaaggcagagaacaatatgaaaacattcgatgcttttattagattatcatctacaatagctggaagacagtactttgtaaacagatagttgtcagattatgcaatgcacatgtagcttatgttttcatttttttctctgccttttttgtgttgtacgtattctcttttccagta

SEQ ID NO: 557884 - DNA, 251 bp, Homo sapiens
gacaattccggtttttccgatcagtgtgctcatgccaggttctccgtcacccgtgggaagatgctttggtagccctcggcgtaaacgatgtttcgggtagaggcgatacccacattgcgcttagcctgaacgccgcgttgcagtgcgacgcgtgtgtagtattcccagagatgctcctggccggccatgcactggatggcagcatatttcttgtcccagacttcggtgatatccagcaggacatcaaggca

SEQ ID NO: 557885 - DNA, 355 bp, Homo sapiens
tattacctttggctgatgatctattctgtaggaagtctgctggaactggggtatctctctgatgatgtgtgatatttaccagagaaaaaacccaacccaaatgccccccccaaaagcaaagaaagtcatagcctgtgttttttaaagggcatggttcaaaattctttcccttcaaatgtgggggcctttgcccttttggttcagttccaataaagaaaagatttgcttttagttttctggcgatgcttgggcattgatgaccattccgggatcctgggttccccccccccatccctcccacgtttatcagcagtttccccagtttaataattgggcatttataatgcccccccca

SEQ ID NO: 557886 - DNA, 105 bp, Homo sapiens
cgtggggagtacggaactgctgccacctctctggaataaggccggtcccagtgggaagatttaacgcaggtcaggtagtgtggagacatcttcagctggacttga

SEQ ID NO: 557887 - DNA, 220 bp, Homo sapiens
gggggggccccccccccctttttttttccccctttaaaaacccgggggggtttccccccccccgttttttttttggggcgggggggggggtctttttttcccccggggcccctttttcccctttgccctttttttgggcccctttttccccttttttttcccaaaaccggggggggggggccccgggtttcccggggttttttcccccccccccccccca

SEQ ID NO: 557888 - DNA, 190 bp, Homo sapiens
gatacacaccatttgttttttgtgagacaccacaagaagatgtgcatgagcttaccagcacacatgaggagagatgggtggcctccatgggtatacatggtgacaagagtcaacaagagcgtgacttggttttcaatgaattcaaacatgggcaaggttctattttgattgttacagatgtggcctccag

SEQ ID NO: 557889 - DNA, 409 bp, Homo sapiens
cgcagctctcactcaggctgattgtacttagatctccagttgtgccacgctgtctctctccgtgcctggtctatttccgagttccggggctgacagcgggttgtaccagtgtgatgagacgctcgatctcagtgggcagtagggacagcatcagcgtcctgcgcttcatgtactaaatgtgcagctgggaacccctgttggttttcttacacatgccttatttcttggacgattgtgcacatgcgcgccggacagcgggtatgtgtcgatccagccttggttgtcttgtttccgatagcctgatgttatctccaggttgctccgggtgtcctgattatctggcggaacaagctggctggcggtcaggtacttcttatttgatcaagctgtggcgggcggcgtaccgaac

SEQ ID NO: 557890 - DNA, 141 bp, Homo sapiens
tttataatcaaacttaatattttcaatacactacagattatatttttcaactatttaaacttagggacaaataacagaggtcgactaaaaatacgtgaatcttttttcaaaattatttcagggggaactcggtcagagggg

SEQ ID NO: 557891 - DNA, 701 bp, Homo sapiens
tgggattggaccttcagcactcttcccggattggaccccccctgaggatgagcctcaggctccctccggcttggccagactcagcctgtcacccccaatgccagccatggcctggtgattccccacacatccttcctgcatcccccgaccctcccccgaccagcttggctcttgcccctgcccggattcttgagcccagccctgcctgtggcccacccctgagtggcccctgcccagcttcggggaagggtcctgaccacagggcatcttggaggctctggctgccttctgccatttaatttgccctttttctttttctcttgcttttaaaggggtggtggccccccccgtttagagatgacccctgggaaccgtgaacgctagagaattgtttttacacacgagtttgtgacccaagtcagagtggatcactggctggctttggcacgccacgggaaatttgtcttagttggagcctgctctgtgctcccccctcccattgctctgtccctctgcctgggctatgggaaatggggaatgcagatggcccagctccccccctgggtattccaaaacggccagacccacacatgttcctccccgcggctcactcgatgcctgcaggcccccgtgtgtgcctccactgattctgacttcaggaaaagtaacaccgagtggccttggcctgttgtcttccccct

SEQ ID NO: 557892 - DNA, 151 bp, Homo sapiens
  misc_feature (12)..(12): n is a, c, g, or t
  misc_feature (25)..(25): n is a, c, g, or t
  misc_feature (110)..(110): n is a, c, g, or t
ctgcactttgcngatttggactctnccttgggccgaccactctgtctcattctccttcccacctacatccatccgtcctggtcacacaaaccactcactgggaaacccanccagctcatccaactgcaaagcctgccaaatcggcaaagtg

SEQ ID NO: 557893 - DNA, 382 bp, Homo sapiens
agatcggaatagcgaggtcaacaatttctctgaggaaaaactctaatgtgcaatatttccttcccaattttttccctttcctgttctggctatgttcactacctgtgctcaccccattccatctctgagagacacacgcatcattagtcttctatctgcatagtttcaacacccaggaaacacaatacgaataaatttaataaagaaataaagaagcaagcagtattcctttaaatcagctgaatttttttaaggataaaaactaaaacaacaattctcgttgtggcttgatccctgacctcgctccaatgggttaagggtcctgtgttgccacaagctgtgggtaggttgtagatgcaactcggatactgtgtagctgttg

SEQ ID NO: 557894 - DNA, 250 bp, Homo sapiens
  misc_feature (115)..(115): n is a, c, g, or t
  misc_feature (224)..(224): n is a, c, g, or t
agcggccgccttttttggggggcaggatcggtggctaacatctgcaatcccagctacttagaggctgaggcagaagcaatgctttaaccttggaggcggcaggttgcattgagcntgagatcatgctagtgcgctccagcctgggcaacagagcgagacttcatctcagaaaataaaaaataggggccaggcacagtggctcatgcctgtaatgccggcacttngggaggccggggcggccgctgggtac

SEQ ID NO: 557895 - DNA, 445 bp, Homo sapiens
gctcgaccaactcctgacaactttgctgttttaagtttcaggctgagaaggggaaggagtcctgcctgattcaatgtaagtaggtttgtgcctcccactgagatatgcatagatgataagataagatggtttcttctggaatccttttagaaaagatcagcggaaatccccagatagagcagtctgtcactgctgttcaaataaccatggtattgtcttccagtgttttcttttctggacttactttgggtttctatagggtattctatttgggcaatctcttcctgcatggtagtaaaacacttacacctacattcttgttagtatttttttaagatcagttcaaaccggatctaaaagaatgcatatagttgtataacaaaatcagtgatttatataatttaagcctaaatatttataaattttggctgggcatgatggctca

SEQ ID NO: 557896 - DNA, 382 bp, Homo sapiens
aggagaccaggctgagatggagacccagtgctgaggtggaaggatcacatgagactgaagtcaaggctgcagtgagccataatcgtgccactgcactccagtctaggacagagagaccctgccttcaaaaaaaaatggccaggtgcagtggctcacatctgtaatctggtactttgggacgccaaggcgggaggatcaactgaggttgggagttccagaccagcctgactaacatggagaaaccccctctctactaaaaatacaaaattagctggacgtggtagcacatgcctgtaatcccagatactcaggaggctgaggcaggagaattacttgatcctgggaggctgagactacaatgagctgatttcacgccactgca

SEQ ID NO: 557897 - DNA, 211 bp, Homo sapiens
gctatcaccttggttactttagttaatgtcttatgcacggttcaggcgggcgtagatactttggaagaaagaaaggaatataaatgactgtacatgacacaatggttataaagtaactagagcttaattgagtactcaagtcaacattactggtataggaactgggagcccagactaaataccaaaccctcactactgacacattatggag

SEQ ID NO: 557898 - DNA, 586 bp, Homo sapiens
ccctcccaaagtactgggattacaggcgtgaccagtgtgcctggtgagttttcttaaagtgagcttaatttctgaactcttagtgatctcatatatgtacataaatctgtgatcccatttcttattgcacccattcaggaacactttatataaatgagtggcttttatattccatattatcagtagtatcatgggtcccattacaggcctattaacatcatacattgtcattagtcttgtgaagaaaaaattatgtacactatatattgtgtacccatggagaatttctctctaaagcagggctaaaaatttgtgggaaaatgttgtgacaaagcataccacagtgactccagatttacctcaatgctaagaattatgtcagttaggacaacacggaacagtcatttggaccctcagcgtagaccaatagatggcttgagagttaatgtagcttaagactttaaaaagttagaatttattctggtaactaaaaattatttgaaaacattatgcctctggttaaatcatgtgctgattacaccatctttctcttacccttgtgtattgaacctattgtccataatca

SEQ ID NO: 557899 - DNA, 492 bp, Homo sapiens
tggcacgtgtgtccactagcctcattctattagaaacaaaggctatctgccaccaacatgtttaaacaaagtagcattcctcatatataaagagtgttagaaatcaataaaaataaagcaacatgtgcaaagaacgtgcatacacttgggacacacaaaagacataggtgggaaattgtaaaagacttgaaaaaagaatttcactgctgggcacggtggctcatgcttataatcccagcactttgggaagccaaggccggtggatcacctgaggtcaggagttcgagaccagcctggccaacatggcaaaatcctttacctactaaaaatacaaagataagccagacgtggtggtgctcgcctataaccccagctactcgggaggatgaggcacgagaatcacttgaacccaggaaactgaggttgcagcgagctaagatcacactactgcactctagccagcctgggtgacagagtaagactccgtctcag

SEQ ID NO: 557900 - DNA, 128 bp, Homo sapiens
tgtgttgcagtgtgtgcactccaccggagctgttgtgtcttcggtttcactgcttgcgcctattgctaccagacaggtgggctgctgttgctcttcatcgccatgggcatcttcactttctctgcggc

SEQ ID NO: 557901 - DNA, 834 bp, Homo sapiens
gccacagaactaataacccgtcgagagcaccgaagcttaaagcaatggaacgggcgtttacttgtggcccacggagacactcggacaacgagatccttgtactcatagagcctgaagctcctccaactcacttagtcagtaatgacgattagtgtcgatgctgcgtcgtgctcaggtcatacacggtagagcagaggatatcgtgactagatggccgtgacagagcagaggcgctggacgggacagatcagacactagatgtgtgaggagtgagcatggaggaatcgctaatagctagtcgatcctgtggcatcaatgaagcgggtagtgccaggatattgtgtacactgggctcattatcccatcgcacaactttccagtacccctagcatgtccgcaaacttctcagtgcctatggtgaggtcagatgcgttccttcaggctgaggactggtttgtgagatgcaaaaagaaggcagcagcagccgtgggagggcaaaaaagcagtaccacagcaaggactacacagagggatgggtggagttccgtgacaagcgcatagccaagagtgtggcggccagtctacacaacacgcctatgggtacccacaggtgcagtcgcctcccattatgacctatggaatctcaagtacttgcaccatttcacctggtcccaccacagcgagcaccttgcctttgagcgccaggtgtgcacacaggcagcacctgagagtggaggtcactcaggccaagtgtgagaccatcttctatcttcaaagtgtgcaatggggacaatgctttcttgctgttgatggggatcttgctcacccagatgg

SEQ ID NO: 557902 - DNA, 170 bp, Homo sapiens
gacagtgagagaggctgtttggatctaagtcaataatggctcttgcaaagaatttctgcaatgtcttgcatgtggttctagaactcccttaaaggcagactataccttgatcgggggaagccagcctatcttgggcctcctttaccgttgcctttcatccactgtgtcct

SEQ ID NO: 557903 - DNA, 487 bp, Homo sapiens
tgttgatgtgaagctgagtgcaggaagaggattgggaggttgctgcagtggctggggagtctatcagattctgctgggagttaagagggggtccaggaggacctcaaggtctccgccttcagtcttgaggacagatagccactgggccactgagggtggcggaacccggcaggcagtcagggaggggggtagcggcccagggttcggcaccaggcagctgcacttgtgtgtggagctgaggccaggagaagagctctgagggagcggtgcagacacagcagaggagcagtgaggggcccacatgggcgagggaaagaccaaagagactgagcacgggcgtcccacagccagaggagggtgcgtggccgccagctgtgcctggcgcttgctcagaggttgcaggcaggtggaccggcttgcggaatgcctgcaatgggcccagggcctcaaggaggggtacggggggcggcttccacatacaccaaga

SEQ ID NO: 557904 - DNA, 374 bp, Homo sapiens
tccgcttatatgcaggaggcaagtgaggctatattgttggcctttatgaagacaccaacctgtgtgctatccatgccagacgtgtaacaatatatgccaaacagacataccagctagcacgccgacatacgtggagaacgtgctataagaatccactaatgatgggaaacatttcattctacaaaaaaaaaaaaaaaaatttctctatcttccggataatgggtacgtcctgaacgttagatatttttattccatggggatcaaacggtacctaagatactttgatggcgagtggaaaaataggggacagaaactcggtatgggcagtttccccattaacatacgtgtgtgactcccacctctaacctgcggag

SEQ ID NO: 557905 - DNA, 93 bp, Homo sapiens
  misc_feature (48)..(48): n is a, c, g, or t
  misc_feature (85)..(85): n is a, c, g, or t
aaaatggtatacactcacgttaactattaagggtcatttcgcctctgnattgctgaatgacaagtctctgtggacagacatcccngtgaattt

SEQ ID NO: 557906 - DNA, 412 bp, Homo sapiens
ttactgtgttttaatccaaaatttgtccttaaccttccatacctggttttccagcccaaggcttcactcagtactcggtggagaagagcaaaccatctgcccacatctgacctggctgaccagggctttcctgcaggggagggaagattctagcaccattccacttgtggatgtctctgagtggaaaatgatcttctctgagctttagtgactaacctgagggcctccattagattgtagttgtggcccacttttcttcactggattcgcaggcaatgaatgtgaaagattcccacaaaacaatagaatggatgcaaactaatcgtattatttatctatttattcatttttcagacagagcctcgtgcctgttgcccaggctggactctgtttccaaataaccacacacgta

SEQ ID NO: 557907 - DNA, 1011 bp, Homo sapiens
gtgaacgcgccgcagatggggttcctggtgaagagtcccggttctctccttgaatccactcgccagcccaggcgccctctgacgacgcagcctgcgacacccgcccctctcctgtgcgaggaacttgctactaccagcacatgccctaccaatatccagcactgaccccggagcaaagaaggagctgtctgacatcgctcaccggatctgtggctaccctggccaagggcatcctgggctgcagattgagtccactgtggaccattgtcaaagcggctgcgagtcaacattgggaccgagaacaccgaggagaacctggcgcttctaccgtctagattgcttgtgactagctgtcgaccggcgtgaaccccctgcatatgggtggtgtcgatcctcttccatgacgacacatctaccaggaaggccgtgattgatgggctgtccgcttaccccctaagttgatcataagtcccaagggctgagtgttggtgagagcatcgacaggcagacgacaggtggcgtggtccccccctggctagggacaaatggggcgagaataaacccaaccaaagggtatggcatggtgctgtcttgaggcgcgtgtgcccagtttacaacgaaggcacggagactgagtaccgccagaagtggccgtaggttgtgctggaagattgggggaacaacagccgcgcctcaagtacctcgcccagttgacttgggacaaattgcccatttggttccgtgggggccgcttattgccaaggtattcctgggccagcgccaaatgtcgcgtttgttgcccacttcgggtggcgcacggagaatctccccgcgaagggcggcccgtgtttgacatccttcgcagtatctgcccggaacggagctggtgctgctaaaggggcgaattagacacgaattcacctggaacgcctttcgtaagcccacccggtcccccggcatgtggcacaacactttcaagagggatcatgagaaccacacactcgacaatgc

SEQ ID NO: 557908 - DNA, 430 bp, Homo sapiens
  misc_feature (304)..(304): n is a, c, g, or t
  misc_feature (371)..(371): n is a, c, g, or t
cacgaggccgacgacacccacgcgcaggacgcggtgatctatgcgctcgggctgatcggcaaccagtaccgattcggcggtcgcaacccggacagcggggtggactgcagtggcatggtgagctggatcttcgaacaggtggcgggcatacgcctgccgcacaacgcggcgcagatcgcccgcctggcgcgaccggtcgatcgcgcgtcgctgcagccgggcgatctggtgttcttcaacaccagcggcaagccgcattcacatatgggcatctacgccggcgagggacgcttcatccacgcancgagcacgcgcggcaagtatgtgcgcaccgatgcgctggacagcggctggttcgccgcgcgcatcancggactgcgcacgctgcgtcgcgacgtctgaaggaaatcctgatggggctcgcctgacg

SEQ ID NO: 557909 - DNA, 397 bp, Homo sapiens
agtagcagcggagcggtgaggcccacaggtgccagcggtgagaacggcacgtagatgcccagggcgatcacgatgcaggtcatcatcaacaccggccaggcggcgtgctctggaagaacgggatcttgcgggcgcgcagcatatgcaccaccagggttggcgagagcagcccttcgataaaccagccggactggaacagcgtctgcatttccacactgtgggccgagaacacgtaccacatcagcgcaaaggtggtgatgtcgaagatcgacgaggtcggcccgatccagatcatgaagcggccgatgtttttcgcatcccacttgcgtggcttggccaggtattccttgtccatcttgtcccaaggcagggccagtggggagctggtggaagggag

SEQ ID NO: 557910 - DNA, 780 bp, Homo sapiens
  misc_feature (10)..(10): n is a, c, g, or t
  misc_feature (14)..(14): n is a, c, g, or t
  misc_feature (26)..(26): n is a, c, g, or t
  misc_feature (38)..(38): n is a, c, g, or t
  misc_feature (58)..(58): n is a, c, g, or t
  misc_feature (64)..(64): n is a, c, g, or t
  misc_feature (69)..(69): n is a, c, g, or t
  misc_feature (71)..(71): n is a, c, g, or t
  misc_feature (86)..(86): n is a, c, g, or t
  misc_feature (90)..(90): n is a, c, g, or t
  misc_feature (92)..(92): n is a, c, g, or t
  misc_feature (103)..(105): n is a, c, g, or t
  misc_feature (109)..(109): n is a, c, g, or t
  misc_feature (123)..(123): n is a, c, g, or t
  misc_feature (127)..(127): n is a, c, g, or t
  misc_feature (130)..(131): n is a, c, g, or t
  misc_feature (159)..(159): n is a, c, g, or t
  misc_feature (205)..(205): n is a, c, g, or t
  misc_feature (295)..(295): n is a, c, g, or t
  misc_feature (319)..(319): n is a, c, g, or t
  misc_feature (353)..(353): n is a, c, g, or t
  misc_feature (441)..(441): n is a, c, g, or t
  misc_feature (478)..(478): n is a, c, g, or t
  misc_feature (495)..(495): n is a, c, g, or t
  misc_feature (528)..(528): n is a, c, g, or t
  misc_feature (552)..(552): n is a, c, g, or t
  misc_feature (584)..(584): n is a, c, g, or t
  misc_feature (630)..(630): n is a, c, g, or t
  misc_feature (642)..(642): n is a, c, g, or t
  misc_feature (650)..(650): n is a, c, g, or t
  misc_feature (661)..(661): n is a, c, g, or t
  misc_feature (665)..(665): n is a, c, g, or t
  misc_feature (679)..(679): n is a, c, g, or t
  misc_feature (747)..(747): n is a, c, g, or t
gagcgtcgcntttnccgatccgccgnccgtccagcacncgccgccagctcaccatggntgatgntatcncngcgctcgtcgtcganaacngntccggcatgtnnnaggncggcttcgcgggcnacgntgnnccccgggcacgtctttccctccatcgtngggcgccccaggcaccagggcgtgatggtgggcatgggttacgaangatttctattttcgagcgatcgagagcccatgagcaagatgaggcatcctcaccctgaagtagccccatcgagcacggcatcgttaccanctgggacgacatggagaaaatctnggcaccacaccttctacaatgagctgcgtgtggntcccgaggagcaccccgtgctgctgatcgaggcctcccctgaaccccaaggtcgagactgcgatgaagatagactcagatacatagtntggagacctctcaaacaccccgagcgagtgtagcgtngactatccatggctgtngctagtccctgctaccgctctctcggccgatanccactggtcatcggtgtatggganctccggctgacggtgggtcacccaacacctgntgccccactctatcgagggggatagtgcccctccccccaatgccantccctggcggtntgggaccntggactggggncggngaccctgaactganctaccctcaatgaaagaatccctcacccgagccgcgggcctacatgctttcacccacccatcgggccngagccggtgaaattccgttgccgctcaccattt

SEQ ID NO: 557911 - DNA, 164 bp, Homo sapiens
ccgcaccggcggcaccgtccacgtggtggtcaacaaccaggtcggcttcaccaccccgccctcggatgcgcggtcgatgacgtactccaccgacatggctaaggccatccaggccccggtgttccacgtcaacgcagatgacccggagtcggtggcacgtgtgg

SEQ ID NO: 557912 - DNA, 1890 bp, Homo sapiens
attttttttttttaactttggtattttaaggtagagacggcggtttcaccaggtgggccaggcgggtctccaattccggaccccaagggatccaccttataggccgtggccgccaacatttcgtgaaccgtggtctttttctcgtggtcagtggtatttcaaaggtccagcgcgtggaacactccaaatttacagggtccctttacaggttatttgggtcgcggtgggtctattcgagtctcttgtgggtccacagtgtgtgcgccggagtcccctgtgtgtgtgaaacggtggagagtgctgtggtgtgtgtgtgaggacaaacaggggggactgtgagaacacgctctacaaggtgacaggggggcccagcagacaatcacacaagagggaaaaagagaaacacagcaagacacgacgatggacaccaccacgccgcagaaaccacaccaataccacacataacaccgagggccaaccacaaatcacgacacaacatcacaataccagagaagtgtaatgcagcccgacgggagaaaacaaaacagacggagaaaaaaaaagagagaacacaacgagagaaaggacacacacaaagagaacaagagaaatataagacaacacaagaaagccagcacagccgacgaaagggaacaggaggacagcagcaggtaatacaaacggcaggccagcagcaccaatcaagcaacagaagaagcaccaaaacaagaagcccacaacagcacacgagaagacactaagcacagaaagagacgaaagagaaataagagacagaaccaacaaaacgactcaactaatcgctagacgacacaacacagcacacaagagcagccacaccaagacgaaacaacaaacgaagtaggggaagagagacgaccgagccaaacaatagacaaaaacaaacacaacggagaaacacgagaacgaagaccagcggcggaaaccacatgcactatacgagcaaacaaatactcaacacaagaagaagacaacaaaaaacgccccaccaaaaagactgacggagacacaaaaacgcgccaacaatagaacaaccacaacagacgcacacaagagcgaacgaaaacagggagggccaacagaacgcaccacactcaacggtgagagaacacgacaactagaaaaaagaaccggacaacaaacaccagcacaacacaaacacgaccagcaaaaagacagaaaaacgagaaccaacgaagaagcagagcagaacaaaaaccagacaacaaaacaaacaaacacagccaagagcaaacaaaagaaacacaagcacgaaatcgtggagaagcatatagagaacacaaacccttagcagcgccacgaagacgagacaagaaaaaaagcacaaaaacacaagccagactaaacacaagcagacaagagccagagacgagctgaactgccgagagataaaaaaaacaccagcaggggcaagaagctgagaaccgagagaaaaaaacattcacgggacgaagaacaacgaggcaaacaaaggcacgagagtaaacaagaacagcaaaagagaagaacaaaacaaaagagagaatagatatgtcacacagcacaaacaacgcagacacagtagacgagagacgtctataagatgaggagaacaggataaacagaagaaagctgtagcacagaagcaaagtagagaacagaaatagctataaaagttattacgatgataacatgcgaacagaacagaagaatggtacaataatgtcagtcaaatagctacagaaaagaacaaaaaagacaaaacaaagcaataaccaatatatactcgcagtgtgacagagacgataagagcgacgagcacgactacgaacaagcgcaacgttgagtaag

SEQ ID NO: 557913 - DNA, 112 bp, Homo sapiens
tatttcgagtgacgcgagacatccaagtgttgaatttcttatcccaaatgctgtatttgggcagaactatggtgtcatggcagaagcctcactttacaattgatcctgtcta

SEQ ID NO: 557914 - DNA, 466 bp, Homo sapiens
acagtgttgacgtccatcgtggctggcctgtccccggaagcggcccatgacacggtgcagcgcgtcgctgataacctggttgaatactttgccggccgccccgtgcttacaccggtggccttgccagcgcccgcaaaatgaccaatcaggcacgctgatcacccttcaacacgctaacctattaaaccgccccgaccttgtcgctgggcggctatgcgcattagattaggaaatagtccaaggcctttagaataagcagaagggataagcatggcgctgaacgaccaatcgacccagattcgcccaggcgaagaacttgatgccagcctgatcgatccctacctcaaagctcatatttcgggcctgagcggtaccgtcaaaatcagccaggatttagtgtagggcaccgatcactcggtctttgtcgagaacacttttgactgtatcaaacttaaaagttagcaaa

SEQ ID NO: 557915 - DNA, 930 bp, Homo sapiens
  misc_feature (192)..(192): n is a, c, g, or t
gttctgccatatactagccatatccacatctgtgtgtcagggcccatcctgttcggcagcttcatcatgccctgatgcctcatgggataggtggacgtgcctcaatcagtgagatagtggccactgtgtagggggcgctcggtgattaccgggaggacggagtcatgctttgctaacaatcactagcccctngggggatcggcgtggtgagtcatcgaagagatacatgcatcagctcgctttactcgggtgttgcatacaatatagactactcactgtcatcgcgtatacagttccgcagtaggcgatgcacctgagcgacagtgaatctagttatctgggtaactgggaggacgaaaaaaaaatagattctatccgacgaagtagtagcaacctcatccagtgtggtgattcaagttctctgatatggatcgactagctgggtagatatgcatagaaatcttgagagtctgtgaagtgcattcgctaatgtagtggagacgagtatcccgcaaaagccatgtgcttcactgtgttccacaggacatgctgggtgtatgacaactaacattgcactgtgtcacatctgaggtgcgactatgtaaaccgctctactagcatattttgagaattagggctgtggggacggaaatgctaagtagatgagcaattccattatccggtagagccactatatccgctacaagcccggtacgcgatcatctgccgagaatgactagggtatgggattgcctgacatatcttggctgcaaagctatgcatctgagtttgggtcccgagtacccccgtgtggttggcccttggcgccttcggaagacgagttgcaaccgcccagctgatatcggtccggaggcttgtattgccactgggacttggtttcctgcccccaaaggacttcggattgccaag

SEQ ID NO: 557916 - DNA, 661 bp, Homo sapiens
tgcctgtttctaaatacccatttcctttaacagtccttgtacccgtgcatctcctgttcttgaactttatacagggtccatagtctctcattcacaaatgttgaacccaaaatatcccaacccgaattttttttccttaccttaatgcaaaaggtaatttagcaacatatctgccttgaactgatgtaaagctattacaagtctcatttgatcccacttagatatattgtgctgaaaagtacaagtgtagtatctagtggtattaataatatatgtcccatattatctaaaatgtgaaatagcgtgaatccaacgcacagcgtgggttaacatacatatatactagcgctgcactctgaaaccttagtataacaaccccgagtaccaatagtgtccccagagggtctgcatgttggattctatataccatcctctaccaaaagaacacagggctctctggaggagaagtcgattccagggcagggacagggataatacaagagcctggtggtgctagaaagaaaggaagtgctcaacacaaaaagccagaatggagaatgtttatggggcacaagaatccaactgaaggattggccacaggtgtaagacctggagccacacaataaatggtgataatattgctcataacacaatactgact

SEQ ID NO: 557917 - DNA, 869 bp, Homo sapiens
gacagagccattgcagtgcgatgcgggcctgcccagtgtccctggtccccctgctgccagtatgaaggtcccaccaatgcctctttgctccaagccatgtggcgtaactcgtcatggttgggaacagccaaggtgagtgaattctcgtgtggctcacacccccatgagaaagccactggcctccggcctggtgcggcggatggctcacgctatgtcctgtcccaacacttttgggcgaggcccaggcctgggtggactcacagagtgtcacgcgatgttcacatgcaatccagtcctgcgccaccgaagtgcgttgacaatcctcccagcgcccattcgttaacctatcatatagcataagcataattagcaaaacacacaacttcaatgacaagacgcttgttgacggagtggcaaagcgcttgcttccagtctccaagggccctaggcatatggcgtgaagggtgcgttgcagccgtgactgtgtgcattacattaccagccgttggaaactcccaatggctgaggtgcgcgaagagagcgtgcagagtgggcttgcacgtcggcctatcagttcgttcggcgggacgcaaggattagccaagcttaccggaagcccagtatggtgctggcccgatgcaatgtcatatgggaggcaacctacgcgtatcgttacagagataaagacacacaagaaaaaagaagtgccgtacgcctaaggttgagaggaccgatacggagagcacacgcatcaacgagcatcgggatgtcgcacccctacacaatcaaacctgtacaggaacagaaaagcgacaaggtagataccacggcatgagaataacaacagcgagagggggaagtacacacga

SEQ ID NO: 557918 - DNA, 890 bp, Homo sapiens
aaaacaggaaatcgatgagttggaagcaattgtgagagctgggatgtctgcataatactgtccttacagtaagttgaacatcatctgacaaaatgtgggcctttgaccgatatgtggcactgcatcccaccttgccactaagcacttacaccagttaggatgtgacgtaagcttaggtgagcacaacatttccaggggagctcttcaacattaaggcagtatgagtatcatggcttgggtcctgtcggtttattatctttcggtccagggaatggattgaatggtgttccattgcctcttctcacattcttcatgtaattaatttcgtttgattgccctctgtggaaaggattaacaataagttatcacgtcatgacaaagtgtgtatgtgtggttccagatctgtgtacactttgagaaggataatggtggaacatttgacgtgggtttcccttgtccctttccatatttaaacctattttccaaattcatctgctcagctcacattttttcagtggtgcccttctcttatctgccatgtccatagccataatgccaccatcatagagatcaggcgggttaagaaaggatggtaggtagcacagcggacagtctttgatcctcatgtagaatatggggtatgaaatacacggggaaggaggattcgacccctctcacctacatggtctcgtaacagctgggtgcctaagtgtatgcattgaagcctaacaattcgttcaccttaagagggcatattcgaaattgggaacattcactacgcaggacctgctttgccagctaaccggacggggtaatcccccgggatcgtcgaagtcgctgccacccactgcaggcttaaaaacgacaaagccctagagattgtctcaccc

SEQ ID NO: 557919 - DNA, 957 bp, Homo sapiens
  misc_feature (25)..(25): n is a, c, g, or t
  misc_feature (28)..(28): n is a, c, g, or t
  misc_feature (282)..(282): n is a, c, g, or t
  misc_feature (447)..(447): n is a, c, g, or t
  misc_feature (520)..(520): n is a, c, g, or t
  misc_feature (526)..(526): n is a, c, g, or t
  misc_feature (548)..(548): n is a, c, g, or t
  misc_feature (819)..(819): n is a, c, g, or t
  misc_feature (921)..(921): n is a, c, g, or t
gggccggtgaggcgccggcggccangcngcggaaggcgcgggccgagcagagccgggcgttggagcccgcgcgcgcatggaggcgttgccggcagccccctgagggcagcggggagacaagacccggcgactcgcgcatcctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctatttncacttgtccactagaagtcattaagacacggttgcagtcttcaagattagctctccggacagtctactatcctcaggttcatctggggaccattagtggagctggaatggtgagaccaacatccgtgacacctggactctttcaggttctgaagcggtgccagtntcccgggtgacacctttcttctaaggaacatgcagtgctttggacataaggaaactgaagacaggtcgatctnggaganagagggaccaaagtcacttttnagaggcttgggtccaaatttggttggagtgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaagncattcgtggcttctatagaggattaactgcctcgtatgctggaatttcgaaactataatctgctttgctatttatgaaagttaaagaagtatctgaaaaagncccattagctcttctgcaatgggactgagaaaattc

SEQ ID NO: 557920 - DNA, 879 bp, Homo sapiens
  misc_feature (25)..(25): n is a, c, g, or t
  misc_feature (28)..(28): n is a, c, g, or t
  misc_feature (282)..(282): n is a, c, g, or t
  misc_feature (442)..(442): n is a, c, g, or t
  misc_feature (448)..(448): n is a, c, g, or t
  misc_feature (470)..(470): n is a, c, g, or t
  misc_feature (741)..(741): n is a, c, g, or t
  misc_feature (843)..(843): n is a, c, g, or t
gggccggtgaggcgccggcggccangcngcggaaggcgcgggccgagcagagccgggcgttggagcccgcgcgcgcatggaggcgttgccggcagccccctgagggcagcggggagacaagacccggcgactcgcgcatcctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctatttncacttgtccactagaagtcattaagacacggttgcagtcttcaagattagctctccggacagtctactatcctcaggttcatctggggaccattagtggagctggaatggtgagaccaacatccgtgacacctggactctttcaggttctgaaggatctnggaganagagggaccaaagtcacttttnagaggcttgggtccaaatttggttggagtgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaagncattcgtggcttctatagaggattaactgcctcgtatgctggaatttcgaaactataatctgctttgctatttatgaaagttaaagaagtatctgaaaaagncccattagctcttctgcaatgggactgagaaaattc

SEQ ID NO: 557921 - DNA, 372 bp, Homo sapiens
attttgatcacacaccacaaatactatgggtgatcgtggggttgtattacaaccccacgatcactgagctggtgaaggaggatgtcctttcatccttccgcttgctttctccttcccttttcctggaatattttggtggaatggtgaattagcacttattgtctattgcaactcccttctagagtgtcttcttatgtttcaaagactggaaagctaaaaacgattttccccagatttccttgcagctatgcttttgtatgcagtgaatgctcaacccctcaggtacacaagtgatgatttggaaggcagatgtaaagcaaaatggagaggtgttgcttctgttgttccttctgggtgatcgtggggttgtaa

SEQ ID NO: 557922 - DNA, 205 bp, Homo sapiens
aactcatgctccatctgttccctcccaccctcgaatgtgcagatggactcaggtggcctgtcctcatcacgcaatggaatgctgtagagtcacaccatcctccatgtctggtcaccctccccatgacactcccttctacggtgcctctgtgttatctcgcctctaataaaacactttggcacagtgggatcttgttacctgtgga

SEQ ID NO: 557923 - DNA, 904 bp, Homo sapiens
  misc_feature (763)..(763): n is a, c, g, or t
gaaacgagcagagtgacagtgctggagcttgccgtctggtgggcgcacccgttgtgtcgcgaaaggctttaggattagagagcttctcaggcggttgttgcggtaagtgtcacacccagtgggaaggaaccaccattaggtggcattgcgccccgcctgcggttggtcctcccccttggggggttgccagaatatttggtctagggcatgtcccaccaagggctttgttccggggggggcacaccagccccctcacctggggggaaccttctctgtctaagacagcggtggccgcaacgtagccccccggacccccttgcccagcccggtccccctgggaaagtatttttcttttccgggcgtctacaacacgcgcggtcacctccggaacctggagccacacgactggggtcccctccagtaacaaaggcgcccacagtctcccggtttttgcaagggagtgtagtttccgaccagccagtgtaccagcaagggggctcgctcagaaccacaagggcggtgtcaattcggggcttttcacacgcaagcaccgcgtcctcgctccgatgtcccccctccggggccaggaattcttctcagtcgtctcgctcccctgtccccacacgctgtttataaatgtgcccgtctttgacccttgattcatcagcgcacttacaagggccccgcagatgggcgcaaggtactctctctgatcgccggtgtcgtgatccagggtgcccgatggtccattcttcaagcggcngagcaatcgcttctctttgggcagtgtgctggcgccccatggggcccgttagttcctcgatccccgccaccccgaggggttctttttttttggggagacccctctccaccccaaaggaaccaaaaaacaaaccacaaaaca

SEQ ID NO: 557924 - DNA, 734 bp, Homo sapiens
ctgctaggtacgaggccgggtggtgtacatattatctactgctgtcgccttctctgccttatctcgaccttatctcgctctgctgctctgcagtgtgacgagtcctgaatcctcttcccacccagcccgcgcctttcttcttttgcctgcgctgttctatttctccttcggccgccgccgccactgctgcacacagctggtgtatggtgcctgcgcttttacccccaatgtctgttccctgcagcctatggcccagtgcctgccttgtggtatttcttgctcaatggtaaccacatccctctttaaaaattcctgcctgaaaaagagaagacgctttaccctgactctttgtgtgcctgttatctcactgtgctgaactttcttgaccaatgtatacaactacccatgagtgtgcctatgtgatgaatgttgcttgtactagatgatgcagttctgacttcaactgctgagccaccttgtggaacctagctgatgatcgtggggtggttccatctcccaacttgtccatttttgtttgcatattctaatgtgacccagacatacggcttggttggcccgtctcttgtctttcctggtttatgactttcggctttgtggaatacggctgagatgacatgtgatttatttgatgatgcaaactactccgatggcctgttggctgacatgaacaaaccttgtcaatgttattgatacctattgttatgaacataccc

SEQ ID NO: 557925 - DNA, 156 bp, Homo sapiens
aaacatgcacagcaagcaccacaccaagcaaagcacaacattcttctttttgtgcgttctccttacaatataacacagctctcacttcctcatgcatgcttcgtcatcaacatctcacattccatgatccctactcctgtatcatggcatgttctc

SEQ ID NO: 557926 - DNA, 288 bp, Homo sapiens
cctgatttgcctgggagtgatagtgaatgcctgtgagggaagctgaggctggaggatcacttgagcccaggaggtgggccgtgtttgcaccactgcactccagcttggatgacaaagtgagaccgtctctcaaaaaaaaaaaaaaactttaaagcccatatttaatatgcaatatgtgggatagtatatcctttgaaagcccttaaattttaaaaatttagatttcagatcaaagtcttgcaaaggggccagactaggtgcctcatgcctgaaaccccagcaatgcca

SEQ ID NO: 557927 - DNA, 240 bp, Homo sapiens
gtccaccttcattgacagcgacctctgtatcggcatctgcagagacggtgcctcggagtacaatcagtcatctctgtcagattccgtatgccccatgaaactgtgaaagtggagcggttaacgatgcaatcagcttgggtcacccctatgtgccatgctgacggcgaaatggcgactatcagggggtgtggtgccagagggaagggccctgctggtgtgtggacgcccagagcaaggaga

SEQ ID NO: 557928 - DNA, 81 bp, Homo sapiens
accgaggacacggccatttattactgttgtagacagtgggacgatttttggactggttacttggactactggggccaggga

SEQ ID NO: 557929 - DNA, 112 bp, Homo sapiens
accccccccacccagcggatgggaacgctccaaattttcggcccctaaaaagttaaaggttacaaatttaaaaaacctccaacacacacctggtggatggctagccctataa

SEQ ID NO: 557930 - DNA, 220 bp, Homo sapiens
tgaggatcctgcagtgcgaatatgtggatcttaaactagccaacatgaactcattctgattgaccagcacacaaaaggcttttcatcacagtccaaaatacccccacagacgattccggatgtgaagtagccagatgttgaggtcctgggctgccgtggttacacgtggtttgcgactgcgaggttggtcagatctactgcccaattctctaaatcgaca

SEQ ID NO: 557931 - DNA, 268 bp, Homo sapiens
  misc_feature (111)..(111): n is a, c, g, or t
  misc_feature (228)..(228): n is a, c, g, or t
  misc_feature (247)..(247): n is a, c, g, or t
cgggaagatggaggggtctttgggggcctttgggaacatggagtcctattctgttccgcctgggcctcggtggcggcttgcacgcccgagatgacggccgctgcctagganggcgcagggcgattgcgcgtgtcctgctcctcttaggcccgggaccgcgggatgggtgtcggcgtgaccaggcctgagctccctgtctctcctcagtgacatcgtctttaaaccctngcgtggcaatccctgacgnaccgccgtgatgcccagggaa

SEQ ID NO: 557932 - DNA, 107 bp, Homo sapiens
agaactaactttgacttgtaccctgggcaactctgctggcctcagtgtagctacaaggtgagagtgtccatccctgcacctgctcctccaatagccaccaatgcgcc

SEQ ID NO: 557933 - DNA, 140 bp, Homo sapiens
cataatagcatggacgtacctcggtttatgtactatctggcctgtagcgcctgtatgaagaaagtaattaagggagtgatggggtggcagtgcgagagcaacagtcgtagtagtaaatattggtggccagggcccgagag

SEQ ID NO: 557934 - DNA, 401 bp, Homo sapiens
agggcatccatcgtagcacttagaaaaatgatcacttcttttttggctttgtggtggcatgtgtgtgtgtgtatttgtatatacacacatatatatataaatacacagacacacatatatacaaacacacgcattcattttcgtccacagttcctggctcataactcccacagcccttgttacactcttttgttacaacattgggtgtgtcaggcctcaggagacaatcactctaacctcctgcccttccttttacctgcccaagacaggactctaatcttccctacctttctgatggtgggtcataaaactcattccagagacggtcccaccccacctttgtcatacaagcctcaaaaggccttccagcctgggcaacataatgagaccttgtctctacc

SEQ ID NO: 557935 - DNA, 257 bp, Homo sapiens
ctcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagag

SEQ ID NO: 557936 - DNA, 125 bp, Homo sapiens
tgccatcatacaatcagtacaaggggattctaacttggtgaccaagaaagaagaaatttacccgttatacaatgtctcctcgttaagaaaacatggagaacattactcgtgaaataaaaaaggta

SEQ ID NO: 557937 - DNA, 104 bp, Homo sapiens
gggaactcggcaaatcttaccccgtctgtttaccaaaaacatcacctgtagcatcaccagttattagagggcaccgcctgcccaggtgacacatgttctaacgg

SEQ ID NO: 557938 - DNA, 1681 bp, Homo sapiens
  misc_feature (352)..(352): n is a, c, g, or t
gtgtgtcagtgctggtgtgtcggggtgtgtctgtgacgtcgtttgggagtgtgtggctctcttcgcaggtggtgctgatgatagtctcctggaatataatccacaccccgtggggttgccaagacaacaagcacacccattttttggggcggaccacccttttgggacccctctcgagagggagttctccaccacacagtgggttggtgctccacacgaaaatgacgcccacggcgcctctattgtttatacagctgcgtcgcgcgcctcctcgcgcgtaacattatgttacccgcgggggctccttataaagggggtatgccccgatggacgcaccttgtgggtgtggccngaaaaaatattcttccggcgcaccatgagtggccttctgggtgggttcccccgcccacattggggggccccatgccctgcggccgccccccgcgcgcccccgggtgggggtttacccccgcggtgttgttgtggttgtaaaggcgagccacatggtccctggtgtgggcgcccccccaaacggtggtgtgtcgctgttttttttgtgcccgcaagagggggttccccccctcggaattggtcccccaccacgagaatttgttcgccgcaccactttgtggtgggaacacactcctgggggtgccgcgtgtatattaagaggcgccaccacaacaagatggggggatgagtaaagattttttcccgccgctctttgtgtggggagccacaacacactacgaggttgttgtcagagaaatgtagtgaattaatataggtgtgacccccaacccttgtgtgccctctctgtataagccccccccgtggaggcgccttgttctcccgcaggaatgtgtggtgcgcccccacatataggagaccacacatgtgtgtagtataaaagagttttgtgtgtgcagcacacacaaagatgtggcgtcttccccacatattatctcccgcgcgaggtgttgctggggacagttactgcaacacacaccccgggttgtcttcacgacggggttctactactctctccgacttttctcacacacagcagagtagtgtgtgtgtgtctccctggtgtgtctgtgtggggcgctgatcacactggagggcgtctccacacacacactgtggccactattttctgagagagggtgtcccctcttgtggtgggatatagtctctctctcagggcgccacactgtgttgggacacacaaggggtgtatcacacacatttgggcgccacagtgtgatttcacattgtgccacttcccgcacccacacagctctgcgcagagacacacacaggagcgcacactgtggggttttgaaggacccctctgcccacaggggccacacagtttcacacagtgttttcctctggccgcccacaggaagagttccaccacttcttcacaaagaaatgtggggctttcaccccacagtgttcacaaggctgagtgagatttgaaaacacactcggtgggctgagaaaaccggcttcacttcccacgatggctctgttggggtgccacagtgacactccccccttggggcccttctggagacacaatggccgggccctgcacactcactgagagggctttcccaattttgctgccccccttttaaaactcccccataaattttacttcccgtcccca

SEQ ID NO: 557939 - DNA, 324 bp, Homo sapiens
gtgctctgtggttctgcgcgtgcagagagggagagaatgagagggcagtgaatgacagtgacatggatggaagagtgggaaggagctggcctggctcagccctaggctgtccctgcagccagggtgtccgggcgctggccagtcagagaaagggggccatggactgttgtggcaaatagggagacaaggagacagaccctgcagtcctactacagtctggagtggggtcctaagaagaagggtcccaactcaacccctgtcagagtccactgatggggtgggggctgacccctgccattcgattgtcatactcctgggaaaccc

SEQ ID NO: 557940 - DNA, 497 bp, Homo sapiens
  misc_feature (183)..(183): n is a, c, g, or t
  misc_feature (294)..(294): n is a, c, g, or t
  misc_feature (310)..(310): n is a, c, g, or t
  misc_feature (398)..(398): n is a, c, g, or t
  misc_feature (442)..(442): n is a, c, g, or t
  misc_feature (471)..(471): n is a, c, g, or t
  misc_feature (489)..(489): n is a, c, g, or t
cctagatcttgacatcactcactattatcactttcggtcttctctaaaacaacaacttgaatgctatggcaggaaagggctacaaatatacattggttaaccaagcagaatacacagatatttggctttacaacttgcaccttaaaataccagtatacgtagctaggttcatatagatgtcantagcaatattagggctatgtgcccaagctatgcatagacagtttacatttttcaagacctacatactagaaagggctatgtgtgatatgaactgggcaacatacattcctngtgaagcccatctcangttacaacgcaaagtgtgttaacgttccatattctggcaaaggaattttggactgggcaaaacttccacaatctggatgcaattgtcnttaagcaagtttttaacacaaagtggtttccgcagtctactctngccattctggccgagtaggtgatgctcanaagatcttgtggggtacncgagctcg

SEQ ID NO: 557941 - DNA, 293 bp, Homo sapiens
tagcgacggtggacgcatgttattttactcctacgaatatgattacaaagtgactttttgctcatgcttggattgagtgtgtacccggagactagggggaatcagtgaacaaatgccccctataatggcgaacactgctcctatagataaagacatacgttggcagtgtgcgcctacatactatgtatcatgtactacaatgtctcgggaggcacattcaatagtacacatgcccgttagacctcctacggtgacataggacgattttataccccagagctcataatatttgc

SEQ ID NO: 557942 - DNA, 164 bp, Homo sapiens
  misc_feature (27)..(27): n is a, c, g, or t
  misc_feature (43)..(44): n is a, c, g, or t
  misc_feature (51)..(51): n is a, c, g, or t
aaggatcccgtgcaagcggcttgtgtntgggtacgggtggatnngtggggngagaaggtggataggtgggaaaggatgctgtggggatgtggtgaggcgagatgtcggtgtggtaggcgcgcctctttacccctcccaccctcaactatacacaagccgcttca

SEQ ID NO: 557943 - DNA, 177 bp, Homo sapiens
aggcggatctggcccagcacctcaacgaggtgtcgcgtccggcgctggtgcagctgcgcgacggctggccgcgctcgagacctgggacgccgcggcgatcaacggcgcgatcaaggccgtcatcggcgagctgaagatcaagatgccgcagctggccatcccgctgcgtgtcctggt

SEQ ID NO: 557944 - DNA, 428 bp, Homo sapiens
tctagaggatcgctcgtaacgagccacccaatgctgaaataagcagcgcctgcctgagcagctgtgaactgtaccttgggaggtcacactttctctggaaagagccgcgacatgagcttgctggaggagaacgtccacgcagttcttgcaagcaggtggacgccggtgacccagccgtggaagcctgtgagaaccggcggaaggtgctctaccagcgtgcacccaggaatattcaccggcatgtgatcctctctgagatcaaggaagccgtcggcgctcgttacggaacagcgcctcctaacactcctccgtaacgaggccagccatcatttaaagaaagcgtaacagctcactggtcaagcgatcctgcgcggaaaatgtaacggggctcaagccgttcgccgaaggtatatggggcgccgttagga

SEQ ID NO: 557945 - DNA, 143 bp, Homo sapiens
gcatgcttccagagcagcaggtgaacacagggcagagggagctggaacccgagggccaggaagctgcattccagaacacccctaatgagggtgtgagaagtgccttctccttccccaggatggactcttctcggctcaggctc

SEQ ID NO: 557946 - DNA, 250 bp, Homo sapiens
  misc_feature (68)..(68): n is a, c, g, or t
  misc_feature (106)..(106): n is a, c, g, or t
  misc_feature (165)..(165): n is a, c, g, or t
  misc_feature (243)..(243): n is a, c, g, or t
ttagtcgaccaagacacacacatgcagacacacagacatgcacacagccgcacacacacagatgtgtncacacacagatgcgtgcacacacagacccgtgcacggncacacaggcgcgcacagacacagacacgtgcacagacacacacagcacatgcacacatncagacacaccagacgtgcacacagacacacagctcgcgcacacagacacacacagatgcacacaggcatggggacagntccacat

SEQ ID NO: 557947 - DNA, 984 bp, Homo sapiens
ggaccagcctggccaacatggtgaatccccatctctactaaaaatataaaaattagccagacatggtggtgggtacctgtaatcccggctgcttgggaggctgaggcaggagaatcgcttgaacatgggaggcggaggttgcagtgagctgagatcgtaccactgcactccagcctgggcgatagagccagactgagtctcaaaaaaaaaaaaaaatttaccttttttgggtaaggttgtacttcttaaataagggctcatggtcactaccaactttgcctgcttggtaatagagtcctattcacttttgctcccaaccccacttacggagaatgactgatgactagttgtatacacagtggttgtgcccttgagaaggctctgttgccagcagtggtgatcgactcacgggccttcccccttgtctggctgatgtgatggctccttggtccttccttctgaaggaggtaaaagggggcacacgggccacctgtggaaagtaggcagaaaagcctcccttgggttgcagatttctctgagcaacaagaacttgggcctcatagttaaccttactccaaaagcttccgctgttgacaatacttacactaatttttaatattacattaacaacgatttaaacttgtgcaacaacacactaaccaaacacaaacaagacctctcaaagcgacattcaaattgtcacgaggtaggctgagacaaaacgagaggttaactggacaattgtggccaaatgttggcccatcataagagtagtttaaccgcgtagaaaccccaaaggagtatatccgagtgtgtacacccaaacacgggtggtgtcataatcattggggcaaggggagtacaccaccatattattatagtagagaagatgcacgaataattagcaattgctccaagaataaagagcacgaagggtgttaatacagccagtgggttttgaggacagcagcaagaagagaacga

SEQ ID NO: 557948 - DNA, 456 bp, Homo sapiens
ttctttgtcccgggtaaacaccaacgctgagtgctaggagaatcgctcggacttgggatgtgcggcggtgtgcagtgcacgccagcgatcatgccattgcatacaagcctgggtgacagagtgagactatatctcaaaaaaaaaaaaaaaaaaattaaaagacaataccaaagtcatcctatccactaaccttgatatacctatccggcttactattgaaacacattacaaccatttccccagggggattgcaaagtccttaagttgattgtatcttctccaccttagatgtctaataacttaatactgcaatttaaggttacctatcattaataattctccatcttgtattagcaaccgaatttccggctaagtatacgggattagtcacctcagccagtaaagaaactccccattttacctgtaggattcagaggctggaaagacccagggtgc

SEQ ID NO: 557949 - DNA, 336 bp, Homo sapiens
atagtaattaggattaagaatgcgttgagatactgattctgtattataatcgtgattaaaaagttaatggtagatttatgggataattatactgaatgttcatatgaatgtaaactctgccaaaattgatgtgtgtttaattgagtttttttactttaagtgataagaccaagttgaatcactgaggaaggtcattctaaattttgggtggataattagttgggtttttaattatgatttggaaaatgaatgatttccctgacctattctctattcctgaactacatctctgatggtgaggactccaattctgagcataaggacttaggtcgacgc

SEQ ID NO: 557950 - DNA, 837 bp, Homo sapiens
  misc_feature (624)..(624): n is a, c, g, or t
gggaagacagtgtattccaaacgcagagctgttggagaacctggtcagccagatggccctttcgagcaggaattctcaggccaagtgctcaagtgagcaggccctgaaacagttcagtgcccttctgaaaacctggctcagcagttaaccctcctgagggcaagaacaggatgaggagatagtgaatgtggcacaaaggacagggagatacgtggatgttgtgaaaaggcggagcttagaacagaggatctcaaggtctcagctgaatgaattgtggtcgattttccagagacctgagtacctacaggggaaaagtttctggtgtgataaagagtataatgtgtcttgtgtgggcagcatcccagggggttgcagattaaggaacagattttacagcaaagatttcgaaaggccttcgagggattccagcagtggtgtgtttaatgcaaaaatcatacccgcaagtgtttgggatatacctcaaaatataagtgaagttcaactagtcttcagaaaatacgaggagttcgttgtcagacaagtgaaacctggaccagcacaggttaaacatgatggtgtctaagggaatttctgagtaccctgtgacaaagagaagcgaaaggnatccagggcaaagttaacgctgcaaagaagattgggaaaatttcattcaattctcaccaaaaaaaaaaaaaaaaaatttggggggtggccggaaggttttaaacattcgtgggggcgggcaggtatgatgcatgtgcaagggcagagaaacggctcgagtggggttcacaaaaaggggggggttgaaacagggtggcttgttaagcaagtacg

SEQ ID NO: 557951 - DNA, 116 bp, Homo sapiens
caccagagtgttctctagtgatgtgaacccacctcggaagttccgagctggacacagcccctggacagtgatccagacagctggccgtccccctagactcctgttggctggcgaca

SEQ ID NO: 557952 - DNA, 281 bp, Homo sapiens
taaaaatccctttttttttttcaaaaaatgtgggggggggggagtaacttgataaacttttccacccgctccctttgggttcattttgcctttggggggggggggggcttacaaaacctggggggcttgcctttgccttggcaccccaaatgcttaaatgcgggtccctcctggttgtttaaagctggggggactaggccccctccccgaaagcccccattttgggttgggggggcctgcccttccccttaatttaaaaactgtttttggggtttaacctg

SEQ ID NO: 557953 - DNA, 1234 bp, Homo sapiens
cccccccccccccacccaatctattaataacgtgatggtatatgtggatgattagtgggtccacacgacttgtaattgttcctatattgttatgtgtgtctaccagtgacaccatgtagtttgccctcaaaattggtgcgtggtcttgttgcctcccccgtgttgttttaacacgacttctctcggggggaacaatagtttgtcttaccactctgtcccgcccctccttttatagcaacacccgaccctgttcgatatgcacaaatacgggtttcaaattaaagcacctcgggatataaaaggggccccaatggagccactctccggaaaggttcacatttgcgggaaaagacaggcgcccaaaaagaggccccccgtggacccccgtgtcttaaggccccatggggagcatcgtataaagaaaagactcccctatgtaaccgcgctctccagatgagtagaaaatgtatccccgcatagctccccataaattcaagctcaactcttgggggacctgggggctttttgaagatagatgggacccccctcaggggtgaaactgataggccgtgggaggttaatatgggggttttttcgagcttggagatattcccccctcgggaatatttctttgttttaaatagttggtgttcacagactctggatatttttctcgataaagaccccactagtgatattgtaaggttttaactcggatatttatatttttaagggagagtgggtaaatgtcttcccctcttttgagattaaagttggtttcacacctaatggtggctatatatcacgtaaggtaattcttcacgtgtcacggttcccgctaagctgaaatgccacttgttaatataataaattaattaatttgtaaatcaccacttgtaagcttgaaatttgggcttgtacccgcactcttttgtaattctggaacatactggttaacttagaactttgggaggtcccaatttggtttcacgtcacagtaagtctactttgtagtttaagtagagcttcatcaactatggtctattttgggtttgtagttttaaatttagagattgtgttaaaattgagtgttttgcacatttgagacttcacatttgaacacattagttgagagtaaaattatttaatttttgaattttggaatttgaacatttactgtaatttgtaatataactgctgtgaaatacttgaataaagatgaccagaaaaacca

SEQ ID NO: 557954 - DNA, 924 bp, Homo sapiens
gtgacgctgctgcaccacggtgctggaggaagcggaaaatgagccaccccgaactcctgcagctgccccgggacctggaacagccctcgcaagcagcagggatcaacctggagatcatccgctcagagtgccagctccaacctgaagaagcttctgtgatgacctgagctggaagggtgtcttgcctcctgtggcctgaggtccaggagcagtacaccgagcgcctccagtgccagcatctcaggcctattcctgggcactggacgagcatgttttgaggccatcgagcagaagcaactgggagctggccgacctacctgtgtgagtgacgcccagcagcatgtccctgtgagtgacactgttcagcaccatgaatgtgctttccatggtgaccattttcctccagctgccctgaaggagaacaaggaccggaattgagcattgctggcagaaaggcatgagaggaaggaaagcagcaagctggctggacggattgacggcgctgaaccggacaaccgaggggaacaagagaccgggacagccctgcacacgacaacggggcccggcgaaagcaactgacgagaaggtgatgttgacaaaacccactgcccatagctgacctgacacacaaggaacaggactactacaaagcatagaggagtaaagacaagccgccggagagcacagagagaggacaaccagaaaggggggcagcaaagggcaggcaccaatgggaatcccccccaggagccggacgacgcatgtaggcaaacaaggtaaccactgcaggaagaccccgcggcaaacaacccgatgaccagcccatgagcccgcctagacgacaacagcagaaagaccgggtaagacatgaacaccggacacgcagccaacaccacagacaacacagcagcagccaccaacgca

SEQ ID NO: 557955 - DNA, 378 bp, Homo sapiens
ggcaaacggaaagactacatctcccaggccgccacgctttccagctggagtcctagggcgctgactgctccccagtttccgtagggaagcgctgggctaccgcggctattgtgcgtcgcgccctcgccctcctcttcccgctgcagtgtctatggagcgaggctacgtttcattgccgccctggcttaacccttccggcgcctaaaaggacggccggccggccggctcccttgcaccaggaagaagtcttagcagccagcgggccctggtcaggaaactctaagaaccatgggtcatcccccgctggagttcagcgactgctacctggacagccccgatttccgcgagaggctcaagtgttatgagcaggaactggag

SEQ ID NO: 557956 - DNA, 144 bp, Homo sapiens
ttcacactcactgccttctacatcctactacctctcatcactacctactacgtcctactacgctctcatcactgccttctacgtccttctacttctcatcactgccttctacgtccctctacgtctcatcactgccttctacgt

SEQ ID NO: 557957 - DNA, 574 bp, Homo sapiens
  misc_feature (207)..(207): n is a, c, g, or t
  misc_feature (394)..(394): n is a, c, g, or t
  misc_feature (468)..(468): n is a, c, g, or t
ggggcgaactgaggcgagtgaagtggactctgagggctaccgctaccgccactgctgcggcaggggcgtggagggcagagggccgcggaggccgcagttgcaaacatggctcagagcagagacagcagaaacccattcaccaagcccagcaagcttaacaacccctttcaagacccagctataatccagcaccaacccagccaacantataccacacttaacatctacaacccttttaagacccaaaaaccaccaccagcctataagcctccagcccctaccccattacctccaccctcagctccctccttacagccctcaagaaaactcagccccacagaacctaagaactataactcatacagcactcgaacctcagctacagcaaccacancgtaagctactaaagaaacaaaaaaaactcaaccagaaaacagaaaagtgtaaccgaaaagagcgagagctcancatactaccctaaaaacacagctactcgacaaacaattagccccctctaccttcttttttccaaatcaaccctacttttgcagaacatctcgcataagatcccccg

SEQ ID NO: 557958 - DNA, 554 bp, Homo sapiens
gacatgaagaacttaaacagtaattgtgaatacctgatgtctattattctgtcttcttcatatcagagactctacaaggtgtggcacacagtccatcatagtcatagtcatagctttctcctggagtataaatatgatacgttgcatctaggtttaaattatttgcacctactggggctattcctaaaacctattcatcagccatatatatgctaataaacagaagtggataaaaaatttttaagagaattcctatataaaatatgtttaccaattacatctagataagaatcagcttgtaaaccatattctcttttatgtagcacagaaattcgtacctgtaggaaaagtgcattaaaatatcttgtcttcataaagcacagattcgtgaacagtaacagggcagtggttcttgatacatgttagctaggactgtttgttttctttgttagtttgtatgcgagagtctcactctgtcacccaggctggggtgaatggaacaatctggctcactgaaactccgcctcctgggtacaagcgatcctctgctcagc

SEQ ID NO: 557959 - DNA, 456 bp, Homo sapiens
  misc_feature (175)..(175): n is a, c, g, or t
  misc_feature (182)..(182): n is a, c, g, or t
cctaaagatactacctagattctgaatagaaaccattggtcatctattgtctctaagggcagccacttataagacttttgtctccgcaatcttaacctgaacattccctttctatcaatcccaggtctttagacaaactcaaccagttgtcaaccagaaaatgtttgaattaacntatagcntggaagccccacctcacccttcccccccccgcgcccccccgccccgccaccctgccaccctgcccctggttttgagttgttctgcctttcaggaccaaaccaatgcatttcttaaatgcatttgattgatgtctcatgcctgtctaaaatgtataaaaccaagctgtaccctgaccaccttgggcacatgttcttgggacctcctgagggctgtgtcatgggccatggtcactcatatttggctcaaaataaatctcttcaaataaaaaaaaaa

SEQ ID NO: 557960 - DNA, 133 bp, Homo sapiens
gtagtgtaatcatatctcactactagccgagctcctgggctctagcaatcctcccacctcagcctcttgagtagctggaaatccaggtgcacactaccatgtccagctaatgttttttggttttggtttttgt

SEQ ID NO: 557961 - DNA, 867 bp, Homo sapiens
cggaagcctggctcgttggccatgttcggggacgcatgttcattaagttcatataaacatacttttcatcttgtctgtggtttgaagactgcgttcattctgcctctagtaccagcggttactctgtctgtgatcaatgtgatgtcacaggagacgtccttagagtaatcgaggacgaaatgagtccaggggcgtggaagatatgacttctatattggtctgggattggctatgagctccagcatgtgcattggaggaagcttttcatcttggcaaaaagacaagagggcctccttcgacttgccaggaacaggctctactgatagcgagtggtgagctggtgagtgtggccagatttgcggctgcgtagtgcgttggcaccgagccactctgagtgactccagctaggagctctcagcgtgctaggtaagtgccattctttcttcatacttactctaatgaaagacttaatcttcagtgggaaaattggggtgtcgctaagatatctaggatctacagttcatggtcattcatgctccacaggaagaggagattgagacttagatgatatgtctcagaagctactgtgatcaggtctagagggtctttgcaaccccttgtgggtccttgtggcccttagacataaaatcttccgggggggtccttggaatggacagacacacatttctgtgttcttacaatctgctcgtaatcggccgataaaagactctgtgtgagggctgagaatgtatcagagtgtgcaggaactggctgggatcccggctgaatagaggaccaacgtcgtacacaaatataccaaagctgatttacctctgggcaattttcccacactattgacttagagaa

SEQ ID NO: 557962 - DNA, 183 bp, Homo sapiens
  misc_feature (17)..(17): n is a, c, g, or t
  misc_feature (25)..(25): n is a, c, g, or t
ttggtgcatcggtcctntgaggaancgtgtctggaaaggggttcatgcctctaaggggcttacggagatgctgaggtactgcctcgcctcatgggtgtgtcaggtttctacacctgtgtgcttttctagaaaaagctgctaatggctgcaacactaatcatgaacacgtttttgccagtttca

SEQ ID NO: 557963 - DNA, 830 bp, Homo sapiens
gagttcaaaaggttatgggagggcctctggcgtcctggatggagtgtgcgttcctttctgtggttgccggactgaatccacgcctggtgtactccaagcatggactgcagacgaggtgtagagccgtccgcttgaggccacgagtgggtagcttggagaccaggagtacgcggtgcccggatttattagtgactgtacgcgttggctgggtcatcatcggacagcgcttgccagacgctgtacgagccgcctggtcaatccttgcatctggccggcccgtgcgcggcggcctaagagctcgaaccctttcacacgcgcgcaaggagggaggagcggcgggggagaaacaagacgaccctcaacttacgtggccgcctgtcgccggtgggcatgctgggggcgtcctaccgctgccggaacccctttatcggctctattgccagaaatacctggacttggacggactcaggcagttggcaggtcatgcctcagacaaggattgacacaaacatggtgccctgtaaaaagatcgaatcacttaaaattagctttaatgcagatgtgcatgcaaagtctccagtggaactataagaccctcaggcaaaagcagaaatactatgtgggggccagcgagcagactggcactggcgtttaccaagctaagaatcttactgacaaagcagaacttggacttcgtacaacgcatattgtcccatttgaaagctggaacagtcatttcaataaaataacggcgcctctgttagaaggacaaggcttaatcccagcagaatacatatccaggtagctaaatgacctaattggtgaaatca

SEQ ID NO: 557964 - DNA, 160 bp, Homo sapiens
agtgctccagcatataacgagtattatggagtgtcagcacgtgtgctcactgtgtcgacggaactatgtacaggggaggcatgcaccgcatggtgaatacacgttgaccaggctccatctaaactgatatttggaggtcagcacggtgctcactgtatcg

SEQ ID NO: 557965 - DNA, 919 bp, Homo sapiens
  misc_feature (45)..(45): n is a, c, g, or t
  misc_feature (78)..(78): n is a, c, g, or t
  misc_feature (83)..(83): n is a, c, g, or t
  misc_feature (88)..(88): n is a, c, g, or t
  misc_feature (97)..(98): n is a, c, g, or t
  misc_feature (120)..(120): n is a, c, g, or t
  misc_feature (122)..(122): n is a, c, g, or t
  misc_feature (125)..(125): n is a, c, g, or t
  misc_feature (131)..(131): n is a, c, g, or t
  misc_feature (134)..(134): n is a, c, g, or t
  misc_feature (139)..(140): n is a, c, g, or t
  misc_feature (143)..(144): n is a, c, g, or t
  misc_feature (146)..(146): n is a, c, g, or t
  misc_feature (153)..(153): n is a, c, g, or t
  misc_feature (192)..(193): n is a, c, g, or t
  misc_feature (210)..(210): n is a, c, g, or t
  misc_feature (213)..(214): n is a, c, g, or t
  misc_feature (230)..(230): n is a, c, g, or t
  misc_feature (237)..(237): n is a, c, g, or t
  misc_feature (270)..(270): n is a, c, g, or t
  misc_feature (272)..(272): n is a, c, g, or t
  misc_feature (276)..(276): n is a, c, g, or t
  misc_feature (304)..(304): n is a, c, g, or t
  misc_feature (306)..(306): n is a, c, g, or t
  misc_feature (312)..(312): n is a, c, g, or t
  misc_feature (314)..(314): n is a, c, g, or t
  misc_feature (318)..(318): n is a, c, g, or t
  misc_feature (363)..(363): n is a, c, g, or t
  misc_feature (372)..(372): n is a, c, g, or t
  misc_feature (378)..(378): n is a, c, g, or t
  misc_feature (383)..(383): n is a, c, g, or t
  misc_feature (386)..(386): n is a, c, g, or t
  misc_feature (390)..(390): n is a, c, g, or t
  misc_feature (395)..(395): n is a, c, g, or t
  misc_feature (418)..(418): n is a, c, g, or t
  misc_feature (420)..(420): n is a, c, g, or t
  misc_feature (438)..(438): n is a, c, g, or t
  misc_feature (448)..(448): n is a, c, g, or t
  misc_feature (456)..(456): n is a, c, g, or t
  misc_feature (467)..(467): n is a, c, g, or t
  misc_feature (470)..(470): n is a, c, g, or t
  misc_feature (482)..(482): n is a, c, g, or t
  misc_feature (527)..(527): n is a, c, g, or t
  misc_feature (549)..(549): n is a, c, g, or t
  misc_feature (551)..(551): n is a, c, g, or t
  misc_feature (558)..(558): n is a, c, g, or t
  misc_feature (588)..(588): n is a, c, g, or t
  misc_feature (593)..(594): n is a, c, g, or t
  misc_feature (787)..(787): n is a, c, g, or t
  misc_feature (839)..(839): n is a, c, g, or t
  misc_feature (894)..(894): n is a, c, g, or t
ggggatagaggagggaagatggggggggaaggggggcgggggagnaacagtgggaggagatgatggaggttgacaggngggtngagtntgaagaatnnggggatgaagaagggaagaaananagnagtggnatngtggnnganntnagtgaanagagcctgaaggatggggaggagcggggggaggaggacnnagaagaagaacatgagntgnntgtggacatggaaacnatcaacntggacagagatgcagaggatgttgatttgaatnantatnggatagggaagattgaaggatttgagantntctgcntncgcnaaaatttaattaaatgcattgagaatctggaggagctacagagtnttcgagagntggatntttanganaacnagatnaagaagattgagaatctggaggngntaacagagctggagattntagatatttnttttaatntggtgagaaanatngaaggggttganaagttgacacgactgaaaaaactcttcttggtcaacaaaaaaatnagtaaaattgagaacttaagcnanttacatnaactacagatgctagagctgggatgtaacnggatnnggggaatggaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagtgtaccttagccacaatggnatcgaggtcatcgagggcctgggagaacaataacaaactcacgatgttgganattgcatcaaatagaatcaaaaagattgaaaatatcagccatctaacagagctgnaagagttctgggtggacggacatgt

SEQ ID NO: 557966 - DNA, 311 bp, Homo sapiens
ttttttgtccttggggggcccccgggggggggggggggggggggggtgtaaagggtcttataatcttttccccattttttcccaatgccaaaaggccggcttttctattttaaaactgggttgggggtccaatcctaaatccttttagccggttgaaggccaacctttgcctagaaataaaaaaaaaactggtttggggccatgggggaaatttgcccatttaggttattttcccggttttgccaaccttggtttttttttcctttggacctggttccaaaatttttatttaaaatttggccccccaaaga

SEQ ID NO: 557967 - DNA, 232 bp, Homo sapiens
gctcccacagtgctggtgattccaggcgtgagccaccgcacctggcctgtatgtatacaatattagagcttcagtcacacgcgactccttaacaaagaaagtcctgatgtcagaatacacgtatatactaccacaattaaaatgttcaggatgcacatgtgtgtatatatcaaatactattccctgtatatactaacctgtctttaaccatacagatcgctgtacttgatca

SEQ ID NO: 557968 - DNA, 737 bp, Homo sapiens
gacgacaggtaccaccatggagtcagctggggtggtctgcccctacagagccatcgatgtccctgtacatgtgaagcactgtactcgaacatgggtgaatgcagcagctgatgccccagtgatggcctggcactggctgtgagtgatgttccatgctcacgtgacacatatgtgcctatcatgtgacaaactgtgtacgaatgcaacttgtgtattacatctagcaatgttgtgatgtgcattgatgtgccgaaatgcaatgtgaagcaacgtatgctgatggcttgctagttgccatgtgtcaaacacacacatatgcatcattgacattgccctgtgtgttgagaccccaatgtgacaacgccaatgcaccagtgatactcacgcattgtgcacattgtgaaaccattaccaagctgaacagatcgggaacaaatgccacatgtgtgacatttgcttatgcgtataactatgcgaaagtggccattgagacattccaatcacactaagtgtggaaccattggcggttacacacgttacgtggcacgttcggattaagacggtttgggattgcgggctgaacaacagtgccccccccaatttatatgggccgcgtaaactgctggggaacaattatacacgcttttgaccgccacctacgaagtcgaatttcggggcgcaagtaggcacgttggtggacaaccgcccacagttgggagcaaacggtgcggccgttg

SEQ ID NO: 557969 - DNA, 271 bp, Homo sapiens
taccaccgccgacatgatccgcctcgcggttgaagctggcttatagcaatatcgcccagccgggatccgctatggcccattgaccgtatcgcgtcatcttgctggcatttctaagaaaataccggacgtctcggcgcggtcgcgcgacaccttgtccagccaaaaggtgttggtcgcgggcggcacttccctccgtctgagcggcgccggggcgtctcaactgaaataaaccagcctgggcgcctgcccacgccgccgcgctgctccccgc

SEQ ID NO: 557970 - DNA, 122 bp, Homo sapiens
cactctagaggatctgaggcaggacactgtgggaggcaggacactgctgtgtattactgtgcgagaaatgggaaggatagcagcaccggtgggggctttgactcctggggccagtgaaccct

SEQ ID NO: 557971 - DNA, 884 bp, Homo sapiens
  misc_feature (153)..(153): n is a, c, g, or t
ggaagctcagagagctgaaatagcaatcgtgcccatctgtcataggacattcctgagaagaacatacaatgaaagtcttcgctcaagaggaaagagaccagtcggagtcctgagatctatcttcacactgtggtgcagagaagtattagcaanactgagttttcccagtagttatgaacggttggaattgttgcagcttcagagtaacattggcaaatgctactagagaattaaaagagatagcaggaagatctattggagaagtagtaatgcatcgttctgaaaagaacaattgtagagcaagcaggtgtgcaggcaggaggttccagtggaggttatcaaagaatctcttggtgaagaggttaggaagatatgttgacggaggaaggatgaaaacatccattgtgggtgggtccggaggcgcccttaaagattttttcaagaacagcttcatgtactccttctgtagaacgatgagcgagccgattgccgaagaagcgacggaaacaaggggcatggcttgagtgacgcctccattctatgcctgggataaggcaggatgatgttctacatgttctactgacttcttccctaagagaaccagctccctgtagttcttcccggcatcataaaggcagcggctcacgtattatatgaaagggaagtggaagtgtctgttagatggatcccgtgttccgataagtgatagcagcgagttcgtgaaatcagcctaatgtgttggtactccgttcacgattgagaagcagcaagcatcgctgttccccaaggaaacccaagtcctcgctggtgattcccacatcgtattctggaagacatttccattccattcatgtttgccaaagatttgacaattctgcaattgg

SEQ ID NO: 557972 - DNA, 394 bp, Homo sapiens
gaggataatcagattcataagagagaaagaaggacacctaataaaggagtaacggaaggagtgtcaatggggagtgtggcattcgtgaccaatatagttgctggagagtagcagacagtcactgcctacaatacagacagaatcttcctgctacactttctgatgctatctcttcctgatcttatgacccagtgttagttgatgattgagtgatgacaagcaatggctccttattttcacaggactaagtccgggccttcgtatcactagctgttgccatttaaaacctggtttaagcaaccctgtccctgtcattggccctgaacttcctctctgtgcccgtgtgtcctctgcctgggagccctctcctcccatagtcactttctctctgcca

SEQ ID NO: 557973 - DNA, 379 bp, Homo sapiens
  misc_feature (69)..(69): n is a, c, g, or t
cggccgaggcgaatcgcccccaggaagcggctcaaggacaagatgtcgaacacacactgcgctgcaggnaatgagtctccaagtcgaggatgcgcacgccatccacggtaacgagcagatgctccgacttgcagtcaccgacgctgatgcattgcaggtcgaacggcggcaaacggcagcgcgacgacaggcagggatcgagaaactcaggggtactgcggtgccccatgacccgctggatattcgcaagggccgtggcatgcatcgccgcgtaggccgcgatcacttcaggcaggtcggccggaccgggcaaacgcccttgaagagactccagcacgagtacctggtgccgcgcatcctgacagcgcatgcctgcgat

SEQ ID NO: 557974 - DNA, 627 bp, Homo sapiens
  misc_feature (627)..(627): n is a, c, g, or t
cggacgcgtgggatcagattgttgaggtgggtgtgatagtcttcagtgtgcagtgcgttcattcactaacgctccctgtccagtgccccatgtttgctcagctgcctccatgtgcactcagtgcagctgctggtgcaacagtcgtgtgcaaatcctggtacactagtgtatcagcacaccaatgtacattttcatgttcaatatgtaacattcacgtttcagcacacaccatcatcgtcacccatcttgcattgcgctaggtcaccggcaggcgcctagctggcgttcaaccattctgcccacacaataggtaattttcagcacatcacaggcacacatttctcaccactgtcttcacacaccgcttcagttggtcccttatcagttgccattattgtcccgcagtggcgcaccatggggcaccttgccaccagggccttcacaagtcaacgacgcttttggcgtttctcaattttctccacgtctcactggtccaccttcctgtaggggcatttaattagggtcagccgttgtatttcacgtcccccttccgggcacacaaccccaatttcgggtttcttcagaccacacagaaccgcggcccacagcatcgttcagtgtcattgn

SEQ ID NO: 557975 - DNA, 103 bp, Homo sapiens
cttccgtaaggaccctaacaagctggttatgtgaagttttcaagtacaatcgaaggcctgcagagaccaatttgaggcacacctgtaaacggataatggacat

SEQ ID NO: 557976 - DNA, 337 bp, Homo sapiens
ttttttttttgacaatgtctctctgtgtcatccagactggagggcaatggtatgatcacagctcactgcagcctcaagagctcactgcatcccttctgggctcaaggaattttcctgtcttagcctcctgggtagctaggactacaagcaggagccatcacatctggctaaatttaaaaaacactttttttgtagagatggggtcttgctatgctgaccaagctagtcttgaactcctggccttaagtgaccttcccactttggcctcccaaagtgctgggattacaggtgcaatctactgtgcctggccccaaattcccagtctttaatctatatt

SEQ ID NO: 557977 - DNA, 176 bp, Homo sapiens
cccccccgggggggggggggggtttttttggcgggttcccccccctttggttaacccccttgggggcgggaagggggggtccctttggggggtttttccgggccccccctggggttttgggggggggcgggaaattttttttggcccttttttcccccggggccccccccccccca

SEQ ID NO: 557978 - DNA, 107 bp, Homo sapiens
tagctggttaccatcagtgctgaatggggctaggatgtagggttttaaattacagtagggtaagctgaaggatcagcagcgtacagtggctcacacctatgtatccc

SEQ ID NO: 557979 - DNA, 534 bp, Homo sapiens
  misc_feature (97)..(98): n is a, c, g, or t
  misc_feature (134)..(134): n is a, c, g, or t
  misc_feature (231)..(231): n is a, c, g, or t
  misc_feature (288)..(290): n is a, c, g, or t
  misc_feature (295)..(295): n is a, c, g, or t
  misc_feature (298)..(298): n is a, c, g, or t
  misc_feature (307)..(307): n is a, c, g, or t
tcacaccgtacactaaaacacactcaacgatccaccatacagctcacacctgtgacactaaaacacactcaacgatccaccatacagctcacactgnnacactaaaacacactcaacgatccaccatacagatnacacctgtgacactaaaacactcaacaatccactgtacagatcacacctgtaacactaaaacacactcaacaatccactgtacagatcacacgtgtnacacaaacacacaacgatccactacacagcttgcacctgtgacactaaaacactcannnatccnctntacagctcncacctgtgacactaaaacacattgaacaattcacatacagaccacacctgtgacactaaaacacactcaacgatccaccatacagctcacacctgtgacactaaaacacactcaacgatccaccatacagctcacacctgtgacactaaaacacactcaacgatccagcatacagatcacacctgtgacactaaaacactcaacaatccactgtacagatcacacct

SEQ ID NO: 557980 - DNA, 464 bp, Homo sapiens
  misc_feature (55)..(55): n is a, c, g, or t
  misc_feature (449)..(449): n is a, c, g, or t
catttctaaaccactgtttattgaggagtccatctctttcacactgatttgaaangcttacctttattgtatattaaatttcttaatacttaagtatttaatacttaagaacaccgtggaatactatgcagccataataaaggatgagttcatgtcctttgtagggacatggatgaacctggaaaccatcattctcagcaaactatcgcaaggacagaaaaccaaagaccgcatgttcttactcacaggtgggaattggaacaatgagaatgcttggacacaggaaagggaacatcacacactggggcctgtcgatggggttgggggacgggggagggatagcattaggagatatacctaatgtaaatgacgagttaatgggtgcagcaaaccaacatggcacatgtatacatatgtaacaaaatctgacgttgtgcacatgtaccccnagaacttaaaatatt

SEQ ID NO: 557981 - DNA, 752 bp, Homo sapiens
gaccctgggcttgtgctctttatggaagggtgtattgtcagtcgacttaagttgggagctcacaccgtgattgcccgggattagctccagggttaggaatgtgttccttctttagatgtccggctcatatttctgggttggatgaaaactccagcctgttcctgactcacctccatcttcggtgtcttcagtattatctgagaagagttgggatatcgtgggaaggggcatgggagctcggcagcacttccgccttgccaggaaggcagtttcgcctctgcaggaaagagcagagcccgtgggaagccctgggtgagggtggcgcagccggcccagcacgcatggtattgccagccacggggggcctgcgtgtagtctctgctcccgtgcatttcaccttctttgatgactttccttctctgtgtttcccccatctgtttgccagaggggtgggactggcagacgagaacagcccgtaggactgcttctatcctcgtccctctccacggtgtgactcaggcgtgagtggtgactaacgggagcctggccacctcgcagctgttcagccccgcgtcaacctcttgaactggaactgctggctcacaggagggttttcgacaatctgcgagctgaatctcatggcaatagctggattccgtctgcctatacgcagaaacacccgggctccatctgccaggtgcttgccactggtcctggcagcaactggcggatgatttacgtgaccttccata

SEQ ID NO: 557982 - DNA, 275 bp, Homo sapiens
ctttggaaaggggcccttattgaacattttaaaaggggggggggggttttcaaggatttcctgtttttttcagggtcctaaagaaacaccacccatttttagattgggtttgttttgggcccttcccccgggccccaagggagccaaaaaacccggccggccctctgtttgttttttcctaattttgcaggggggggggggtagtttagtttcctttttgaaaaaatattttcatttttgggggcctttttgtaaaaaaaggggacatttttata

SEQ ID NO: 557983 - DNA, 534 bp, Homo sapiens
tttcataccctttccttcagcccccccagcagttttattatccccaccagtaatatgtttgttcaccagttcagttgattcagatcagagggaaagaaatcccacccctccaataagtgtattaaactttccgctctggttaatgtaaggtactctcctggactgaatccagtgtataatttctgtttccagttaaaagctgtgccccagttccccatttgattacccatgtgagatttgctgctgttccagtataacccttaggtataataggatttgaaattgcattccagttcataaaaattgaaaatgagaaattaaccctgcaagtgaaccatttgaaacgattatcctttttacataagacagggttgggccatcagatacttccaaagatggtttaagtagggatactagagaaaattaagttttctttctcttgggtttattgattgggtttaattcccattaggctatttggcataatcaaggccctgtaatttttataattttaaaataaattccttaagacca

SEQ ID NO: 557984 - DNA, 237 bp, Homo sapiens
ggtgaagtgataaagctgacctgaaaagctcatcgataatccagaagtactactatagtacaagtattcatggtagaaatatttcctacagcattgctccactaattctgcattctttctttactttacttgcttaagttctgaccactttctgaacataatatgtatgaatgatggtatttaaaatgaattccaatccagataatatggctttcttttactaactaataacttgat

SEQ ID NO: 557985 - DNA, 553 bp, Homo sapiens
acgacagggcgactcctgcaacagagaattcttccgagcattcgaagctgtaaacttaacttcttatcaccatttttaagggcaaataatttctatagaaagtaagttcaaattaaacttttagctctcgccacaatttttcccaggaaatgacctccttctaaattatatactcatgcacttgaaagtgaaaacacagcttggaaagtcagagtaaagaaagaatgacaagatcaggaaattgggaagttgctttagcacttttttctttgtaaagagagaatattatcaagtgtctagagcatataatagcttcaaagcatagttgagaaaagatcactatggagctgaaggtagagaactgggtagtgtgaccacttgatccagtcagtgcttaggataaaatgaactgtcatgatctagaaagctgtttttgttgtaaatcccaagcccctcactatgctcaatattctctccttgaagcattaagtaaaactaatcaaggaaaatggaaggcttggcattttaggtgatgagaattcactagctggat

SEQ ID NO: 557986 - DNA, 212 bp, Homo sapiens
catacctggaaactcttacacctcctacttttacctgtccatctcttactacttttaccgctatgatttgtcttacatgaacttttccacatactttctttaccactctcagttagagtctaggcgaacatttctaacaaatctcgatgaatctgctagaactcaaccatggctggcctaatcttccttcacgatatcatcgaaaccaaact

SEQ ID NO: 557987 - DNA, 115 bp, Homo sapiens
tatgcagtatgtactctatttaaggcatctgtggtagtcatcccatgcagtgcaatgtccattcattttgacagtaataactgccacatgtgggaagtaggatacagtagggaga

SEQ ID NO: 557988 - DNA, 687 bp, Homo sapiens
  misc_feature (41)..(41): n is a, c, g, or t
  misc_feature (86)..(87): n is a, c, g, or t
  misc_feature (99)..(100): n is a, c, g, or t
  misc_feature (112)..(113): n is a, c, g, or t
  misc_feature (172)..(172): n is a, c, g, or t
  misc_feature (235)..(235): n is a, c, g, or t
  misc_feature (281)..(282): n is a, c, g, or t
  misc_feature (289)..(289): n is a, c, g, or t
  misc_feature (303)..(303): n is a, c, g, or t
  misc_feature (332)..(332): n is a, c, g, or t
gaagggctgggtctggggccacagaccacaaggctcagctncctaccctgctccctggggtgctgctgtcttggagagcacagctnnggtgagacggcnnggcaggccgagnntgagaaaccaggaggatagaggagaaaagggcttgggcccagcccagaagatgctggancccaggtgggagacccaacagtgggtgcagtttctcagtagggctggagcaatggtgggggtngcccggcagcctggctcctcacatcccaggggttggcttctgattnngggcttnggctccaggcactngcttctcttctctgtgtccttagcatttnagagaagaaggccaggggccttgttcatggatcccgtggacccaaggtcagatgtccaggctttatcctcctgaggatgaggatgtctgatccatgcccgaatatctgaccctggctcggactgaccggggcaaggcagtccaagagagttcagtgaggaccagctaggctctcccaggtgcaatgtgggtgcagggccctcatgtcccctaccctgcctgtgatggagtgttctgaggggctttggcatttgctggaagcacagggagttccaaatgagagggagcttctgtggcttgagagcctctggggccttggctgccagagcacgaggcagcagggaccttggagagcc

SEQ ID NO: 557989 - DNA, 197 bp, Homo sapiens
cattgaactgttgaggagtggtgcgtcggtctcacaacgatgcatgatgggcgtatcggctccagcagattgcagctgctgtggaaaacaaggtcacagatctatatggaacccagtgagccacgtgcctgctagttgcttcatgcctggcctgtggcagccctgtgaagctcgagacggagaggccacctatctta

SEQ ID NO: 557990 - DNA, 106 bp, Homo sapiens
tgctgctggtcgatctagaggaccccacgatggcctcagctcttctcctactcctttcttccctatccattcttctacgtcaactattacgttaccgagccacagt

SEQ ID NO: 557991 - DNA, 114 bp, Homo sapiens
ggcgggttttttctttcaggtggagaccttccgcaaacagtcttcgccagaactaactgggcaggccaagaagcaaccgagcctttaccccccctatgtatttatttggaccgg

SEQ ID NO: 557992 - DNA, 1385 bp, Homo sapiens
gcatcaaatggagtgatgatcgccgtgtgcagtcggtgggtggcccgtgtgggcccatgagtggcctctgggattgggaagcgtggtggcttccgtcggaggtttcggcagtggcatccgaggccgtggtctgcggccggtggactggcggccggggccgagagtcgccgagacgctcgccggcaggcgatgcctgagagattacaggacgttgcgatagcctgtctaacatagtatggcgtcgctattgtgtcaagggagcatcgcaaagatcaaattcccatggcagtgagatctcatctatctctccctgaccatagtatacatggaattcaaggaatagtcattggatgtgacgtttcacttgcgtgggcactactcctccacaggactgcacgcggttcacgaacgatttcattgccccggttgccagcatacgctagtacctccttgtgcctcgcgtcccaggggaacaacccacgggtttcaacgtggccgaatatgtgctccgacgtaacttcagccccttaaaccgtaagcgaaagtgtgacccagccgatcggagattcatagcgacgttgcttgtaaatcgcttgcattcccgacagggcaccgggttgggcccaactcagtcagccaatttcgcccgttggtggagccacatcaattcccctttggagctccacaaggtttcgttctcgcaattctggtaccccccggtttggcctgcacatcggactatggcacttaacctttgggaggggtgcacaaccacagacagaattccgcggggccaacagtgttgccgccacaacacagcctgtagagtcccccccgtatttgggcacacaacagtggtttgaacacacggaggcaccaggtacatagcccggtggcattcactacggtacgccgttgggcatgaactcaggcccactttccagtatccccctttgatcacaacacgcataatgagggtgacgacaccttatggtgccagcatttccgggtacctatcacccgggacaactccctttgtttgcgcccttaaaatgcacacacggcgcttggccttaccatttggacttggggacatttgggggtaacttccggacactttgaaaccgttggctcgtaacaacaccccatttccaggagacacgcacggggtggggcctttgcctacgtttgctccaaagccgccctttggggggctacaatacacttatccgctccagacagtgtgcggccgaccccctattttcgaagttgcgctcatgatgtttcctctaatggaaagcccttatcgaggcgtgttaaccacgtggaagaccccccctcaggaacccccatcacttgtgtcgacagcggggaaggcacctacg

SEQ ID NO: 557993 - DNA, 106 bp, Homo sapiens
ggtcggagaccagttttcccagcaccatgtgtttgaaaggtttgtaccattcctcattggaattggttttgggcacctttgttcaaaaattattttgagcatacga

SEQ ID NO: 557994 - DNA, 984 bp, Homo sapiens
gcgggaccatggcaggctgtagagcccgggggccctggcgtgggcgccgctggtggtcccggtcgctgactggtggcccggtggtctaggcctgtctgtgcggcgggccggggctggagccttctcgctcagctgtctgcattcactgacgacggcggaggctcctctcgttccgagaccgaccagagggcaaagtgttggagacatgttgtgtgtgttttgagtgtgccaaatagtatgaatggaaaatatgataccgggcagcttttccttcatagcatttttcggctaccgaggtgtcgtcctgtttccctggcaggccagactgctatgaccgctgatgtgtgcgttctgcagtctccacgaaaaaagcacggaagtaacccgtgtctggccatggctccaaggaggtgaaaggctaaaaactcacacttactatcaggatgctgtacttgatgctcgtgactgcccacgagtatatcgtcatgagatctcagaacagaagctgtgaccttcttggctaaccatgatgtacagtcgggccctctatgccatcccaggcttggactatgtcagccatgaagacatcctcccctacacctccactgatcaggttcccatccaacatgaactctttgaaagatttcttctgttatgaccagagcaaaaagcaacctcctttttgttggctcgggagaaacggctaaggggcctggcaagagaaagaatcacccccctgtggttggaggctctcccgatgtttcatcgcggaaagcaacttgagaaacattacgtgttcacttgtcatccccctttctaacatgggcatgagggaaggcccagaaattcccacgtgtactgggtgggcgcacatggattccgttggaaaacttgaagtgatgttggacactccggacggctggggagattcgtctctggcctttgaacttagccgggtttggcgggcctctgtccgaggcgtcc

SEQ ID NO: 557995 - DNA, 399 bp, Homo sapiens
  misc_feature (194)..(194): n is a, c, g, or t
  misc_feature (330)..(330): n is a, c, g, or t
  misc_feature (335)..(335): n is a, c, g, or t
  misc_feature (337)..(338): n is a, c, g, or t
  misc_feature (344)..(345): n is a, c, g, or t
  misc_feature (347)..(349): n is a, c, g, or t
  misc_feature (352)..(352): n is a, c, g, or t
acctggcaaggtggaaatcaggaggcagaggttgcagtgagcccaaattgtgccactgcactccagcctgggcaacagagcgagactccatctccaaaaaaaaaaattgagaggagtgttatcctagattttccaggtgagctctaaatccagtaacaagtgtctgtacaagaatgaggcaaagaaagataacncagataggaggaagcaatgccaccatgacgacacagactggaatgacaccgttaacagctgaggatgccaagaaccaccagaaactggacgaggcaaaaacagattctcctctagagcctctagagagagtatagncctgntnncccctnnannntcntctgacctccagcactgtgaaagaataaacttctgttgtttaagcca

SEQ ID NO: 557996 - DNA, 1421 bp, Homo sapiens
ggactgttcggacggaacagatccggggactctctttcgcgcctccgaccgggcctccgagtttgctctccgtgtgtaaactccgggaccatctgctcggggcagtctaccatggcttgctgggacctgcgcagccacccgtttccgtggttcagtctcctgtctagccaacgcgcaaacagtgatgctccctggaagtgtcgctgcaggaagttagtttcttattcgtaccgtgtggaagcgcagtaacgtcatacgcaggcctggctcaagtattgatacctgacaggggcgcgtccataacagccataaccgtctcgtcatggagacattcttaatggctctgtaccgggctgagtgaactggtggcatcgtggaacaggcggtgcagccgagtgtatccttccggcgcaagcgtgggaccggagggtagacacgcgtcggaggcggtaacgagtcgttcatcgcgtgaaatcattgctaaatacccccaggcggtggtgacgggaccccgcgacggcatactgttcgcaaggaagcaattcaaaaggaaaggcgcaagctggcatacgcatggcagctcgtgcggttagaagaactcccaccacggacggtcccaggtgacagacgacttggcgcattgggggcgctacggaagcagaagagaagctaggaaacccgatgggccccggtattatgtgggcggatcgtatccaatttgcccaccctcgtgggtattcataggcccttcgggcgactaggggcaacccactcgcgattctttcatgggtagcgacaatgtacacatgggggtatgcaacattccaacactatcacgttaaggaatcggtaaggggagaagggctagcagcatggcgcttttgattctcgacattgcaaaacaaataggcgcagataggatccacaaaaaccgcgtagggaacatctataatacgcaattccctgaaaacaagggggccgttgggcacactgcgccccccccgggaaaggtggccctcgggggaacccactggggcggacggacagctgaaatccgtcccctgtaccgagaacataagggggccttcaaagcattccgttcccaaaggtgccactcggcaaccgtaacacagcgaaggccgcccttttgtgcgcaccggcccacagtgacggaactcttggcatgtgggagacggggggacaccccccgttttgtgtcgcagcacagcggccaacgactaacagagggggccttatccgtgggcgccataagagggtacgattccgtcgcctctttacccaatgacctcatagtatagggggagcagagactgtgttcatattgtaactgttagatgcccttaaaatcacaatggaccccttgtggaaccagaaaagtggtgcacagcttgataaggctg

SEQ ID NO: 557997 - DNA, 893 bp, Homo sapiens
ggcgctgtcatggcgggtgtgctgaagaagaccacgtggccttgatgggatgggctgtgtgcaatactcctcacgaagcaggctaagcaatattgtacacaaagcattcttgcatgttcttgaggaaatccctaacaaatgcagccatcatcagcacacagtatacagaaccagattcacaaatgagaagctggctcatggttaaagcggaacccagatgttcaaacacaaattagcacagcaccaacttcaaggcggtcaattcagcacagaggtgattcttcaggctgcaacatgaactaaatctggcaagcaacacaatgcagggcaatggaccaactcatgggagccattagtggcaagagcctcctgccgcatcagtggaaatggcctaatataattcattaagtgactttggctgtgtccatgggaaactgatgtacttaccatattctgttcatattaagagcgtgttcttattactgacattcgcgtacatcacacgacacgtgatactagcaacaatctgtaggagactgtcaacataggtgatcatggtaactcaggggccactggtgaccctcaaacccaaggatacacatacaaagtactcaacagaacgtcgatatcaccagatgagactcactcgtgcacccgagcaggcccaggggacacgaaacgaaaacaaccactaaaagagacaaacaagcaacaaacgcacaaagccaaatggcagcagacccactgggccacaagagtaagacgcacacaaacgccaggcaagagaaaccaagaacacactcaaaaaacacgaccacactgaggacaggagaggacaagacaaggaaacaagccaacaccccaaatcaagaagacacaggagaaacgacaca

SEQ ID NO: 557998 - DNA, 415 bp, Homo sapiens
tgctcgtggtcgtctctgcacgatccccttcatttggcaatctagttcaggtggcctcgcatggtggatgtggcttctcatcgcatttagacgctgaggtccgacctcgtgttcactacctgtagtgctgctgtttgggcggctgatcaaggtggatcacttatggcttcgccgtggtgttctcattgagtcccagatcatgccactgcactccagtcccgggttacaaagtgtgactctatcgttgaatcacaattgctatcgattatttatcgtaagctttttagacccattacttagctatgcctctaacgtccatgtcagttgtggaatagcatatcgaatatgacttacaaacttgggttatgatcttcttgagttctgtggatcatgtgactgtgcattcctatgttta

SEQ ID NO: 557999 - DNA, 398 bp, Homo sapiens
agagtctgagggggaatcaggttctggaaggcaagccagaactccagagctgagctggtcacagtcactcctcccccaccacccctgcccctccagaggctgcagttttctcgcctgtcacttggaacattagagctcctgaagcctgtctgtcttaagacgttgggaaagcctcgtgttgaaagccgggggagcttaaatgatccaggtggtagctagggaccgtccatcagtggtccttccctccaccgccacgccagctcctgggtcgttttcatttatctggcagagccaaggacccttaagaatcatattttagctgaaggatgctcactgatgcggccgagggctttgggatactgcacagtgctactgtgtcctgtgaaggctggtgcact

SEQ ID NO: 558000 - DNA, 405 bp, Homo sapiens
  misc_feature (49)..(49): n is a, c, g, or t
  misc_feature (113)..(114): n is a, c, g, or t
  misc_feature (121)..(122): n is a, c, g, or t
  misc_feature (126)..(126): n is a, c, g, or t
  misc_feature (136)..(136): n is a, c, g, or t
  misc_feature (180)..(180): n is a, c, g, or t
  misc_feature (182)..(182): n is a, c, g, or t
  misc_feature (204)..(204): n is a, c, g, or t
  misc_feature (217)..(217): n is a, c, g, or t
  misc_feature (221)..(221): n is a, c, g, or t
  misc_feature (227)..(227): n is a, c, g, or t
  misc_feature (244)..(244): n is a, c, g, or t
  misc_feature (280)..(282): n is a, c, g, or t
  misc_feature (303)..(303): n is a, c, g, or t
  misc_feature (314)..(314): n is a, c, g, or t
  misc_feature (316)..(316): n is a, c, g, or t
  misc_feature (326)..(326): n is a, c, g, or t
  misc_feature (331)..(331): n is a, c, g, or t
  misc_feature (334)..(334): n is a, c, g, or t
  misc_feature (372)..(372): n is a, c, g, or t
ccttgggaggcctcccaaaatgtgtccagattcccacaggcagaaaganagggactgaaaaactgaagtgaagtgaccgtgcctgcccagcctgggactgagagcctgaagannagctttnnaaantctgtcccanaaaccccttggccctcagcaaatcccctcctcctggcctgaaananactccaggcttcttgcagaaangtcttctgtgganaacnaaaaanaatgaatccaccctgantgtcccgggacaaaactgctgagcagggtgcaggannnaaaaacaccggatctttcgangcacatcagtnanagaacaaaanacaanaanaccagccaggaaattgaaccactgcagccccaaggatntaaatgcagtgcttcagctctagcttggacacc

SEQ ID NO: 558001 - DNA, 749 bp, Homo sapiens
  misc_feature (242)..(242): n is a, c, g, or t
cgcagaatgaattcggcatagtcctaacacagcttctcggcaacatctctatgtgataaaaatacaaagattattgccaggtttcactgcaaacagggcacctttcacagccagcaggcatcgaatatggcaccaaactcgtggaggaaccactccaggaacaggaggcaacacatctgggctgacctgtcttaatactgtgaaggaggccaaagaacagacaggagcacggtactgtcatntatgtgcctccgctttggttgctgtgccatcaatgaagctatgagaagaacatccctgggtgtgtgtgtatcactgacggatccgaccagcaggacatggtacgagtcagcacaaatgctgcgcaggaaagacacgctatgggcgccaatgccgtgagtcatcaaccctggagatgtaacatggaatcatgcctggcataattcacaaaaaagggaggatgcattgtggtcagatctgcaccctgactaatgagcagttcccccaaacaacgcagttggatcgcgcagcctgtgggggtggcatggaggtgacctttcatgcacccgatttatggctgcccgaatcattggaagatctggcccaaagcctatatggtgggactgcggtatgccacacaaggccgatttgagccaattcggcaaccaggggtcccagggtaagccccgaaagggcgcggcacagggagggaaaaactccaagggggtttcccggcccacggtgggcaa

SEQ ID NO: 558002 - DNA, 962 bp, Homo sapiens
aatgaccccaatacgcaaaactaacccgcctaataaaattaatattaagtcacgtcattgcatcgaatctcccgcaaacccattccaaaatctccgaatgatgaaagttcggctctctccttggcgcctgcgtgatcctccaaatgcaccataggatgattccagagcacatgcacatacatcgccagaggcgcgtcaacctgccttttgatcaatcgccaagatcatctcgagatgtgaaatatggctgaatcatccgtgtaccttccaccggctgatggcgccgtcaatattcgtaactcgtgcgcgtcttcctacacatacgggcgatggtgctatatctaacggatgcattgcgtctaatgcagaatacctgaaagcatcgggcactttatcctcctgctagcaggtataggcaaaagcgcccaataggactatgtgcctcccgggaaggtgcaaatatcattgctgaggggcgcacagcctaattacaagactttactataccgccactcccataacatagtggacaggaacatagtttccaatggaaatctagacggaggctatgtgcacgtaagaacagtcaccgacgccctcacaacgacttctttggagctctttcattgtccacttcgttgccccctgcatgtattgggaaggccctagcaggaggtaccacctgctaatatcttgcaacgaaaaacgtggatcaagatgaagcccccataagagaattcgacgtgcgccgatttcccgattaaaaatccacgctttccaagcctgtaagtgacaccaagtccagaatgaacgccctgcggattaacttcttcttacccttgtcttcctttattgacattaatcactattcttcagcagacctccctattggcgacccaagacaacttataaccctaggccaaagcctttagaaacccttcccacattaaaggccgaatgaa

SEQ ID NO: 558003 - DNA, 749 bp, Homo sapiens
  misc_feature (29)..(29): n is a, c, g, or t
  misc_feature (62)..(62): n is a, c, g, or t
  misc_feature (71)..(71): n is a, c, g, or t
  misc_feature (78)..(78): n is a, c, g, or t
  misc_feature (83)..(84): n is a, c, g, or t
  misc_feature (109)..(109): n is a, c, g, or t
  misc_feature (125)..(125): n is a, c, g, or t
  misc_feature (127)..(127): n is a, c, g, or t
  misc_feature (199)..(199): n is a, c, g, or t
  misc_feature (230)..(230): n is a, c, g, or t
  misc_feature (234)..(234): n is a, c, g, or t
  misc_feature (245)..(246): n is a, c, g, or t
  misc_feature (250)..(250): n is a, c, g, or t
  misc_feature (258)..(259): n is a, c, g, or t
  misc_feature (267)..(269): n is a, c, g, or t
  misc_feature (274)..(274): n is a, c, g, or t
  misc_feature (282)..(282): n is a, c, g, or t
  misc_feature (302)..(302): n is a, c, g, or t
  misc_feature (306)..(306): n is a, c, g, or t
  misc_feature (313)..(314): n is a, c, g, or t
  misc_feature (317)..(318): n is a, c, g, or t
  misc_feature (333)..(333): n is a, c, g, or t
  misc_feature (337)..(337): n is a, c, g, or t
  misc_feature (340)..(340): n is a, c, g, or t
  misc_feature (363)..(363): n is a, c, g, or t
  misc_feature (373)..(373): n is a, c, g, or t
  misc_feature (380)..(380): n is a, c, g, or t
  misc_feature (385)..(386): n is a, c, g, or t
  misc_feature (388)..(388): n is a, c, g, or t
  misc_feature (403)..(403): n is a, c, g, or t
  misc_feature (460)..(460): n is a, c, g, or t
  misc_feature (463)..(463): n is a, c, g, or t
  misc_feature (472)..(472): n is a, c, g, or t
  misc_feature (484)..(484): n is a, c, g, or t
  misc_feature (506)..(506): n is a, c, g, or t
  misc_feature (511)..(511): n is a, c, g, or t
  misc_feature (520)..(520): n is a, c, g, or t
  misc_feature (671)..(671): n is a, c, g, or t
  misc_feature (677)..(677): n is a, c, g, or t
  misc_feature (701)..(701): n is a, c, g, or t
gcgaaactcctgacacccttaaaacaganaacattgttattcacataataatgtggggctcngtctctgcngacaggngctgnnttcgggcattatctgtgccgtcganaatagccccattcacncnattcataaatgctgctgctaaaggaagggaaaagcggctctcccagagagggatccacctggaacacgagtnacctccaaagagctgcgaatgtttgagaatntgcnaagaggaaaannactnaatggganntggataannnaggcncgggagtnatagcaggatgtggtacttnaggnaaatggnnaanntgttgataacgagcntccngtnatagctcagggaggcaaacagcnacgggtaagnagagganaagtnnanggcatagacgctgtnctcgtgctcctcgtaggtggcgatcacgttgtcctgcaggggctccttgctcttctnttnagaacggtngtcctcctggtnactgatgtcatcgtcgtctacnaagtngccgaaggntccgacgagatggacaccatgttggaaaggatgactctgctgtcactgctgcccgtgaggaccagctggtcatgagagtggttgtagcggacgttccacacccagtgggagttctcctccagggtcttcacgggttcggtgacatttcggntgtccnagaacttcaccttacagtcgtctncgcagctggccaagtagtactgcttattgggattaaagtcaaggtccc

SEQ ID NO: 558004 - DNA, 390 bp, Homo sapiens
  misc_feature (10)..(10): n is a, c, g, or t
  misc_feature (40)..(40): n is a, c, g, or t
  misc_feature (43)..(43): n is a, c, g, or t
  misc_feature (124)..(124): n is a, c, g, or t
  misc_feature (139)..(139): n is a, c, g, or t
  misc_feature (251)..(251): n is a, c, g, or t
  misc_feature (299)..(299): n is a, c, g, or t
  misc_feature (310)..(310): n is a, c, g, or t
  misc_feature (350)..(350): n is a, c, g, or t
  misc_feature (364)..(364): n is a, c, g, or t
tccgcgacantaggacgcgtgagaccggccgcccgcaggnctnctggccgggacccgctggccgggagacgcgaacctgccggaccaccgcgcggggacgacggcggccatgagctcgcggaantgagcgtgccgaaanaggtagaatctcttgaacccaggaggtgaagcttgcagtgagccgagatcacaccactgcactccagcctgggcaacagagggagactccgtctcaaaaaaaaaaaaaaganttgggccgggtgcagtggctaaatgcctgtaatcccagcactttgggnaggccgaggtnggtggattcatgaggtcaagtagtttaaaggaccagcctnggccaagatggttnaaaccctggcattttattaaaaaaaa

SEQ ID NO: 558005 - DNA, 126 bp, Homo sapiens
cgctaactggtcgcaagtcaggcggctttgatgtatattttttaggctctcacaggtgatgcttaccctctgcagcacagggttgaaacactcatacatcaccatatggctaaggaatatatccac

SEQ ID NO: 558006 - DNA, 175 bp, Homo sapiens
  misc_feature (11)..(11): n is a, c, g, or t
  misc_feature (54)..(54): n is a, c, g, or t
  misc_feature (138)..(138): n is a, c, g, or t
  misc_feature (154)..(154): n is a, c, g, or t
ttacatgggtncgcttttcagaaaaagaaacagatttctggagggattcagaancatggctggaagaggtagtaaggccattgggagggcatgctctcctcagccaccccaccctgtgtggtctccattctgaaattncattcagatgaccggnctaggcagggacaaaattctt

SEQ ID NO: 558007 - DNA, 213 bp, Homo sapiens
ataattctgcttttcattaatttccctacttctaatctattacgtgtcttattagatctacgatcaatactatgtctttaagattctctgtattgtgcatgtggctgagtttatttttgctgctgtgtagaaattcaatttctacaccctcactcatgtattcaatcaattgaaacctatcgggaaaagaattcgcatccaagcctgcatgct

SEQ ID NO: 558008 - DNA, 636 bp, Homo sapiens
gaaaataggctagtcgaggctcggtgttaatcggccgaggggagacatccctgtctccagagtctttcagaatccagcaggctgcatgaagacctgccccctgatgacttggaggtggacaagtggacctgcgacagatggggactgtggtgccatctttgcttcatcaggacctggacagccttgggaatcagtgatgctcctgttacaggcatggtttctggtcagaattgctgtgaggaaaagaggaatccctcctccagcacgctgccaggcggtggtgttcagaacccttcatgcagacaggaatttgctggatactccatctcagacacagacagctccgatgccctcatgaattatgtattcgacagaaaagtgtccccaaggaagtgccaccaggtactaagtccatctccaggttggtcctgggaggcatggcccgatggatccttacacacacatcttcacagaatacacactcatggctcaagatgtaatgatccctttggagatctgattaagcccagcagacttgccgacatctcaatagtgatatgaccggaaatggattcaagaaattatgctccacattcatcccaagaccgggagcccctgggacacccagagggtaca

SEQ ID NO: 558009 - DNA, 210 bp, Homo sapiens
ccaccttcgcccaaaatgctgggattacaggccatcccaagtaacttttttaaaaaagtcgataatcacaatacaataaatagtctaaaggctgtgcgctctctagggtgaatcacgctatgctgaacatgttccctgatcggctgaagcagaggtacaaaatcttgccttttcaggcctattacctagctttctcatgaagtgtctcta

SEQ ID NO: 558010 - DNA, 905 bp, Homo sapiens
ggcagcggatgcagcgctctcgtcttctgcggttctcggagccctctccttttcgtttccggaaatcatggcctccggtgctggctgtctcgtgatggtgtcgagtctagaggatgttcgaagcggacatgagaggtgcagtagagtcttcagacgcacggaaggcaggtgacagaagcgtcaagcaaggcaggtgcttacttctgtccatgagtgagggacagagaagaactatcatcctggtaggaagggcaaggaacgatcctggatgggccgagtatgggtccagagctggtcgtacggagtcccgtacggcgcacctttgtcaagcatgcatgccagtagtaagcgacgtgccgtctattgcccgtactatggatgcaacactcttatcgcagactccaatggaggagccagagacacgcgaggactctgggtagttctatccttcggtgggactccgcgcggtagtccttgcgcactcgcctgtaagtgagcaacaattgcattctgatgacgcattgcctccatatgggaacgtcctagtcagacgcaatgcatatgctagaccagcgggactcgaaagccactggaacttggcgaacgcagaagctgactaacgagcgaggctcaacgggacctgctgcgagccactggctagcagacagcctcgggtgggccagtgcgctgctcagatcgtcgctctggcagggccaagcctttctgatggagccgcctttctggtccccactggcttgggagctatcatgggagaacccaggaccgtaggccttgggagggatcgcaaggggtgaacacccttactgccagaagcggaaggggctgggggggatcccaagcaggggcgagggcaatcccgttcactccaagttgacataatagac

SEQ ID NO: 558011 - DNA, 339 bp, Homo sapiens
aagtgtatagtcctcttcaacaatctgaaagattcaacgtatggataagcagcttttcaacaatatcataggaatactttgatttagaaatttaccttttctattgtattggcatccactccttgtagttgcaaccagtctataagctctctgtcggttcccagtccatcagggggtggagggttctctgtaccacctataatgattccaattttgttttattgtatagtaatgtataaccataaaatgctttaaaagtaacaacgtggatgtaatgatgtatcgcaacagaaatgtcatgtgctgtgaaaaggaaacgaattaaacttgtttgattca

SEQ ID NO: 558012 - DNA, 102 bp, Homo sapiens
gtgcctcgccgagtgtctagcctcgccactgaatcgttagcgctccttccttcttcctagcttccttcaccgaaatcgcactggcgaggcaggacgggtacc

SEQ ID NO: 558013 - DNA, 324 bp, Homo sapiens
  misc_feature (69)..(69): n is a, c, g, or t
aacttgtccagatgaaacaaacgggcaagattaccgagtccagaccaactccagtcccaacagccactnccacagtaccttcgtctctacaggccacagatggaccatcttatgccaggactgtgatcccaccagtatcaacttctggtcatcccaatgcagttggcacattcactgaaattcccggcagcaatattcgaagagtcattgccacgagattaactgaatctaaaagtactgtacctcatgcatatgctactgctgactgtgaccttggagctgttttaaaagttaggcaagatctggtcaaagatgtcattaaag

SEQ ID NO: 558014 - DNA, 871 bp, Homo sapiens
  misc_feature (300)..(300): n is a, c, g, or t
  misc_feature (330)..(330): n is a, c, g, or t
  misc_feature (421)..(421): n is a, c, g, or t
  misc_feature (435)..(436): n is a, c, g, or t
  misc_feature (439)..(439): n is a, c, g, or t
  misc_feature (446)..(446): n is a, c, g, or t
  misc_feature (453)..(453): n is a, c, g, or t
gggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattaccagatgganttcaaggcagtgcagcaggttcagcgtctnccatttctttcaagctcaaatctttcactggatgttttgagggtaatgatgagactttggattgaggatatctaatgatccatcacaaagngagtcatgggaganncanacttganggtggantataaactggttactgtaatagtgtgctgttcaggaaccgaggcgcactgttatagtcacttgtacgtaatttgagtacacaagatttcaaagtactgaaaactgagaatttctagctcaagtagtatcagtgatcaatttaaaatttggaggggtctaagggttacagccatgtgagcattaaaaagcataaagggagattatgtaaaggctcgttaaagtgtattatttacacacccagttagaccttgggtctttaacacaacagatgggagggcacaatgaaactttgtctccacagatggactctaacaggggttacaaatgtacaacgcggttgcaaagggatatcgtgggacaattagataaggaattaagaaattaataagacatttgaggtctatacaagtcatagtac

SEQ ID NO: 558015 - DNA, 365 bp, Homo sapiens
ctcaagtggtgactcaccagaagtcaccttgccagctagacagataatcggcaggacatgtagttataaagtagttacagcccaatccacacaagttaccaactgtttctcttctctagaaggaagcaagaagttaagaaatcccttgacttagcgcctggtgtgtcaggtgggcagtgcagagacagggctgttagagcagtgtcaaaaggcaccctggtgggccagcacgggtgggacatcgtaaataatcatagttggcttctaaatcctggtagcaagatgcacttctgattggtaatcttaggtaaattatagatcaatgaaaaaggccagtaatcatacactaagaacagagtataagg

SEQ ID NO: 558016 - DNA, 305 bp, Homo sapiens
ggggggggggcccccccccccccttgaaaggtggggtttgggggggcccaaaaaccccccgggcccgggggttaaacccccccccccggggtgggggaaagtgaaaccccccccccgggttttttttctttcccccatggggggaaaaaatttcgaccctttttaaaatttaacccccctttgtggggggcccccttgggggggggcccccccccatggggggtttttttttaaaggggggccccctttttaacccccccctttggggccccctttaaaaaaccgggttttgggtcctgttcgga

SEQ ID NO: 558017 - DNA, 946 bp, Homo sapiens
gtccgcttacccagaagcttgtgttgaatcttaaaacaactgttgtcatccgcgctaggagtatttgaaggtccgatgaatgacttatgtataccttacctaggtctcgggatgcagatatatctggaatagtgtaatgctaaagggtgtcagtcgcagcatgtctttgatcaagtggtattgttaaaaacagttcggaaaggacctgcgttacaagcatgctagtgcatgtagaaggtgagagtacgcttaagtgtaatagtaccatctattagtgatagagcaggagtattgaaaatttgaggtgcatattctacgtacactttgaaactacatgcgtgtctgcaatatgtgtgtcaacgttatgactggaacattatggcgagtgtcgtgagataaagatgtatatggtagataggatacgtcctgtgagatagatatgttgattatccgtagaatgcatataaatggttgatgattaccgtcaatgatcagtggctgtatagagtccatgtgtttaggattggtctgacattggaactcgtgaactcgccgttcatcgatgaaagttcgcgaagggagatatcgacgaaaagttgtgctatcagtgagtcccttgatagaaatttgtttagtagcaagtgtgtcttaattaacacttcacactaaattgtcagaccaagaaaacttcttgtggaagaatacgggtttgggtcaaatggttcgtttgaaaaaggtgagttaagaaaatcatggcttttgaaccggtttaaagtatggattgaataagccattgcgtagtgtggttgttaggccaatatattgaatgtgaagtactacaagtggcacctttcagtaatcttggggaaggcacatgggttggttggactaagaatcatttgtatgaaaaatcatactttgtgtttttgcttaagggggaaggttt

SEQ ID NO: 558018 - DNA, 265 bp, Homo sapiens
  misc_feature (7)..(8): n is a, c, g, or t
  misc_feature (32)..(32): n is a, c, g, or t
  misc_feature (39)..(39): n is a, c, g, or t
  misc_feature (43)..(43): n is a, c, g, or t
  misc_feature (55)..(55): n is a, c, g, or t
  misc_feature (86)..(86): n is a, c, g, or t
  misc_feature (93)..(93): n is a, c, g, or t
  misc_feature (95)..(95): n is a, c, g, or t
  misc_feature (123)..(123): n is a, c, g, or t
  misc_feature (145)..(145): n is a, c, g, or t
  misc_feature (147)..(147): n is a, c, g, or t
  misc_feature (157)..(157): n is a, c, g, or t
  misc_feature (159)..(159): n is a, c, g, or t
  misc_feature (201)..(201): n is a, c, g, or t
agagatnntgcccagagctttcagcgtgtcantcgaaancctnctcatggacacnccctccagattatgaggctggcatggaactnttcagcncntgatcaagacatgatgggaggcaggggntcagctgaagaagctggtgganancctcccccanangcccagagaaagcatcattaagctcatggaaaaaatagcccnaagctcactgtgtaattagcatttagaagctgaagatccccaactgctccagcctctccgctgc

SEQ ID NO: 558019 - DNA, 318 bp, Homo sapiens
  misc_feature (265)..(265): n is a, c, g, or t
cgaataggaacagctccggtctacagctcccagcgtgacgacgcagaagacgggtgatttctgcatttccatctgaggtaccgggttcatctcactagggagtgccagacagtgggcgcaggtttgatctcagttactcccttacttgaagaaggcttcgatgattcctcatggagaaatcccagatacttctgcacatgattcagaggtcccttacaactggcttcagcctgccttccaagacactgtctctgcctctcccttnctttcaccgtgcttcagcgagatgctgtgtttttttgcaaatggacggtttgg

SEQ ID NO: 558020 - DNA, 102 bp, Homo sapiens
gttatcctaaaatacactaaagctagatttagaaaatatacctgggcacagtggttcacgcctgtaatcccagccctttggaaggccaaggcgggtggatca

SEQ ID NO: 558021 - DNA, 884 bp, Homo sapiens
  misc_feature (884)..(884): n is a, c, g, or t
aacactggtacataataggtgcataacacatcttagagttgtttaataatagataagaaccaagaggaaacacagaatataagaaaagatgggggaaaggaaggagaaaataggaaatgaataggattaggaacgtatgggcgatttatattaactacgaaaatggtgtaaacggcctgaattatcactgtagctagtatcatacgggggaaaagtgtgatggaaaataggtcttgaagaatcttaattcttaaaactttagtaagctttatgtatatttttctaggatttctctgaacatagcatgaggagggtttagattcatttttctgaaaaacgatgtataaaaactacctaatttctttttttcgagtgcccacacttgccgttgtgctgtatacatgattttaccttaatcctctatagggtaggtgctaatgtctccattttatcgatgaggacagggctcagagaaatgcagaaacttggctaatataacacagctgtgacagagctcgaatttgagcacgtctgatactgaagcccatactctgtaggggaggctctatgtgctgcctcattaaagaacttctggtagaatggtcagcgcttaaggagccctagggatgattgtgtcctataaaagaggtgggtttggaactttggagagtgctatgcctccccccaataatttccttagtagccctcttcataagacaaaggtttgggccttggctcaatttagaaccctcccggtgccgcaggccccaaagggggggcctcacttacaacgacggcgttccgtggaactcataaaccccgcttgggcgcggacccgccttagattgggatatacaccacaacgcgagccgcgcaagaaaatn

SEQ ID NO: 558022 - DNA, 383 bp, Homo sapiens
  misc_feature (378)..(378): n is a, c, g, or t
tgttagaaaccccgggcccacacagcaggagatgaagtggaaagccaagtgaaaccttccatgggtatttacagcaattcccccgtcgcctcgcattacccacctgagctgtgtctcctgtgagatcagcagcagcattagattctcaaggagcacaaacccttttggaactgtgtgtgagggatcctaagttgcgcatttcttatgagaatctaatacctgatgatctgttgttgtctcccaccacccccagatgggaccatctagttgcaggaaaacaagctcaggctcccactgattctacattatagtgagttgtgtaattatttcattatatataacaatgtaataataatagaaataaagtacataataaanttatg

SEQ ID NO: 558023 - DNA, 1650 bp, Homo sapiens
  misc_feature (217)..(217): n is a, c, g, or t
gtgacgcgtgttccgccgcctcaacgtgaccctctcagtcaagccagtactagtgtctagcaccacgagacagctctactcgattcactcgccgttagtctgccacgtgtgccattgggggcgcatcagaatgccacgacacgcgcagaatatcctcctcgacgaatgacctcgggtctatgatgcgttgtcgcctgattgaatgtagggcatgtgnctcgcaaagtggttcttgagtataagttgaggcgtagaagtagaagcaaggctgggtacccttcaccagctgcgcagctcctcgaggacgcgcgcatgtgcaaggcctttggcgtagtggcctgtcgtcgctagcgctatctacgcgtcaacacacccttggccacatttttggcttgtcagtacccaattggttccacttcagtagtgggcctccaagttagtctttcaagcttatctaagcggacagcatcccgagtccagagacttgtgctatacattaatgacactcaaaaccgatgctgaggtcaaaaactggacgacgtgcaaaggccttgcctggcggaacttggcgccctgggggacccatatatgggagcttccgtatagaggtccattgcttcgtgtgtaggtgccaccctataggggtgtgagctcctttgtagcgcgcacgatccaaaggtcgaagatacggctctacagttgtgttgcactttgcggatttagactcgcctagaaaaatccaattttgcgcttttcgtgggtcgatttgataggcaaaagaaccgatttgccgtgcaaccatttccacaagtaggactcctgacctcttgccattttttcggcgagaagccaaggcggctcagctaagtttcaataaccagttaaatctcccaatgtggtccatctcgtgtgatggccataacacttctgtttgcggacttcaccggtaacgggggtccaactgttgaagacaccctgttgccgtttatcccgaatcctgaacgccgtcctaaggctagacaccacagcgattagagccaccgttcccccttatttcccacgtcagcatggtggaattcattctcccacaatatacaaaccatggtgaaatttaactcctcccgcggaaacatatacctatatgtcggcccacctaggaaacgtctgttttgataccaatcacctctttcgaaacctgctgggtggaactttaggacgactctattctgcatgtagcaccgggcggagccacccagctggtggcatctaatatgtggcctatctggcgaaaatctacccggagatctgagcgccctttatcagaaacctttgccgctagtattttcgcgaccgcacttcgggggcggcaccaacctttcatcccacctagcgcacgttttgtcgtccactataatgtattctaagccacacccagtatcggtgtgggctcaaacagaccagggtatagtctttgatcacacttgtgtggtaccgatttacacgcattggtcacacattggcaggacacacctctacgctattagctctgcaacacttcgttcgtcacacacaagatgggccaatctggtgtccccgtatagtctcctccacagcggcactgtgtgcctaccctgcctggcacttgtatgg

SEQ ID NO: 558024 - DNA, 121 bp, Homo sapiens
gacactggcaacaatgtgttcatccaggaaaatgaataagaaaatattggacattaaccacactttgaaccaaactggacttaactgatatatacatgaacattacctctattgcagtgaa

SEQ ID NO: 558025 - DNA, 160 bp, Homo sapiens
tctaccttcgactcacatcagataggcagactggagagctacacaagccttcctgaatttaggtgcccaatacaattgctggtttgtgtagagacagcccttccctttttacatgacgagaatatttctccccatgcgcactatgtagcagcgctcagag

SEQ ID NO: 558026 - DNA, 881 bp, Homo sapiens
gaattcatctataacgagtgtagtgttcaaaaggacaagataatcgaactaacttgttctgctgcgcaaatctaaaatttaaaattaatcttgcttcattgtcacatgtaactatattctcagacattttcactggaacgatttatgaacagaaactattggtctgaaagttagagattttacaaaatgctgcacacaaaatattttcctagcatcagtagataccctggcatatgtttctgctagcctatatatttaggaaattcaaagcatacaaactttggcaacatcttggctgtctagacacagtgtccttgtcaacccctctcaggtacctttatcttgggatgcttcattcatgaagccaagtacaagtgcttaaggtttgtatttcattaaattagcctattacttgatcccctgttcacagatgcctttctgacgtgtttcatcagatcactggcctttatgaaatcagcctggtattattcgctttacctggcaacagttacgtcattcaggcatctaacgagaacgtacccttattcagtgcctccttgggtaaactcacaccacattctaactcaacagtgtcaccacgattatttaacaaacatcagtataactccacttactgttttttccacaaaccatcatgtcaacgtggggcagggaactggaagttcttttttccttggaatttcaccctttgacaccaagtggaccacataaatttggcccaagctgaagcgatattgcacaaaagcggcgtgaaagcagtacagaaagcaagagaagaataacggaggctgctgcaaaagaccacaaatcctgcccgataagatgataagagagcaccatcgctatgacaagaaaacatg

SEQ ID NO: 558027 - DNA, 413 bp, Homo sapiens
ccctgctatgtcaccggctgggtccgcctctggaccatcggccccattgctgataagctctagcaggcctgtagcccgtggtggatcacgccacgtgctctaggattgtctggtggggcttcaggttgtagaaaaccatggtgtgcgctgtgggcgatggcgtcatcttagcctgcaatggggactccggtggcccactgaactgccagtttgagaacgtttcttgggagttgtttggcatcttcatctttggttcctggcggggttgcaacacctgctagaagccggtagtcttcatccgtgtttccgcctacatctactggattaacgagtaaatgcagctgtgattgtttgtgtggagcggcggcagtgtgtccctgtaacagcaataaacttccttctcttctgaaaaa

SEQ ID NO: 558028 - DNA, 175 bp, Homo sapiens
gggtatcacagagtctcgcgtagtcaaagccactggtcttctgttgatgtcattaaggaatcacaagacaaaggccagtagagagggttaggccgtgtatgtatcgcacaaactgactgaactatactaatgaatcagtaacttttttgttcaggtagacaatcgatgattgggg

SEQ ID NO: 558029 - DNA, 230 bp, Homo sapiens
  misc_feature (106)..(107): n is a, c, g, or t
  misc_feature (230)..(230): n is a, c, g, or t
acccacttcaccttaccaccagacaaccttagccaaaccatttaccaatagagtatagcgatagagattgagaccttgcgcaatagatatagtaccccatggggcnngtgagagattttatccccgcgctaatatatgcctggggctaaccccctatatccctctgcataatgagttaactagagatagctctgcaaggagagccataagctatgacccccccagaccan

SEQ ID NO: 558030 - DNA, 203 bp, Homo sapiens
cggccgatccagttttattcttttgggatctgtgatgtcatcatgacaggccttgcagtaaaaaaatgcccttttaacttcgggggcgtggcttgcgatgaaaaatcctaaagtaccttcttggatcttaagatggtttccaggattaattaatatacggctctctcggttggcagacttgtactcaatggctatcattaaga

SEQ ID NO: 558031 - DNA, 436 bp, Homo sapiens
tcgatttggctcagagaaatggaggtcaagtgactggctgaaatatctatagaatcatgattagactccatttatatcctagatcccacatagttgcttcctttctgtgtaattagatataatagtgtaatcaatcacccctatatggagaagcttgctggacagagataatgcatattaatggtagactttgctttagtatctgatctccctcactttttgtgtttctaagttctcaaagaagtcagatggacacattaaagaccaaaggctggggggaagagcaaaatcacggagtcaaaacaactcagtttgtaccaaaacaatgtgagttcccagatttagccttgtcttaatatattgaccttagtacatgctacagtgttcatatgaggtagaaaattgacattcaagtgtagatggtgtaccaaaatac

SEQ ID NO: 558032 - DNA, 135 bp, Homo sapiens
agtgtcttcaagatcatgttaggtctgtttctgcggtgcaatgcatctatagatgctgctgaattactctgcagccattacgataatttgaaagcacgacatacttgtcccttgaaaagcattacattataaact

SEQ ID NO: 558033 - DNA, 1173 bp, Homo sapiens
cccacgcgtccgctttcttttttttttataagacacatctatttatttataatcaacccactgtgtataaaggaatactatcaaaaggcaagtataagtctataagtgctaccaacacttatgtgggtccacttgtgtatatcacacttgtgataccacacttctgtatcggaatacagagaaaagaagaacacatcccaacagtgcataaatacaccatatttaaccacctctcaaaaacattggtatagatctcaggcaggtaaccaagctgccggatattaccactctatcgtggtgacaagtgttacaggaggcagcaatgtgtaagcgcaaggcttaaataagacaaggaggtaaccaaagtacacactaaccaggaattagggaaatggagccaggaatatacactactgcatggcctgaaaggtttcaaaatcctacaaatatatacctgactatcccggaagtggacatcagcgaaccatagacgcataacttacacgtgaaggctaaccaaaaaacatacctataaactaacgcaccacaataacacctcaaggtggcaaactccaacagcaaagtgcgcagaactagggcaagataccccaccaaaaagggggtgacacaaatagaagggcaaaacaacaacaagggggaaaaccccaaataaaggatatcccgtgaccaacaattcaaatgatcccaaaaggcagcaaaaatagatcaggacgaagacaccacacaggccgtaatcgacacgaaacgaaaaaacacacaaacaaaagaatcatccagacaaagacaccacgaaagagagggaccaaaactataccaacccatgtgccaaagcacaaacacgcatggagacaaaagtacaaaagggcaaaagataaggggacaacggcgccacacacaaaaccaaatgaaagggaccccagaacaccctgaaaaaaacaacaacaagatggcgaaaatccacaaaaacgaacatacaaggagaaaaaccacagctgacacaaagcaagcagaaggggaggcaacaaaacggcaacaatagaggaagcaaaaggaccacacgaggcaccacacgaaaacagaacaagagcacgaccaagacaaacaaaacacaaaccaacaagacaaaacaagaggccgcacacaaaagacacg

SEQ ID NO: 558034 - DNA, 877 bp, Homo sapiens
acatagcatgggactaaccgctataccttctgcataatgaattaactagaaataacttgcgaaggagagccaaagctaagacccccgaaaccagacgagtctaacctaatgaacagctaaaagagcacacccgtctatgtagcaaaatagtgggaagatatataggtagaggcgacaaaactaccgagcctggtgatagctggttgtccaagatagaatcttagttcaactttataatttgcccaacagaagccctctaaatccccttgtaaatctaactgttagtccaaaggaggaacagctctttggacagcgtaggaaaaaagcttgtagagagagttaaaagatttaacgacccagtagtaaggcctaaagagcagacaccaattaggaaagcgttcaatgctcaacaccacatagctaaaaaatcccaaatatataactgaactgcctcagcacccaataggagcaatctatcaccctatagaagaactaactgttagtataagtaacatgaaaacattctcctccgcataagcctgcgtcagattaaaacgactgaagctgacaattaacagccaatatctacaatcaacaacaagtcattattaccctcacgtgtcaacccaacacaggcatgctcataagggaaggttacccaaagtacagggaactcggcaaatcgttaccccgctgtttgcaaaagatcactctagcataacagttttagagggaccgcctgccgcgacgcgtggtaaccggcggggcccaaccgggcaagggcctaatcctggccttcaaaggaccggttaatggcccaggggcgggcctattacccggaaagcgcgcaaagggggaacaaaaaaccgggcatagc

SEQ ID NO: 558035 - DNA, 301 bp, Homo sapiens
ggaacatggtattgcaggtgcacatgtatgtacatgtgcaggtgtctgtgtatgtcatgtatgtggcagtgtgccatgtatatacgtgtgcaggtgtgtatgtgtgtgcatgcatgtatgtggcactgtgccatgtgtatacgtgtaggtgtgtatgtgtgcatgcatgtatgtgacagtgtgccatgtacatacgtgtgcaggtgtgcaggtatatgtgtgcatgcatttacgtggcactgtgcacatgtacatatgcaggtgtgtgtgcatgtatgtacatgtgaaggtgtgaatgtgt

SEQ ID NO: 558036 - DNA, 122 bp, Homo sapiens
tgtggttatttcaaacttgtttaagggaagagaggagaatattggctgcagccaacatgcctgtcctaggtgcctctagcataaatccttacacaagttcttcagttttcacgaaagacaga

SEQ ID NO: 558037 - DNA, 601 bp, Homo sapiens
tcatgtacacatgtggtacgtgccaatgcatcctcgtgccgaccgcgacacccgggagcgggggctcgcgggccgtcgcactcatttacccggagacagggagaggctcttctgcgtgtagtggttgtacagagcctcatgcatcacggagcatgagaagacgtgcccctgctgccacctgctcttgtccacggtgagcttgctgtagaggaagaaggagccgtcggagttccagcacgggaggcgtggtcttgtagttgtcctccggctgcccattgctctcccactccacggcgatatcgctgggatagaagcctttgaccaggcaggtcaggctgacctggtccttggtcagctcatcccgggatgggggcagggtgcacacctgttgttctcggggctgccctttggctttggagatggttttctcgatgggggctgggagggctctgttggagaccttgcacttgtactccttgccattcagccagtcctggtgcaggacggtgaggacgctgaccacacggtacgtgctgttgtactgttcctcccgcgggtttgtcttgggattattcacctccacgcggagcacgtgcgggca

SEQ ID NO: 558038 - DNA, 365 bp, Homo sapiens
tactggtatcgaaagtattctgtccccgttccccagagcaaggttggctcagagccctcctaggttaggtcaggttggtcccaggttaaggcaggggagcttaagtaccactcctccctgcagtgtggaatgcttagactgggatgttgctagagggacaatgggtgggtgctgtgcatctccacacagcactagccggtggccatggtccgtacgtgattctttacacatcctgaacatacctgttgctggggctgttccatataggagaagggtgtggggccctggcatccctcacatttcctaggaagggccagcgagacgttccacaggggcaagggggctggggtcatcatccctcactt

SEQ ID NO: 558039 - DNA, 342 bp, Homo sapiens
catggcgggtcttctactcattcagacttaacgctacgcacacgaaggcttctccaacatctgacacttatccacataatgctgtaagagaacatgaatgaccccacagcatgatcagatgtctcatgtggtgtatgccctcggggtcgtccgcagtcacgtcgggacattccggatcggccgagaaagtgttgtgggaagaaagttagatttcacgccgatgaatatgcatagtgaaatggatttaggcgtaggtttggtctagggtgtcagcctgagcataggggcactcagtgaatgaagcctcctcatgatggcaaatacagctcctattgatcagga

SEQ ID NO: 558040 - DNA, 513 bp, Homo sapiens
acttttcacactgttgttctttttgttttagacatttgcccccatttattgcataaactttgacccttgggagttttacaggaaaaggacaaaccatatggtccggtttttatataaaggaaaatttcccttggggattttttggcacacaattggttttgactttggggaataaaagccgacgcaaacgtagctgcccaggggtggtcctgtaaaacgcctgaatcaatagggtgtgaaagcttattgcaaatggttaattaaattgggtgatgactgaaagggtataaatccttcattccagctccaggagcggagccccttttacaactgggtttccagcttgacagggcacaaatttcaccgtgccagttttcccagctgtcatactattttgcattttaagggcttcaaacacacaaattttttggccttttgctacctggaatggccaaaataggcggatctttacagacagactcccggttccctggggttaaaaagggaaggggt

SEQ ID NO: 558041 - DNA, 261 bp, Homo sapiens
caatggagagagaaggtgcagcatgacacacacaggtattcccacactctcccaggcacactcagctggagaacacacactaccctagtcacactgaagaaggcagcagcagtgaaaggagagaaagcccagggtcatgtttctctcgagtgagatctgcacagactctcaggcagaccctcagggaatgggacttatgcttgggctgagcttacttggtactccatatgcccctttgctaatgccagataaccctaaaat

SEQ ID NO: 558042 - DNA, 234 bp, Homo sapiens
  misc_feature (39)..(39): n is a, c, g, or t
  misc_feature (124)..(124): n is a, c, g, or t
acaggatcttaccacggtaatttgccagttaagaagatnagtgtcatcaagtatcgtatgccaagtcttaagctgcaatccttaaattaaatgatttgagccgggtgcggtggctcatgcctgnaatcccagcactttgggaggccaaggcaggtggatcacctgaggtcgggggttcgagaccagcctaaccaacatggtaaaaccccatctctaccaaaaaaagaaaataca

SEQ ID NO: 558043 - DNA, 302 bp, Homo sapiens
  misc_feature (6)..(6): n is a, c, g, or t
  misc_feature (33)..(33): n is a, c, g, or t
  misc_feature (118)..(118): n is a, c, g, or t
  misc_feature (136)..(136): n is a, c, g, or t
  misc_feature (251)..(251): n is a, c, g, or t
cgaggnatggaaaagaggatgggtaggataagntcaaactgcctttaatggcctaacaaaattcaccctttattccctttttatttttagttgacatgtaaaaattgtacatatttantggctacagagtgatatnttgatacaagtataaagtgtgtaatgatcaaatcagagtaattagcacatcaatcacctcaaatagttatcacttatttgtactgggaacactcgaaatccttttctagctttgnaaaaatatacaataaattattgttaactgtattcaccacatagcactatag

SEQ ID NO: 558044 - DNA, 835 bp, Homo sapiens
tactgcagtcatgggctcaggacaggaacacagtttcagtgaaggcaggatagcgaacgtccagtaaaagagctcaatgaatgacagccactctttcctgtgctttgtattgtgacagtatcgtgtggtgaaatctggatagttcagggacagttggaatactaggtagctatagttgagtatggatgtttaaggggctttttacagagtcgtggtatatactgtgctatgagagtttagaaagactcggaagtacgataagattatcagtgaaacagaatagtattgcctcaacagagagcattttgaagtttacactattggacaggaagttagggtcatgggttactttagacaattcagtgttaagggggtttccaggaatatgactgtcaacaatgcccattaatttgtttttgttcactcaagttgtctgtactctgtgtggaagaccagcgatttgggctgtgatatggcggtatttatcgtagaatgggatttccagtttatggaaagttacatatagggcctttggacctaagtttgtttaatttgtaaccaaaagagattttcaagttacctcaacaggtgactgagtgtcaggactgtgcacgattggtcataggctcaccaatatattcatctaatctttcagaaaattaacatttaggttattattaaaaatggtatccatgtggggcagctttagggtttcctagatagctgacacgtccactgtttatagtccacaatggtacacgtgtcggaaacggaaagggtggctgaatttcctcagattgccgtttacgatacagaatttcctggtccgcaaaaa

SEQ ID NO: 558045 - DNA, 497 bp, Homo sapiens
  misc_feature (167)..(167): n is a, c, g, or t
catgccacgcaggtttgtgaggtgaaggaaaaaaatgttccccgttctggtaaaaaacgggagaagggcccccaatttttgaagtctggggaggccccccttttttaaaaggttccgggccaccccatgggggtgaaagcttttccaaccacccccccttggggcgnttcgtgtttgttaaaaaacccccccgttccggggggggttatcaaacccggggccaaaaaggggggtgggggtggcaaggtcccccagtttcccccaaaagctcaaaggggtaaaagaaaattttccccaaacccccccccccccctttttatcaggggggggagaagggtttcaaaaccgtttgtttccattggccctttaagttttgggggaaaaggcggggttatgaaacccaggccttggtaacccctccaaaggaaagggaaaattttttgggccccccttgggttttttttttggggggggccgttttaaggtattagttttta

SEQ ID NO: 558046 - DNA, 666 bp, Homo sapiens
tgcttctccatgtgtataatcgctggacgatgagattcctgatatcttatcaatcttgacagttgcctgggttagaagggatctgtcgagcgatgcctagctgatagctgtcagaagccttaaacatggctgggcgtggaggctcacacctgtaatccgaacactttgaagaggctgaggcaggaggattgcttgaggccaggagttcaagaccagcctggacaatatagcacgaccccatctctgtggggaaaaaaaaattagctggtttggtggcatgtgcctgtattcacagctacttaggagcctgaggcaggagaatcgctgcttgagtcttaaaaaaaaatgctgggcatggtggctcaacacctgtaatctcagcactttgggaggttgaggtgggaagatcagttgacccccaggagttgagactagcctgggccatgtagttagacctcatttctgttaaaaataacaacgacaacaacaacaagccttaaatacttacagtcaggccaactgatttagcatttacctaaaggagatttatccccaatgaaagttggaccttcctgaggatgtccaatggagttatcatagtattataaccatgaacaaggcatcagctgggtacgagctcgaatcgtatctgctaaggtacccaca

SEQ ID NO: 558047 - DNA, 838 bp, Homo sapiens
aatcagcaccatcatcaccaccatcaccatcatcatcactgtcatcaccaccatcaccatcatcaccaccatcaccatcatcaccaccaccattaccaccatcatcatcaccatcatcaccaccatcaccaccatcatcaccatcatcatcaccaccatcatcaccatcatcaccagcatcaccatcatcaccaccaccattaccaccatcatcatcaccatcatcaccagcatcaccaccatcatcaccatcatcatcaccaccatcacaatcatcaacaccatcatcagcacaacagtaccatcaccaccgtcatcatcatctatcccacagagggtcactagaatgctgtcatggcgctgaacacctggaatggtagatggtgagaaactttcaccactttggtctaagacgaacactgtgcacaacagatgcagacatccaaagaagagcacccataaaagcacaggtgacccctagccagacaaaaacgatagaacgaacaaacacactaccaatcacgggaacaaaaactgaatgcatgacccgagggcaaagagaaacggctgatgcacgcaaacattactagacgcaaatatcaacaccctactgaaaacatcaccatacatgaacgtcccagcgaaaaactcaattgaagacgatcagagactataccatgggcaaaaacaaaagatcggatccccaaggagacattgcagcgacgacaaaccttctctccagaaaacccaggaatggcttggaccatcatctggacagaccccaggacccactgacagacaagccacggcggtaacacgccgtgcagaggacaaccct

SEQ ID NO: 558048 - DNA, 348 bp, Homo sapiens
ttggactctattaacaatttaccttctggaaaacatttcccccttgcctcaagttggaagctttttgtgttatcaattaactttgtagattcccaaaattatattggctgagtcgcttgtatctttcctatgaaaaccttcctaccaaaggcattggccttcatgggtgttacaaaccacttcttgaactcacgtacatgggtctcagaggctgcaagtcaaaggtttgcactcacatacaaatcaaaccagagggggcctaaaagtcctctttcccagaaggccccaagagcatgcttttttgctagagaaaacccagaggaccccatttttggcaagtttatagaa

SEQ ID NO: 558049 - DNA, 80 bp, Homo sapiens
gcggccgcctactactactactgctcgaattcaagcttctaacgatgtacggggacatgtttacaaataaactgtggtat

SEQ ID NO: 558050 - DNA, 335 bp, Homo sapiens
gcgctcgggttaagcagcagctttagcatctctaaagaagtatggcgtggggacgttgtggacccagaggggttttatggcacatttgatgttcatttaggatttggaagaccgcctggcaaaatttatgaagacatgaagaagccattatatactcatatggatttgccacctatagccagtgctattcctgcttactctagaagaggggacattgttattggagatagagctgcctgtgttgctattcagaaaggattacaggcttcccgtagtgacattaagttatttaagcataatgacatggttaacccgagcgctaccagggtaccgag

SEQ ID NO: 558051 - DNA, 160 bp, Homo sapiens
gattcttttttttctttttttgggatataaaaaactggtttctaatcctagccatatagctaatctactttgtgacattgggccagttcttttccctctgagagctttctctgcacaaatggagaggttctcccctggtatcagaaaacctggattcaag

SEQ ID NO: 558052 - DNA, 867 bp, Homo sapiens
  misc_feature (624)..(624): n is a, c, g, or t
  misc_feature (732)..(732): n is a, c, g, or t
  misc_feature (859)..(860): n is a, c, g, or t
tattccttgagtaattgtgtgttcttgtaaaatgcaaaatcaatttacatgcaatcaggtatggacacaagaaatgcttgtgctctcgatttcaggactcacagataccataacagtcacgggactgtagttcactcagtattttttgttaataatgtggctttgctataaaataacttggtgtttcctttgctttggtactacaagattttaaatgttgcagcaaatgaaagaatgaaaacacatttgaaagctggtgtcaaaaatcatcagctgtacttataaaagttgttgtgcagcttctgaaatgtagtttattgctgtaaatatgtacaatttatgttagttcgtttattctgaaaacacaaataaaacttttttttaaattacaaatgcctacatataaaaagcttactttgtactacgttttaaaacatgcaagatttcaggcatatctttttataatccttaaaaatgtttagaattttgaatctatcatttgagaacttttattacaaaatttaatacaaagctacatccctttatttggaagaaattcatttcaggattactcaacaatcaaaaaaaaaaaaaaaagataccagcacatttccaggagcttgngtctgtaccactttgatttttttaaatattatttaagatgacaacatgccttacaaacacttaaacatatggggtgtttatactagaaaaggagaaatgaacagaggncttgttttcaaaaataatgcctaaaactggctaattggcatccctttgtgagggcgattatgtcaaacttttttgaaaaattgccctgtaaatattgaaattaaagttgggctatttggcagaactnnccgggtg

SEQ ID NO: 558053 - DNA, 247 bp, Homo sapiens
  misc_feature (1)..(1): n is a, c, g, or t
nagcattgcctacttattttacttctataaagctagtataacgttagtaagatgtaacgcggtggatcacgtttacctgactgtgctgcccctttcacatcaaagaactactgacaacgaaggccgcgcctgccttacccatctgtctatctatctggctggcagggcaaggcaagaacttgcctgtcggtgccggcagccgtggggtggcagacagtggggtgggacgacatttgacatctacgac

SEQ ID NO: 558054 - DNA, 191 bp, Homo sapiens
aggcatggggcaggaccagaggggacaggccctggattctcactacatgtgagatcttgaatcacttacttagtactgtttgtttagttagtatcatctggtaaaatagttaacaagcaacaaaaaactctgtatctgtttctagcatgtgctgcatagactctattaatcacatctcaaattcaccctag

SEQ ID NO: 558055 - DNA, 122 bp, Homo sapiens
agagcatcccgatggcgtcatctcacaacgttcaggttgtacagaaccagccacggtcagagcgttgcggtccacgccggcagccaggttgcgctggtcgtacgacacagccacgcccgggg

SEQ ID NO: 558056 - DNA, 964 bp, Homo sapiens
acaagcccgggccgcggccccgccttccccgccgcctcccggcgctccgtgcccgccccacgaggccggcggctgctgctacctggggcctgttgcttgcttgtgcctgtgatgcgactgtgccagccattgtcccctgcctgctcctgtcagcctgcgccctggcctgctgctgctgcacctggaaggcgcattgtgcgtcttgctgggctccgtggcctgggtgggcaggatggcctccacagagcctgcatggctgcgcatggtggagcctccgttgatgcctgcgctgccgccctccgatggcttgcatcctgctggaatgccctggctcccctgatgctgctccgggccctggccctggtgccccggacctgagtgcgtccccatgaatgtgctgccctgggcttggcccagtgctggcctgtggctagagggagaccccggactgggctgccctgagctctgccccagctccgaggcgcggtcgccggagccgcctgccaaccgccttcaagacttcgacacgctggtcaccgtgggaaagcaactagaagccatttgtgtcaaggtaacgtctggagaaacaaaatggtcaggaatgaccaacgtccctactggccacagtccagccccaatctgcaagacagagccagccgcccgggggaattccctgcctggtgggactccaagtcaccaagcccagctggtcaggggtacagcccctcgtgagaactgagccacagtcatgtttcctacattaggctcctgctcaggggtatgtaccagagaacactggcatgcctctaggttggtccctgaaaaagagacgtccaggacccaagggtccaattggggccaggaacattgttgacccattcgtcggctccaagttcgcgaatggaccattgtccatcagtcacgcacgctaataattccaatggatacaacatttgggacttag

SEQ ID NO: 558057 - DNA, 977 bp, Homo sapiens
  misc_feature (977)..(977): n is a, c, g, or t
ccgccaccacgcctggctaatttttgtatttttagtaaagacggggtttcaccatgttggacaggatggtcttgatctcctgacctcgtgatctgccctcctcggcctcccgaagtgctgggattacaggcgtgagccaccacgcccagccctttctctttttttttttttatactcaccacttatactaacaagggctcttttcatttatcttaggggggggggttgacattgtacacaagtttctctacttggatgaagtttagttcatcacgtggttcctttcatggatcatgccttggggcgtcgtatcttaagaacttttggaagtcttctggtcccattcttacatgtaggtactgtgatccacttggggtccatctcggggcatggtgtaagggcaagagtctaaattcatctttctcatggaccgatttccattggtccaaggcaccattgtgttgtacagtatctttcccccatggaatcgcttggataccttggtctcaatcaatggggcctcaaatatacgggtccatctctaaactcttagtatcggttccatggatctgtgcctgtccaggatggggtgtaatggagacccggctttaaagtatgggaagtcataacatccggtatgtacaccctcccacttggtattccacaaatcttcgactttccagaaatggattccccgattcactatatagacacagattgcagaacacagaaagccctccgcggtcacacattcttgtgcacctcacacgtgacactgccctcgacaatggagtaccctggacacagagggggcacactactgcgacgacgtataacgcaatagtccgaggaacatccccaggcaacggatctgcgcagaccagacgcgtccatctacgagagatatacgtactaatcacttgcgtacgccagcagtcatgctacagtgtactatagcacactcgaccaagcactgn

SEQ ID NO: 558058 - DNA, 148 bp, Homo sapiens
tcttcagtgactctaaggatcccccaggagtgcccagtgcccgatcgagtgcccgctgaatccgacgtctccggcccggccgcgggggtgatcactgccgccctgcgccgggcgatccggagccagaccggtgccgcccgcgcctacg

SEQ ID NO: 558059 - DNA, 618 bp, Homo sapiens
tgaggctcagagtggtccagtcatttgtccaaagtcacacagcttgtatgtcacagactctttttcagtggtcttttgactgtaacccctcactctgaaactacatatccaccacttcccaagtaacccagcccccacaaaattggtgatgatgattattttcatcatatccacattccaaaggggactatcttccccaagtgcattcagagatgtggctagcgatgggagcatttctaagtagaacagaacttggaatcaatattcatgttccaaagccacaatcctgggaaaaaaatgtagcaaagaatagggcacacacacaaagaaagctaaaccaaatttcagcaggagattttatagctctctcctgggtggcttgctcttacccaggcgtttaatcgaatgtggacatcaaggcagcttgcagcacgactgggaaactcacatggggctgccatggctgcaccaactctgggaaacctcattaatttctgaacgagaaatgatttcctttcttggccacagtctgagatgatggtgtgtggggggatggattttaaaggactaggtttttgcatgagctgtggtacttccctgcccaagacttttccctga

SEQ ID NO: 558060 - DNA, 94 bp, Homo sapiens
cggatctctccgctcccttgtgagtgagcaagcgggacagttctgcggaaagtttccggccccaatcccccagccctgcgcccggactgaagcg

SEQ ID NO: 558061 - DNA, 379 bp, Homo sapiens
  misc_feature (8)..(8): n is a, c, g, or t
  misc_feature (23)..(23): n is a, c, g, or t
  misc_feature (47)..(47): n is a, c, g, or t
  misc_feature (85)..(85): n is a, c, g, or t
  misc_feature (152)..(152): n is a, c, g, or t
  misc_feature (159)..(159): n is a, c, g, or t
  misc_feature (167)..(168): n is a, c, g, or t
  misc_feature (183)..(183): n is a, c, g, or t
  misc_feature (195)..(195): n is a, c, g, or t
  misc_feature (197)..(197): n is a, c, g, or t
  misc_feature (279)..(279): n is a, c, g, or t
aaaggggnactaattgaaaaggntttccacaccctgggggagaacangcatacctacaattaagagagtgaacatatcccatcancccctcaaagtgtcacaatgctcctcctgatgactcctccccagaaaaccacccaatcggctttcantttgcantttgtagnnttatgtgaatggaancatatagtatgncntttttttttgtctggcttctttcactttgcataattattttgagattcatatgtctccatcttgatgctcgtatgaattcantcttttaaatgttgaatattcccttgtatggatataccacaattcatttacccatttacttgttgatgacatttgggttgttttagttttgggatattac

SEQ ID NO: 558062 - DNA, 191 bp, Homo sapiens
tctagcaggatccccgtacagctatactagttggcagctactgccctttatttcataatgtgtggatttgacagtaggaacttcaacacgagtcgcatggatgtgtatctatcacattatccagcaggaacttctgttcaatccatgtgccattgtacccaggccgttccgtctgggaaattccaagctca

SEQ ID NO: 558063 - DNA, 589 bp, Homo sapiens
atttcaaaaaaatttataactttcttttgatcatcatgtacagaggtgttttttttctttaggcttctcatgcatatgaatattttaagcacgaatggactactaaatatctgagtttttttttttttttttttaaagactcctaacagaacatagcgtaacaatttgggtcttccagggttttacctcatttcaattatgttgttgttttccccggacagacctatttttcagtgtcttattttctttaaagagcgtgcttcattgtggccgggcgccagggcctcacgttctgtaattcccagcacttgtgggaggccgaggcggggtgggtatacttgaggctcaggagtttcgagaccagccgtggcaaactgtggggaaaccccatttttaactaaaaattacaaaaaaatttagccggggtgtgggtgtcacgcgccgtgttaatcccagctactgtggggggcctcaggcaggaaaattgcctgaacccaggaggcggaggttgcagtgagctgaaattgggccacttggacttccaccctgggcgacagagtgagactcggtctcaaaaaaacaaaaaaag

SEQ ID NO: 558064 - DNA, 418 bp, Homo sapiens
  misc_feature (235)..(235): n is a, c, g, or t
atcaatcatccctgctaggcttagtatgtagtggattagttacgtgatggactaccacaatctgaagcggctactgtagaaagatccaccccttacgagtgcggcgttcgatgctgatactgcccccacgcccgcgtggctgcgccttctgcatgcgcagtagagatgtctccaccgtaagcgtagtcgtatctagccctatgctatgatgtatgtatggattcctacgtaaagnttggtcctccttcttagcccctaccatgagccctacgaaaaacactaacctgccagtacttagttatgtcatgctctcctatattaagtcatcatcctacgcccctcagagtctggtactattgagtgactagccaggaaggatttatcacctggaatgcgacatacaaagaagacaaagaaa

SEQ ID NO: 558065 - DNA, 400 bp, Homo sapiens
ttgcagattatagcactgtaaagcttcataacattcacatttgactctattattatccatggtttgttcagctctgtattgttctttctcattcctgccttctttttcagtttccgtagtctattctttccctcatttttttcatttctctgatatttttagtttctgctatctaactgagctctgtagagttcaacgtatttctgcttttcagtttcgtgctacagtgataattgtttcattaaatttttataattcatgacaaaatatttggcctaaattttcacctgctctatagggatatttttactggtgttttgttggcccattctttttctgttccttttcttgatttcgtttcctcttatatttctagacagctcctgtgttggttctattt

SEQ ID NO: 558066 - DNA, 132 bp, Homo sapiens
  misc_feature (38)..(38): n is a, c, g, or t
acggagaggaggccaaagagatgtgggcccagggctgntgttggcaccgaaactgccaaaggtcatttgtatattattattgattgattagccaagaccgtgtatgagatggaagtcaacagaagagggcat

SEQ ID NO: 558067 - DNA, 126 bp, Homo sapiens
ctcgtggtcgttctcgagcgtcacgcggaaagtggcgttcggcagcagttcgctgacggtgccgggaaactcgagcagttcttccttagccatgcggcctctcacgcccgtctgaaatgcgttcaa

SEQ ID NO: 558068 - DNA, 768 bp, Homo sapiens
cacggtggctcacgcctgtaatcccaaaacttggagagacaggtgggcagatcacttgaggtcaggagtttgagaccagaccagccaacatagtgaaatcccatctctactaaaaatacaaaaaattagccaggtgtggtggtgaaacacctgtagtcccagtgcctggggaggctgaggcagggggatcgcttgaacctgggaggtagaggttgctgtgagctgagactgtgccactgcactccagcctgggcaatggagtgacactccatctcaaaaaaaaaaaaaaaattgtgtcggggatgctatggggggagggacccttgggactcttgggtggggccagggtgcccacgttggatagggcaggaagcttggcttcacctcttgggcacagagcagttggccctcttgtgagcttgtggggtgaaggccacctcaaagcttccttgggtcctttgctccagatggggagagtggctggctgaagggggtcctctgcttactcggggtgcctaatctctggtcccttcagtttctgtgtgcgggtccctgaatttatacgtggagttatcttctaccaaaacgggatttgtcacgacacggcttggtcacacgacacacaaaagaaaaaaattgtgggcgccggcccgaaagtttaaccactcggggcccgccgatgaaggaacgcacggcgcagagaccgcagagcgggcccaaaaacgcggagcgtgaaccaggggtgggtcaggcagagccaccgcggct

SEQ ID NO: 558069 - DNA, 225 bp, Homo sapiens
taaataaggtttataggaaggtctgttagatatttgatgacctgtatgctaggccaaaggctatggatttgcaatgtaggccagaagttagcaatcttttctggcaaaggactcaactacaaatatttgaggctactgcctatgttgcagctattcaactctgctgttggcacacagaaagcaggcatagacaagtcacataatggggtatcgggtaccgagctc

SEQ ID NO: 558070 - DNA, 212 bp, Homo sapiens
tgattatgtagagactaccaggctccagataaacgatattaggagtgcagctcgttgctcacgtgcggacggaacttgtacagggaggcatgcaccgcagtgttgaatacacgtcgacctggctccatgtaaacgatatttggaggtgagcacggttcttacgtagccgcggaacttgttcagagaggcatgcaccgcagtggttaatacac

SEQ ID NO: 558071 - DNA, 345 bp, Homo sapiens
tcgattcgtgccaaaatactaaagatatagattgtgtactacagcggcttaggggccagcaaagttaaagcatcaggtacctatactaaagttctggccaaagaaggctaactatgtatacttctgattcaactttggtgaatagctagagtccattttcatatactgaagatacaaccggtttaaggacacatactagtaaagttgaagggagaaaatcaagtcgtgctgaataataccactcacaacgtaattcacacataacaatgcactgtaggttgagaattcttggtgttatatatagacagttgcttgagtttcaacccagacataatccacctacta

SEQ ID NO: 558072 - DNA, 849 bp, Homo sapiens
  misc_feature (418)..(418): n is a, c, g, or t
  misc_feature (452)..(452): n is a, c, g, or t
  misc_feature (636)..(636): n is a, c, g, or t
  misc_feature (764)..(764): n is a, c, g, or t
tgggttgagcaacaggttactttattgatggtacatgacaaggttgcggctccctaggcccctcccctcttacaaggggtctacttggaaactgtgaggaggggaaatccagtgtggggggggactgagtgtggcaggaactccccagcagtgagggtctctctcttcctcttggtgtgctcgtgcgtggggctgtgggtggttccaggggttcatatacttccttggggaggccatggtgtggtgggccagtgaggctccaccaccgcgtgtttgcgtgtagccaaatttcgttggctcaataccagggaaagtgagtcgtctggacaagaggtggctcgtgtgagggacaagtgccagctcccaggcgtctcagaaggtggtggagagatggtggagggtgctcgctgtgtgaganagctcaagagagaaaccacgtgtgggtgcctcangtgtgatacgcccgaggatgtgcccttggagggggtggcccttccgcgaacgcctgtgctttcaccccaaccttttccgtgtgatgtgttccacctccaatttttgggggacaggagttattctacaagaaagcggcgacaggttacaagggtgcacacccaatgtgagacacactcgtgtgtnggcgcagtgtgggggacgaccaccgtgagaaaaggggggcccattgcgccacagtgtgagaacgtccttttccgcccgggtgtacaacgtctcaccaggggggaattgaagacccctgggggcgcccnaacaaggcctctttgggggcaaatgccgcggccaatgttaaaaaggggcaagggggattagactgtgtcctctggggggaaaacg

SEQ ID NO: 558073 - DNA, 512 bp, Homo sapiens
  misc_feature (9)..(9): n is a, c, g, or t
  misc_feature (61)..(61): n is a, c, g, or t
  misc_feature (76)..(76): n is a, c, g, or t
  misc_feature (85)..(85): n is a, c, g, or t
  misc_feature (97)..(99): n is a, c, g, or t
  misc_feature (104)..(104): n is a, c, g, or t
  misc_feature (115)..(115): n is a, c, g, or t
  misc_feature (125)..(125): n is a, c, g, or t
  misc_feature (137)..(137): n is a, c, g, or t
  misc_feature (142)..(142): n is a, c, g, or t
  misc_feature (147)..(147): n is a, c, g, or t
  misc_feature (156)..(156): n is a, c, g, or t
  misc_feature (160)..(160): n is a, c, g, or t
  misc_feature (187)..(187): n is a, c, g, or t
  misc_feature (221)..(221): n is a, c, g, or t
  misc_feature (245)..(245): n is a, c, g, or t
  misc_feature (253)..(253): n is a, c, g, or t
  misc_feature (273)..(273): n is a, c, g, or t
  misc_feature (278)..(281): n is a, c, g, or t
  misc_feature (283)..(283): n is a, c, g, or t
  misc_feature (285)..(285): n is a, c, g, or t
  misc_feature (289)..(289): n is a, c, g, or t
  misc_feature (305)..(305): n is a, c, g, or t
  misc_feature (307)..(307): n is a, c, g, or t
  misc_feature (317)..(317): n is a, c, g, or t
  misc_feature (322)..(322): n is a, c, g, or t
  misc_feature (343)..(343): n is a, c, g, or t
  misc_feature (346)..(346): n is a, c, g, or t
  misc_feature (354)..(354): n is a, c, g, or t
  misc_feature (358)..(361): n is a, c, g, or t
  misc_feature (367)..(367): n is a, c, g, or t
  misc_feature (391)..(391): n is a, c, g, or t
  misc_feature (396)..(396): n is a, c, g, or t
  misc_feature (408)..(408): n is a, c, g, or t
  misc_feature (414)..(414): n is a, c, g, or t
  misc_feature (430)..(430): n is a, c, g, or t
  misc_feature (445)..(445): n is a, c, g, or t
  misc_feature (464)..(464): n is a, c, g, or t
  misc_feature (467)..(468): n is a, c, g, or t
  misc_feature (491)..(491): n is a, c, g, or t
  misc_feature (502)..(502): n is a, c, g, or t
  misc_feature (510)..(510): n is a, c, g, or t
attgtaggngggctttcttcttggcctgcacctccaggatgccttccatgtagtcctcgtnggtgaactccgtagnacccctgcncagtgcgatcannnccgcntccacacacanagccttgcantgggccccattnaagtnatctntgcagcggnccanctcctcgtagttcacgtcaggactganattcatcttttgggagtggatctgcatgattttngtccggggctcctcattgggcatngggaactntattttggggtcaagggggnccgannnntngngggnggggtccaggatgtcnancctgtttgtnggtgnaattaccttaacttgggtgtnggnctggaagnatcnnnntggttnagaagctccagcattgttctctgnacctnccggtccccagntttctnactgtcaaagtttttnttttcgatggtattnaatttattaatgaagatgntanntggcgcttttttcttggtaaggntaaaggtatcntggattantt

SEQ ID NO: 558074 - DNA, 890 bp, Homo sapiens
ggctgccttctagtttttatgtctcagaccatgaccaccgtgtgcgcaccccgatgcctgagccctgcagcttctggtgctcttcggcagccagacatggcactggctcatggactgtgtcgtgagagactggtgtcgcgaggcccgtgcgcctggctggcttgtgctgccggtgtgcactgccctgtgactcctaccctggtggtgaatctgattacctgaggcccctggtgatatttctgtttgtgcaaactacagtgccactggagacccctcctgacaaccctgaatcgacacttctggaggtttatattccggcaagaaacctgccctccatctgccctctgtcagattggacttttgccgtccttgggcctcggcggactcctcatacgccaagttcaaccttcggtggccaagaagctgcaaccgacggctaactgcaagccttgggggcagcgccctcctgcccgttgtgcctgggccgatgaccagcatgagctggggcccgacgcttactgtggaccccctggctgccaacaccttgtgggacacgggttctctgaggctgcctgtaccacgtcgccatccgtggccatcaactgacatccacctccacggagataccccattgcccttcaagatgttccaccttgcgtgctcccttcccatagacgtggccaccccacgcacaggggcttctgcagggcgcaaccggggtaagctcaaccccgcgctctcaagggaaggccccacggaccggagttcgacaggccctttcctaagcacccagtgctgctgcaaccagatgagtcaccgggacccttacccacttcccgggacgctttgtgctgattggcagtttggcgatcttggagctctggtcatta

SEQ ID NO: 558075 - DNA, 718 bp, Homo sapiens
  misc_feature (323)..(323): n is a, c, g, or t
  misc_feature (329)..(329): n is a, c, g, or t
  misc_feature (335)..(335): n is a, c, g, or t
  misc_feature (385)..(385): n is a, c, g, or t
  misc_feature (405)..(405): n is a, c, g, or t
  misc_feature (443)..(443): n is a, c, g, or t
  misc_feature (467)..(467): n is a, c, g, or t
  misc_feature (470)..(470): n is a, c, g, or t
  misc_feature (473)..(473): n is a, c, g, or t
  misc_feature (495)..(495): n is a, c, g, or t
  misc_feature (500)..(500): n is a, c, g, or t
  misc_feature (504)..(505): n is a, c, g, or t
  misc_feature (512)..(512): n is a, c, g, or t
  misc_feature (516)..(516): n is a, c, g, or t
  misc_feature (522)..(522): n is a, c, g, or t
  misc_feature (525)..(525): n is a, c, g, or t
  misc_feature (531)..(531): n is a, c, g, or t
  misc_feature (550)..(550): n is a, c, g, or t
  misc_feature (558)..(558): n is a, c, g, or t
  misc_feature (564)..(564): n is a, c, g, or t
  misc_feature (570)..(570): n is a, c, g, or t
tgagggtctaactctgttgcccaggctagagtgcagcgagatgatcacagctcacggtaaaaccaaactccagggctcaagccatccttctgcctcagcctgccaagtagctgggactactagctcagactaccatgcccagctgtcgttcattctttccatctaactgtccctctctctgagacctgggtctgcctctcccttgtttttgaggcttccccagcagaccttcctgttccccttctgggcatttgcccccgatcgtacccctaatctttgcctttttttctcaatttccacctataaacatgttcaaatctctntactcncaatgnttcctcagtcctttcaagttaccacttttcctcttcatgtacttcaaagnctacaacggctactttaggntgcagcttcaccacttccactccatacaaggttctgtncccaaagctgacctttgttttttntgnttngttttgctttttgagacggagncttgntctnncacccangctngagcgnaanctccgnctcccgggttacgccattntcctgttnagcctnccaagnagtgggactacatgcgcccgccaccactttttttatttttagtagagacggggtttcaccgtgttagccaggatggtctcgatctcctgacctcattgtccgcccgcttcagcctcccaaagtgctgggattacaggcgagaaccacc

SEQ ID NO: 558076 - DNA, 1194 bp, Homo sapiens
cccacgcgtccggagcgacgtctcaaaaaaaaaaaaaacaaaaaacaaaaaactattcccagaaatttcaagaattgaattctttagtattaatttcacaacacttaacaaagagaaaaataaaacggtgatcatctcatttccgtgattaaaaacttgattttaaaattaccccaactaggaattgaagtgtctcaacctttacattattttacagtggtgaaacaattaacaagttattctacaacaaaacagaaacaagttcaagaaagtggctcactattcgtgctactatttaacatgtgtttaagaaagaacccaatttacgtgcaataactaaaggctattataattaaaattttatactgaaattacattattaagattctacattaaagtggagaaagggattactattgttccgtgtttgtggaaaccatttcgtttaccttattaaagaaagatagtttctcgaaagtaataattaaatttcaataaatctcaagatatcttacaggggcattttataactaaaatctaaagttcaatctcaagagcaatattaattaaccaccaatacaattttcaacaaagggtaatcagaacatttttaccctatcaggtatcaaacttactttaggaaaccatagttgttatacgagtatactgccttgaaaggcaaagagatcatggaacagaatagtcttaaaaaataacccaagcttcatcatattttaactcttagttcagtgacataacagtgcacattttcatactagcttgggggaaacgcgtgggccattctccagacaccacatgtgttgtgtcagagacaaatgtcgctcacttcgtgaaaaaaacatcactcaacacctggtcccgtcctctacaccgaaataaacgttctccaaagaccccgaagagtaacgcgcagcggggcaagggggcaagagcccgtgaacgagaaaaagtctgacaccagatcagaagaggggagggatagaaccaaagatttgtatgaccaaatgctcgtaacagccatgtagaaacatccacacctatcaagacataagtgggaataaaaaagctaataatagaggataaaataaagagcgactatatgaccgacactactgtttatgtatttttttttttctctgtttattgttatttgttttatatcgtgagggggga

SEQ ID NO: 558077 - DNA, 87 bp, Homo sapiens
agtaatcttaagccatctagatgtcccaattgaaacaaactggggagttgcctgctattgtaaaataaaatatactaaattgaaaaa

SEQ ID NO: 558078 - DNA, 301 bp, Homo sapiens
tctagaggatctctttatcgccaacacgtgtgaagcatgtatgagctccctactttgtgggctgtcttggctggatatgataactggtctgtgtgacccttggacaggccatggctgagctgctgctgaggaggggcaggcccacccatgtcaccggtcagtgcctttttggaactgtccttccctcaaagaggccttagagcgagcagagcagctctgctataagtgtgtgtgtgtttgtgtagtggttctattattttttataacggtatccaaaaatagccctgcaaaatttcagagt

SEQ ID NO: 558079 - DNA, 932 bp, Homo sapiens
gagtccgagtggtagagagcgagctgagtgagttgtgtggtcgggtctcgaaaaccggtagcgcttgtggatggtgaaccaagtgattgagagcagcttgctgatttcaaagaagcttcttcatatatttgacaaaggatggtgatggacttaagtaacattgaatatggaatgggcgaccctgtgatgaagatctcttgtggacacgattcccaaagaggcagagttacagggacatgatcaatggaggtagatgctgatgttgattggaagcaagttgagcttccctgatttgctgacaattgatgggtaaagaaaaaatgagtacgagactgacctggtgatgaaagagatttgagaagcattccggtgtgtgtgataacggatggcaatggcatatattaaggtgctgcagaggtttcggcattgtgatgacaaaaccgtgggtgaggaagggttatgtgagtgaattagaggttgatgagacttgctctgggaagcagatattggtggggatggtcaagtaaactatgaaagaggtctgtgagatgatgaccgcaactagggagaaccttgtggcgaatgtgtagacttctgtggacaaaattgtttgattggcctttgctctggtggactggaactgtagagaggttgtcactggctcgaaggaaagttgcttgtttgcaattagaaatcatctgccaggttttccgctatctggcgaatgtcctaaactggtttgaaagaatgatccgttacattgccgttggttacggagaagtttagcccttggcgacaaagagtgagggccaaggggaaccgtggtgccttagaaattcgaaggaaagggtgaggggggaatcggtgaggagcattttgtgtgagggcgagccccatgcggcgccattttttgtcctgtgcttcttctctta

SEQ ID NO: 558080 - DNA, 377 bp, Homo sapiens
atgttccctttgcatggtaaagggatgtggcagatatgattaagctaaggatcttgagatggagagtttatccaggattatccaggtgtgcccagtataatcacaggggtccttataaggacaggcaggaaggccagagtcagaggaagagatgtgatggcagcagcagagtctggagtgatgcagggaaggggccacgagccaaggaacatgggcagcttccagaagctggcaatggtcggtaacagattgtctcctaaaagtctccacaaagaatgtggtcctgtcaacaccttggttttagccccttaatactcatttcagacttctgactcaacaaatgtaagacaataaacttgcgttgttttaagtcaaaa

SEQ ID NO: 558081 - DNA, 522 bp, Homo sapiens
ggtaagaatggagtagggaggcagaatgaaggaaaatgcaagcagcatgataatacgtgtagtacatttagcataaaagtagaaggcacaggagagatagcaaaggccaggatatatcgtttggttttcttcacacataggtgcaaaaaacactgccattcacaagtcaaggaacccagggccagctggaaatgtggagcacacactgctgtggagcacacatgctgtggagatagcagtgtgtctgcggttcgtgtagtagtggaagacttacggtatgtagcgcaagttgaaaatggattgagactgcatggtggcatcaatgacgaaattgcctgtagcatctagtctacttgaagagaagtggagacataaggagagacaaaaacaggtttgtgccataaagtatattttcaaagacaccaagatgtggtcaatgacaattattagtacacttccctgatgccatgaaactttgccttaagaaggtgctggataccccggctagtaaaggcatctcgg

SEQ ID NO: 558082 - DNA, 521 bp, Homo sapiens
tagggggagaacctgaaaacttgtttttatttccccccaggggcgggtggtaaaagggcgtttttctttatttaaaatctatcccatctttttttttggccttcctttaaagggtgctggcaaagggggttggggctatttgcctggggggaaaaatcttccccttgggcaagagacccccctttaaaaggctggttttgcccctgcctttggggggcgacccttggactcgcaggacctttggggaccagggggttctttttttatttcccctattcgggagaacggaaaggggaaaaacctgggggcctttttattaaggggaacattcccaagggttgccaatttacaagtggggaaatttttttcttccaggggaccacataaaacttaaaggtggaatctagggtttggccaaattttttgggctcacaaggtttgggcaacttttataacttttcttggaacatgtggttccctggccacgaaagcataaaaaattcttgccagcccccaccttt

SEQ ID NO: 558083 - DNA, 250 bp, Homo sapiens
cgcacccctatatcaggaggctaggcaggagatcacttaccccaggaggtgaggttgcagctgagatcatgccattgcactccagcctgagcaacaagagtgaaactccgtctcaaaaaaaaaaagtcccaggatagaaggggctgcctggtttggcactctcggggccagaggggaaagtacagcagccagggggccccttgagaccccttccttggaaaaccgccttcctagtttacccttgcaggtt

SEQ ID NO: 558084 - DNA, 878 bp, Homo sapiens
  misc_feature (124)..(124): n is a, c, g, or t
  misc_feature (163)..(163): n is a, c, g, or t
  misc_feature (198)..(198): n is a, c, g, or t
  misc_feature (211)..(211): n is a, c, g, or t
  misc_feature (628)..(628): n is a, c, g, or t
  misc_feature (645)..(645): n is a, c, g, or t
  misc_feature (669)..(669): n is a, c, g, or t
  misc_feature (691)..(691): n is a, c, g, or t
  misc_feature (707)..(707): n is a, c, g, or t
  misc_feature (709)..(709): n is a, c, g, or t
  misc_feature (741)..(741): n is a, c, g, or t
  misc_feature (745)..(745): n is a, c, g, or t
  misc_feature (763)..(763): n is a, c, g, or t
  misc_feature (765)..(765): n is a, c, g, or t
  misc_feature (775)..(775): n is a, c, g, or t
  misc_feature (823)..(823): n is a, c, g, or t
  misc_feature (853)..(853): n is a, c, g, or t
  misc_feature (878)..(878): n is a, c, g, or t
aacaaatatccgagaaatacagaattcgcatacggagaaatcaggaggacgtcactagaagtgagcccaaaggaaaattatgcatgggagcaaagaatagatagatccaccttctcctagtgtncttccaaagcctcctagtcactggatgggaagcactgtngaaaattccaaccaaaacagggagctgatggcagnacacttaaaaacnctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatatttgtaaatactgtataccatgtattatgtgtatattgttcatacttgagaggtatattatagttttgttatgaaagtatgtattttgccctgcccacatgcaggtgttttgtatatatacaatggataaattttaagtgtgtgctaaggcacatggaagaccgatttatttgcacaaggtactgagatttttttcaagaaacagctgtcaaatccaggtgaagatctaaagtgaacngttactaatgcactacngaagttaaactgtgggcacaatcnatgtagcctgggggttgttccncctaattgatttgtancnggaatactggaccactcccatcccattttgcnaacncaattccgggtttgggananacccatcccncctaatgcccccaaatttaatgcccacccaaattgggtggaacccaantttaaaataataataaattggccccccccntttaaaaaaaaaaaaaaaaaaaaan

SEQ ID NO: 558085 - DNA, 787 bp, Homo sapiens
  misc_feature (124)..(124): n is a, c, g, or t
  misc_feature (163)..(163): n is a, c, g, or t
  misc_feature (198)..(198): n is a, c, g, or t
  misc_feature (211)..(211): n is a, c, g, or t
  misc_feature (628)..(628): n is a, c, g, or t
  misc_feature (645)..(645): n is a, c, g, or t
  misc_feature (669)..(669): n is a, c, g, or t
  misc_feature (717)..(717): n is a, c, g, or t
  misc_feature (779)..(779): n is a, c, g, or t
aacaaatatccgagaaatacagaattcgcatacggagaaatcaggaggacgtcactagaagtgagcccaaaggaaaattatgcatgggagcaaagaatagatagatccaccttctcctagtgtncttccaaagcctcctagtcactggatgggaagcactgtngaaaattccaaccaaaacagggagctgatggcagnacacttaaaaacnctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatatttgtaaatactgtataccatgtattatgtgtatattgttcatacttgagaggtatattatagttttgttatgaaagtatgtattttgccctgcccacatgcaggtgttttgtatatatacaatggataaattttaagtgtgtgctaaggcacatggaagaccgatttatttgcacaaggtactgagatttttttcaagaaacagctgtcaaatccaggtgaagatctaaagtgaacngttactaatgcactacngaagttaaactgtgggcacaatcnatgtaaagccaggggggtttggtttcccctaaatggaattggtaatcnggaaatttacctggaacccaactcccaattcccccattttggcctaacctcctttccgggtnttggggat

SEQ ID NO: 558086 - DNA, 127 bp, Homo sapiens
gattatcgctacagatggcttttcacgacagagtgttggaccatcccacttttgaggatatgcaggttctcgatgttagggaaaaacagagacccaagttcccagaagcctggaaattaaatagcaa

SEQ ID NO: 558087 - DNA, 169 bp, Homo sapiens
ggcacgaggaatcaacctggaggacgaatttcaaacacaatttttaagaaccagtcacagccttgaagacacatgcaggagagctatgagctacctgcatcatgctatcgacacagcttggcctatcatggagattagctgacagtcgtcaacttctgtgactgggcgt

SEQ ID NO: 558088 - DNA, 394 bp, Homo sapiens
  misc_feature (390)..(393): n is a, c, g, or t
tccgggccgccccctgcccaagggagcaaaaacaacttccagtttctcctgaagttcgctgagaaacagctcgaaaccgaccatgttttcatttgcttccacaaaaaccggaaggacaaaacccccttgctccgaaccttcagctttttgggctttgaaattgtgaaaccggggcatccccttgtccccaaaaaacccgacgcttgcttcatggcctacacgttcgaaaaaaagttttcgggaaaggaggaagaataaggccccctcggggctgggcatccggcccctggggccaccccttgtcaaccgggtgggtaagaaccgtaaactcgctcatctcgcctgggtttgtccgcatgttgtaatcgtgcaaataaacgctccctccgnnnna

SEQ ID NO: 558089 - DNA, 103 bp, Homo sapiens
ggatgtgatagctgctttggacctgtatgtggagcaggccagtgggacaagtgcattgaaacagctaccaagcagaactacaagattctgcacaagtatgtgg

SEQ ID NO: 558090 - DNA, 269 bp, Homo sapiens
agttaccgctcggtactgtgactaacgtgtgtgtaatttatagtacagttagttttcttctgactgcacttattctcatattattaaaatgctatgcgcattttaccttgcattagtcctcattctaccacatgttaaccctctagcttataatgcatacactaactgggggattttatttatgagtggctctagaactaaacgagattattcacatccagcatcatcattaactaacattctgaactatgttagtcacagtctcccga

SEQ ID NO: 558091 - DNA, 456 bp, Homo sapiens
agcggaggagccccggggcggaggagccggggaggcgggaggcgggaggcgggaggtgtggggccgttgaagcggctccctcccgccccagcgccggctggccccacctgccgaccgcggctggccactccgacctacccggcgaaggtccgtggacacgcgggctcggagcagtccaagcccatgagggccgcgcgcccggccgcggtgctgacgagacggagctcctggcccccgaggaggagcagaggatcaatgcggttcaagaatcgattccagcggttcatgaaccatcgagctccagccaatgggcgctacaagccaacttgctatgaacatgctgctaactgttacacacacgcattcctcattgttccggcatcgtgggcagtgccctcctccatcggctgtctgatgactgctgggaaaagataacagcatggatttatggaatgg

SEQ ID NO: 558092 - DNA, 696 bp, Homo sapiens
catgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctaccctgggggacgttggttcagaggctggtagcacttggggagagtatcttaacacagtttcttgacagcagctctggaacttagtatttctgtcccgagtcttgccacactgtgactttgagtagctcctggtggactcaaccctgttcaactcagagacgggccttctttcactgatgcaaagctttaaggcttctctgactgttctgaaactctccgtattcttgccaagtctaaagagactgaagaaaagatttaaatcctaataaaaatcagtcgataattcctgtaggttctgctggaggaatacatacttgtttggtgatttaaaattaagtgtatataatgttgatatgtgtgatacagtacaaattcttactggctttttgtttcactttgtcatttagtccataccacccatgatgttttcaaaatgtttcacaggcatattccgctggatccatttttccttgtcactgtgagatgggcagtccctgttactatgcattccactcc

SEQ ID NO: 558093 - DNA, 417 bp, Homo sapiens
catgatggctcagggtggtcatccaggttgaaaactgaccgtgtgatgtttgatttgggcttcatttcgtgggcaggctgcccacgaagtggcttcaacagctatctatatgcacacgcacacacacctcaaacctttcttttgagttcccaacccacattagctaatatcccaggggcacctaaaactcattctctcccccctaaacgagaaagaaactggtatcattacggcaggggttttccaggtcacaacatttgtacctattagaaccgatctgtatttccacgactccgcagtttgacctttacaacagatcagacgatgatcatgatggctgtggaaaagagccgtcagaaatgctgtcattagattatcagttcgtccctgcaattcatctttaacactgtgagtcag

SEQ ID NO: 558094 - DNA, 462 bp, Homo sapiens
gtgaagtcgatctgcaggcgtgtatgcatgtactgggccgtcatatacaatatatagttcccaattgtgaatgaaaaggagtatcaataggcatgacccaaaaccttcttctacacagttaaacaaaatttctcaagacctgatttaagagcaaactttttaaactgagtacttagggccgggtgtggagagctcatgtctgtcatcccagcactttgggaggccgaattgggccgatcacttgaggtcaggagttcgagaacagcctggccaacatggtgaagccccatctctactaacaatacaaaaaattatctgggtgtggtgacggatgcctgtaatcccagctacactggaggctgaggcaggagactcgcttgaacctgggaggcagaggttgccggtaagccgagatcgcaccattgcactccagcccgggcaacaaacagcgaaactccatct

SEQ ID NO: 558095 - DNA, 215 bp, Homo sapiens
taagcatccagatagtttataagagtaacacaaacatcagtatcgccaaatgatacactcttatcacttttagtgttaataacacagataatcttatgtaatatagtgtccctgaataactataaaaacttcttggaattatttagtatttaaaataaaacactattataataactggtatcatagcccttcaaaagacacattctgaaatgcta

SEQ ID NO: 558096 - DNA, 628 bp, Homo sapiens
  misc_feature (10)..(10): n is a, c, g, or t
  misc_feature (76)..(76): n is a, c, g, or t
  misc_feature (79)..(79): n is a, c, g, or t
  misc_feature (104)..(104): n is a, c, g, or t
  misc_feature (128)..(128): n is a, c, g, or t
  misc_feature (134)..(134): n is a, c, g, or t
  misc_feature (141)..(141): n is a, c, g, or t
  misc_feature (161)..(161): n is a, c, g, or t
  misc_feature (188)..(188): n is a, c, g, or t
  misc_feature (263)..(263): n is a, c, g, or t
  misc_feature (295)..(295): n is a, c, g, or t
  misc_feature (321)..(321): n is a, c, g, or t
  misc_feature (330)..(330): n is a, c, g, or t
  misc_feature (345)..(346): n is a, c, g, or t
  misc_feature (364)..(364): n is a, c, g, or t
  misc_feature (462)..(462): n is a, c, g, or t
  misc_feature (484)..(484): n is a, c, g, or t
  misc_feature (562)..(562): n is a, c, g, or t
  misc_feature (604)..(604): n is a, c, g, or t
ataaacttgnatttttatactttactatttgaaaatcataggcaaaaaaattaatttttattataagaccccttgnccnttttcagttgtctctcaggacgganggcatcatccttcctcttatgttngcttangccttcnttttgtgtccttataaattngcttctaatataagctccagccctttnggggcttctcctgggtagggatttgcgtcccgttttcccttatgagggtgtttcttcatttaaccccttatttgnacggccttccccgcaaatctgggaggcaggcnagccttgggcaatacccttttcttcnaggccgctngccctcttttattgnncggttttatgttgcagtnctctgatactttctgagttcaaagaggtaaatgtataaatttcagtcccttctgaacacagatatcatcagaaaattaccattccctagcaggatgtnttcgtgtttgtattcgtatatnccagtacatttcctttgaaaaaaaaaaaaagtggaacacaaagtaggaagtgagaaccttctggctttggatggattnacttcttgattctttctggttttgcctgaacaccaagtagcntcataatcaaagggtcattttctg

SEQ ID NO: 558097 - DNA, 158 bp, Homo sapiens
  misc_feature (39)..(39): n is a, c, g, or t
  misc_feature (102)..(102): n is a, c, g, or t
gatcaggggaagaataccaacctgcataagtgtactaantctacgtctggttaatgtatgtactctcctggactgaatgcagtgtataattcctgtctacantagaagtgtgccccagttccacatttgattacacatgtgagatttgctgctgttgc

SEQ ID NO: 558098 - DNA, 1179 bp, Homo sapiens
tgccgtctctcggagacagagtgggagacgctgtgagggccgctgaataacgcttccaacatgatgcccacagccagtttaatcctattggaaagaggggactgatagctcccaaggtcatcccacctagactttggtgagtaaacatcagatgcctgccaagggtgacttgcatggaggctgtaaagaactacccatgggatccccgtggcatggacaatgcttattgtagatggcagaggcgaagctcacaatttctaatgatggcggccacaattctgaaagcgttcttgagtgttcgtccagtcctgcagcaaagactttggtagacattggcaaatcccaagatgctgaggtgggtgatggcagcgcagcctcagtgaccttgtctggctgcagagttactgaatcaggtgaataccctatgtgagcggaatggtttacatcccccgagatcatgcgattcgagcttaccgaacagccacccagctggcagttcaacaagatcaaagagattgctgtgaccgtgaagaaggctgatgaagtggagcagaggaagctgctggaaatagtgtgccagtgatcgctctgagtctccaagctgatctcccagcgagaaagctttcttggctaatgatggtggtcgcgatgcagatgatgatgctcgacgatttgctgcagcttaagatgatcgtaatcaagatggtacaggttggagcctcgaggattctcagctgatagctagtgttgcttcaagatgacttatccttaagctgggtagagatgcaacccaataagtaccataatcccaagattgtcctttgaatgtcgactcagttggaagtgggaagaccagctgaatagaatccccatggagaattcagggcatggtgaggcgatgaaaggtcaccctatgacaagggtggagaagactcggtcgtcgcgggggaccaaaaagttttgttgcaaactccccatggggggatttggcgccaagactttgggacaggggacgatatctaggagagggagataccagagtgatgattgcgaccaagacgtggggagcacagccgcaaggaggatctttaatgttggcacaggacgtgtaacagacgggatgagacgccgatggccgcacagatactgcgcgacaaacagcgagacgctaacaggtgt

SEQ ID NO: 558099 - DNA, 222 bp, Homo sapiens
ggaagtcttcctttcttttggacacctgtcaatggtcatattactgagaaatatttaatttccatatcagttttgaattagaagttttcttttaaaaagcaactatgaggacatttgagtgcagtgctagatggtagcgctctgataaacctacccccttgttttgttccaatgtttatagtaatgcttaatgagaagagtggtcatttggaatttgctctt

SEQ ID NO: 558100 - DNA, 937 bp, Homo sapiens
gtaaagaccttgtcctcgatgtccctatcgactccttgcctattctgataaatagtccagtatcagtacttctctgtgaatgcacgacgtgtgcaaagtagatacagcaatgaaatagtgaatagcatatactagagtaaattgatcctcatgtgaagatgtccacatcctagatatctctttacatcatatgttaaccatgtacttcacaattgctcttcatcaatcttgacccattcgattattctttcctctatttctgataaattaccttccatactcttccttcttacacttggcctatctattccactccttccctatctcttccatttccttcctataatctccttcatttcagtccttgacaagtctattaagagatgatgtaagtgacttgtcgagaatcttgacctatatataactcttagacttctccccttctcatatttatgtttctatacctttctcactgtcttctgacccatccttccatctattatccactacgcattcactatgacattatgcctatgattgccgtggtggcattgaattgtatgaacatgactctcctatgtagaatgcgtggctctttgtttcatagtcaagtgatccaatcctaagatctcgtcacatttcctacgatctgtagtctatcgtacttgttattccttttgttccaccgtaattctttaggagtagacatgaggcaacgttggatccgggggtgcaaaatctcccgtggccccacgttggatagtcatctttgatataaggtgggcgcctcctgaaatcctcttacttagcaatgggaggggccaagggtcaaatccgtccaaatgccttgtgtgcccaaccacaaatgcttctgtcctgggtggactcaatcatcattcaacttcctttcccttcatgagctcccaatctgaatagg

SEQ ID NO: 558101 - DNA, 1278 bp, Homo sapiens
  misc_feature (1018)..(1018): n is a, c, g, or t
gcaggcctgtgcctatccctgactgtcgccaggctgtgccccgtggggtcaggagctccacgaagggccagctgggcagtattctagagattggcctactcagggcccgcatttcttgctgcaataggctggctcagagcctagtgttccctccatggagacctaaaagacaggtgccatagtgcctgcacctgtggaccacacgcctgagccacatggtgcagtccggtgataggtctccacgcagggagcggctgtaggacccctgcttctctgcaggcatgccactcgtcctatgtgcctggacaccttgcaagtagcctgtggagccatcgctggcaatgcggcaagatccttgtgtggcaagcattgcggctcgctctgaacagacggagggccacgtacggacggcaggctgctgccggcggcgcaaccgttgctcgcacgggcgcgtcccttgcgcttcccctggccagtggggcctcttgactcgtagggcttttgccgctccttcggcctcgtgcgcttttcctattgcaccttgggccgggctatggaactttgccatggaacgggatcgcccaatacgcggaagacattggctcgcgccatgacttcggcccgtcgctttaccttgcccattgacacaacgagtcccgaatctaggggagtcaacaagcgtataagacgtgcgtgcattatccttccccatgacgataattagcgtgggagccccattgccacatacaatgcccttttgggaccagtgctcgacggagagcgccacttaggacgctccccccacttggcgcacccgggtacagactaacttgcgccacaacacttggaggttgcccaccgccgagagtgcactcgggctcaaagggattccacccatttgtcggtatccccagcaggttccaacacacacccggttcgatacataactaccccatttctaatgcactgcgccaagtctacacacgttgtgcctgtgcaacggtgcgcaagtgaacgncatcccaaaccttccccccgacaaggtacgttggtcgtttgcggcgactaccatccagatgtgtcggggacaggcccccgggatggcggaggcacactggacaaaacaccgggagcagacaggtaacggggcgcaacgcccatcaccagttgccatgtgatggtggaccccacccgttgtactacgggttcccctcccttgctccccttcccttgggtgggcactaaacactccgtattgggataggcccctatgatcgc

SEQ ID NO: 558102 - DNA, 194 bp, Homo sapiens
  misc_feature (55)..(55): n is a, c, g, or t
  misc_feature (71)..(71): n is a, c, g, or t
ctgatccatgagtcataaagaaaaatgttttaaaaagaagtgtttggtgactgantgaataagggaatgantaccttcattttgtaaattagagatttaaattttgctgtggcttggaccttcctgtagttattttgagacacttggtgtttattctgagccagtttttccacgtaaagtttccagtacatata

SEQ ID NO: 558103 - DNA, 704 bp, Homo sapiens
  misc_feature (554)..(554): n is a, c, g, or t
  misc_feature (566)..(566): n is a, c, g, or t
  misc_feature (576)..(576): n is a, c, g, or t
  misc_feature (618)..(618): n is a, c, g, or t
  misc_feature (649)..(649): n is a, c, g, or t
gcacgaggcctggtcagaagaccccgtctcaacaaagatgtgaaaaaattggctggatgtagagcacacctgtggtcatagctgctcacgaggctgagttgggaggatcgcttgggcccaggacttcgaggctgcagtgaggcgtgatggcactgctatactctagcctgggcaacagagtgagaccctgtctcataaagagaaaagacaaatttgctcctcttttagctcagccaagagatgctgttttatctagaagcttcccctggtgtctccattcttcctgggtgatttctccctctctgctttcagcagccacctgtagctgatgacttcctcctgtcccacttctttccagcctcactgccactattttaggtaacccagagttattgcaggtcccatcgccaatccacacagctgcctgaggaattgatctgaaacatcatgtccctcgtatggcatccgaggccctcataatctggcctgattaactccgatctcacctcatgtgccatccttcccccaaatgtgccttcctcttcagctgtccntctgcggggctncctatgcctngggcaactgtgcttaccaccccagatagctggataaacaggncaagggttctgtgccccatgttgatgctggnatctccattctgggtattcctatggcatttaccaatggctactggcacttcctgg

SEQ ID NO: 558104 - DNA, 725 bp, Homo sapiens
gtgagtcccaagcgtgtgtgcgagaccagatagctctaggacgttcttctgtgtgcattgcttctgtaaatgcaggcgcagcttgtcgtgtttccaaaccagttgtgccgtccactcactccttttcagaatagaaatctcctctcgcttctctggccttgtgaggttgaggacaactggaagattctgactcaggaatccagaactaggtctaccttcaacatttatgcagtcagggcagggatgcttatatctttcataagggctggtgcaaccatatgaactgaaaaaacacgcattttgtaatccaaatattgatattccttacaccaagccatcaggctccttttatcaaatagcattcagagtatttgaatgttcaccagacaccagccccggtgggcacagagagaacaacattcctctctgtcaacatcgagaggctttaaaacaactgcttagtggaaaccttttgagagatggaaaacaagctttctggtgggtgcatttttctggcccgggggttgcctggattcacgctactgggcccctgtccacccggccccccagtttgtacgcgttgcaacaggtgtttctctttcttggctttaaatttctgtggcacatgcgttgtgccttctgggaacagggcaccaatgaggggggccctagcacaatgggcttggaccaaaaggaagcggcttaattaataacttggttaattt

SEQ ID NO: 558105 - DNA, 422 bp, Homo sapiens
tccgggccaccgtctccggctacagtggggaaaagaggttgggaaacctgactctcatgccctgaaacatctcggtgctggtgtgaaaggccagcactgtggtggcattgactcccggacagtccagcagcccacagggtcaggctctccatgaaggcgaaggctgacgctttgaatgtccagtagtcaatggcaccgggaatgccagacagtgccagcacgaagttgaggcacacgatgtggccattctgcagctccagcatacgcgccagaaagcccttggtggtccagaactggcccagggtgttaatgtgttggaccttgaagagggcatcatcatcactgtccattaggctcttcacatggaccgcggcggcagtgttcaccagtatggtgatgtcacccactttctagcgagcggt

SEQ ID NO: 558106 - DNA, 190 bp, Homo sapiens
atggcttgtcatctctgaaatctcatccgggtattcgtgctcgtccccatgcttcccagcctggcctggagggtctcaaacttggtctggtacaggcttcagcctctagcctggtgcattttggccatctcctcatactgtgccttgacctcagcgatgatgcggtccaggtccaggtaggagtaccacc

SEQ ID NO: 558107 - DNA, 592 bp, Homo sapiens
  misc_feature (180)..(180): n is a, c, g, or t
ttcgataagtcgaaactgaagaagacagagacgcaagagcaaaagccacggcctcccaaagacacgagcgaacaggagaagcaagcaggcgaatcctaatgaggcgcgcgccgccaatatgcactgaacattccacaagcagtgccttcttattttacttcttttagctgtttaactttntaagatgcaaagaggttggatcaagtttaaatgactgtgctgcccctttcacatcaaagaactactgacaacgaaggccgcgcctggcttccctgtccagccagatagatagacagcatgggaaaggccaggcagggaaggcaaagaacttgcatgttggtgaaggaagcaagtggggtggacagaagtggggtgggacgacagtgtaaatctacgagtaaaacccaagctggccccaagggtgtccctgcaggcctggtaaaatgcgcaggttctaaagtccagaggtgcgcagtttatttagtttatatgtggtatccaaacagtggactatttcaaatctatttgggcaagtgcgccaagtgtgtttctgcaacatagtgggcaaagacacaacaacaacaccaagagg

SEQ ID NO: 558108 - DNA, 209 bp, Homo sapiens
  misc_feature (208)..(208): n is a, c, g, or t
atcgggtcggtccacacgccaccggagaaggtccactgccacctacttgtattatacccagaaacagatatagggtcttctactccaacaactaaagagcagacactacccctgacagggctctgacaaccacaaagcaaagaagaggctttactcaatacccagtcaccacaccacatcaaggacaccccttctccggtggcgtggnc

SEQ ID NO: 558109 - DNA, 116 bp, Homo sapiens
gggccctttttttaaaaggttttcccccacccctaaaaccctttccagggtgttttgggacccaaccatgggaaaggggtttttgggggtgaaaataaaatggggtcccccgccca

SEQ ID NO: 558110 - DNA, 159 bp, Homo sapiens
  misc_feature (158)..(158): n is a, c, g, or t
atgaacaagtctagggtcattcataggtctgatcaatctaaatgagtcgatgacacaatgcctgacagggctctgacaaccacaaagcaaagaagaggctttactcaatacccagtcaccacaccacatcaaggacaccccttctccggtggcgtggnc

SEQ ID NO: 558111 - DNA, 896 bp, Homo sapiens
cacgcgatacggtgagaccatccactccacatctgcatcacgtcatggaccactcgatgtcatggagtcccctcctccagccgcgtggacaacaacagcttcagtccactgggtatagtccgtacatagaaattgtgtttgctaaacaaagtgtagcccttttagccagatgctaggctgtctgcgacacaagtgctaggagtaatcgatagacagggagtgggtgctggggaacgggctggctagcaattgcagcatcactgctgcatgcctctgaaacagcacgtcggacaggaacacgagacacaaagcaagtaagagtagcaaagaaacaatagaggataaagcgtgaaaacggacagaggaccaagacgcgagacacgacagcgacacacaagaggacttccaagatgacatgagggaagggaactcggccatgtaaatccaaatacgcagactcgtgcacgcgcaagaaaaaggcccccaatcccataccagtataacggatgggaacaccacaaagaacgagagaaataagagagggggaacaagggacaccaaggccatataagacacggtgaacagggaccgcacacagataagggcccggactgagtggaaatatactaaccgggagcagcgacacaaggagggatgcgaacacatgagcaaaatcaacgaatacgacacagacagcccgcagcatgggaaaggcacgaacgaccagggaaatggcagacagggaatgaccgccaaaaaacgaggcagaacacacaagccatagctactaacattaaatcaaacccatggaacaacaaccagacaagggagaaaagacagaaaaacgaagcaaatagacaggacgcagccgcaaagaccagaacacaaaaggacga

SEQ ID NO: 558112 - DNA, 440 bp, Homo sapiens
tattacaccgcggtaaaggataacctggtggcctgccactgggtaagttgagcctagtaaattgcctctcccagaaacacagaggttggaataccatgaaactgaatctagcagtaatggacagaatgggtcaggagctacagcaagtgaaaggtcacatacaagcccttagtaacaaatggacagaaaccataagtaaatagagtgaattgaagcagaacacaaaaagaagcagaagtgggatggcatgcagcttagacaaaaatacagacatgggtggccggggcagtggtgcacacctggagtcccaactgtgtggtaatgctgatgtgggagaactgccgaaaccaggaatccgtgcctaatatgcacttggaatagcatctgttaataagtcactgcactccagccagtggcaacagaagtgagaacttgtctct

SEQ ID NO: 558113 - DNA, 436 bp, Homo sapiens
cggtagtaccgattggagagggctccaaatggcccgggaaatggcactttcgatttcaattatacttagaggactgagaccacttggccatcgcaatgagaaacggtctgagattccttatattcaggctttcttcattctccgtaaccacccttctctctgccactcctgctctactttccaaatcctactcaccagctcaaaacctgactcatctcccgtcaccccacccacagacccagccgatgactcctcttccttcgagcccgtggattttctccctcctcgacagcatctgatcctccaccagagcatcatgatcctccaccgtatgtccctgctccggctctacccctctcccccactctctccaaccaacccacttctgactctgagtcctctctgcctcctcccctcacccgctctcgggcgcaag

SEQ ID NO: 558114 - DNA, 160 bp, Homo sapiens
tgattagaggatcttacactgcggtatactgtgcgagaggttacacacccataggcactggggccgtggcaccctggtcactgtctcctcagcgggaagaccttggggctggtcggggatgctgaggagacgatgaccagggtgccctgtgccccatgtg

SEQ ID NO: 558115 - DNA, 931 bp, Homo sapiens
atgtacatgcagcgcagttaggtctacagagacgctacttcccctatcatagaagagcttatcaccttacagttgatcacgcctcataatacatgttccttatctgctacctaagtcctgtatgcccgtttacctaacagttcagaacaaaaactagcataatactaagatcgtcagacgcgcagtgaattagaagcgcgtcctgaactatccttgaccagcaaattatccgtagttccccaggctgccctccccatcccttaggcatcccttaacataacagacgaggtcaacgatccccttccctttaccatcaaaatccaattgtggccaacccaatggtaacttgaaaccttacggagtacaaccgacatacggcgggactaatcttttcaacctccctacaatatttcccccccattattaccctaagaaacccaggcgacctgcggactccttgaaccgttgaacaattcgagtagtactcccgattgaaagcccccattcgtataaataacttacattcacaagatgtttttgcactcattgagcttgtcccccagataaaggcttaaaaaacagaatgcaattccggggacgtaataaacaaaaaccaattttcacagtacacgaccggggtatactacgggacacttgctctgaaatctgggggagccacacccacagtgtcattgcccatcgtcctagtagttaattcccttaaaaatcttggacttcagggccggattaccctataggaccctttaccctttagagaaaacaaaacatcaaaaaacttgtgcgccgcctcaaagactttaaccattgggcccgcccggtgaggaagggcactgtcaagcctgcctaattgcgggtccccaaacccgggccgagcgcacgcggcgggaggcagcggtaaacccggcggcga

SEQ ID NO: 558116 - DNA, 167 bp, Homo sapiens
cccccccccgtttttttttttgggggggggggggggttttttttttccccgggggccccttttcccccttggcccttttttggggccccttttaccccgtttttttccaaaaccgggggggggggggggggggtttttccgggtttttttccccccccggggcccca

SEQ ID NO: 558117 - DNA, 173 bp, Homo sapiens
atcctatttctctggggggctgcaggtgacagcaggcttactcttccagggtgcatgggcaattggtgcgctccagggcagagacctgtattcctatggtcccattcaccagtgctggaccccatccagcattggcaccagggccattgcacacgtcaccatgggtgagcagg

SEQ ID NO: 558118 - DNA, 242 bp, Homo sapiens
gcggagtaaccggctatacatactggcaaggggagcagaggaaagagcaagcgcaccaaacggctcaaacgtttgtcgaagcactagaaaatcaggaccatgagcagctgtctgcaatgctctctgcgtcctcattagaagaagcggcttacacacgcgaagaggtagtggaaagatatgaaacgatttatggcgggattggcgcttcagaatttcaagcggcggatatacgattggccgaa

SEQ ID NO: 558119 - DNA, 1188 bp, Homo sapiens
  misc_feature (802)..(802): n is a, c, g, or t
gggcggctgggaccctgtacacgtatcctgaatagactggagggccttcaaggctctcatcggtgctcagtacagcggaggcacaggtccgcgtgctctccggcaccattccgcccacttccattttggctcaaagtccaagccgcagcccctgcaatttctcgcgacaacattgtgcctgcgcggtctaaggtcccgagtccgattctggccagggtgactgagtggattgctgtggtgtttgagaagcatagtggccatatgtcgcatagctattgtgcagcaagtgcagggagctgcgtgtgtgaagtactccgagacgcgcagcagtcaccaggtggtcgtcagtggcgcttgagcttatgcctgattcctgatatagttgacccctcatggccatatacctggtgctgttaccgccgaccttgtggcagttatgtcaacctacaaagtaagagactagtgcctaccatgaacacagtggcgacaggcaactgggaacacgtcgacggcggacacttcttaggggggcgttcgcgtagcgcaattgctttaactctagtacactgaccgacgtggacttctcgtatctgagggctgtgtgctagaaatctgcaagtgaaccaatgttgggcttgaccattcaccaagtgtctgtcctggacaccccctggattggggttgggggcctgctttaattcacggcagaggtggatccctaacggaacgcgcctttcgtaattcgcggcccaggtggcgcttgggtgcccgctacactgaacccagagctcttggctagggntttgctcctccgattcgctttgccaattataaaagctcaatagccccccgaggtttgcccggggccctagagcttttgcgggcggcggatcggataggaaaatccgtagctgttcgatcacaaagaattggagcgccccccgtgtgttggcaatttggtcttaaaggaagcaccgttacggcaacgaagaaaccccgcagaatacccttaaccactatggcggagcaaccaacgcagtcgggaaaaggacggacgaccggggggtccccgcggcggcgaaacgaaggcacctccgggaaaggcccgcgagggctctcgagctggcgacttgggatgcgcccgaccaacaggggggggttgcccccctggctgccttgcaggaccga

SEQ ID NO: 558120 - DNA, 188 bp, Homo sapiens
tcggtcggtccttcagtggtacgtcctgcggggagcggggctcagatgctcaggccagctgtttatggccgagcccggtgaaggctcctttgaattcccgctaccatcagccgtttgaggacttccgcatctcccaggagcgtctcgctagaccacttttgacatgtccatgtctctggtgccccggt

SEQ ID NO: 558121 - DNA, 295 bp, Homo sapiens
  misc_feature (55)..(55): n is a, c, g, or t
ctcaacctgtaatcctaaccctttgggaggccaaaaaggaaggctcacttgaggncaggagttcaagaccagcctgagcaacatagggagacacccccccccaccccatctctacagaaagaaaaggaaaaaaaaaagctgggcatgatgacacacctctagtcctagctacttgggaggctcaggcaggaggctgaagcgggaagactgctggagccagggagttcaaggcttcagtgaaactatgacggtatcaccgcactccagtctgggaaacagagcaagagcctatctc

SEQ ID NO: 558122 - DNA, 120 bp, Homo sapiens
gggggggggatttttttcccttttttttttggggggggggctcccccccccccgggcccctttttttttttaagggtttcccaaaaaaggggcccccccctcttttaaagtttgggcgga

SEQ ID NO: 558123 - DNA, 193 bp, Homo sapiens
  misc_feature (51)..(51): n is a, c, g, or t
  misc_feature (94)..(94): n is a, c, g, or t
  misc_feature (118)..(118): n is a, c, g, or t
  misc_feature (183)..(183): n is a, c, g, or t
cagactccagaatcagctgcaaggagccctgtatgctgtgggactgctggngcatgcagcgggctctggcttccacccttctgttctgagatgngggtggtgggcagtatctcatctntgggttccacaatgctcacgtggtcagccaggggcttcttagggccaatcttaccagttgggtcncagggcagca

SEQ ID NO: 558124 - DNA, 984 bp, Homo sapiens
tctcgattataatacgttgaaaatcgctagaactcagacgtcctttggcggatatcagactaacttcttgataagacttcaaaacggtgcgcgtatcggttttccacggtgctggacaagattctgtcccccaaattccggggaagattcttctcatgaaacatggggggaccctgaaactcgcaggagctggttgaccaccccgcttaccagaggggaaaccaaaggggaatcttgacaatccctttaaggtcggccctttttcccagagtcttgtccttgggccccacccgagacatcgaacaaattggggtttgcccgaaatttttttacgggtttggcttcttcccgaagagatatatggaccatgtaagccaccccgtgggggaccagcttaaatttcaccacaaacggtgaaggacttggtctttccctcctgtaggtcttgttcctaacaagaaccggtaagcccccccctaaaaggatccatggggataccccctcatgtttggatcgcgtgatcaaccggtttccccgcctcacccttttgtctaaaaatctatctgagaaagggcgaatatgggaagagaggaaccactttgagtccgggaaacacacccatagtctttaagcacatgttaaagtaatggaatctgcgaatacacttcacaacaacgtaaatccctgaggcttggtgatctgaggtataaatagcacggtatgaatgctgcggagctggagaaatagagaacgtctaaatactcaaggggtaaatttgcacagcgtttagtttttttggccctggttcaatgatatttaatggtgttcaccgtgtcccgtggaacaaataagaaatggtaaaggtgtcatttcccaaatttaaattaggaaaattaattagatgaccttaaaatttttacccgccttttttataaggacacctgccttttttgtattgtaaaaaatttcccttttaacctttga

SEQ ID NO: 558125 - DNA, 244 bp, Homo sapiens
ctttaaactttttaaaaaattttaaccttttttccagcagatatggagggagctacaaatcaattcacatttttaaaccaattttagcaaacctgtcattggcaatctctgaggtccctcatggagctccacagatccattttaggggagggatttttggctcaaaaacgatctgaccacctctgccctgtccaccaggataagtgacacctaggacccaggaaataaatgccgatgatttgtg

SEQ ID NO: 558126 - DNA, 168 bp, Homo sapiens
ccaggattcgagtctggaaggaggctacgtattcattctacacactctcctgtgtgtgatagagcgtactatattgtgaggggctatagctcactgtcctgtagaacagctgcgaatgcactgtgctctttctcacagctgaattgattacttcagaggcagctttct

SEQ ID NO: 558127 - DNA, 240 bp, Homo sapiens
ctcaaataacagggtatctgaagacctggacctctaccgaatgtcgcgctccctgggtacgccaagtagcagttgtcgtagtggactgacagcgcacactggcctgcagcgtttggaggcgtctccctgatcgtatgcagccccttcatgtcccgaattttgtggatgtacagggactcctccaggaatactatcagcctctgcctgttgagctatcacagccagacaagagttgaagaa

SEQ ID NO: 558128 - DNA, 248 bp, Homo sapiens
tctgcgccttcctaggagagtcttccatgtgttgagttttcccaagccatgcgcgttgttttctcccggcttttctagttgtttggctttgtgccggcttcgttttctgtggctttttcgcctttttcccgttggtgttttttttgccttggttgctgtttttggcccttttttgtgttgcttctattttacctcaaattgtaaatatagggtaatcaataaaatccatacatacatttaacacaata

SEQ ID NO: 558129 - DNA, 106 bp, Homo sapiens
  misc_feature (83)..(83): n is a, c, g, or t
cacgatatgacacatagcattgtaaaatgactctcactaagctacatgtcatttttttttcggaacgaaatgcttgtctgtanatatcaaagattagttaaactgt

SEQ ID NO: 558130 - DNA, 474 bp, Homo sapiens
tcagacaacaagaggcatccctgtcgctgtcgataagaaaatccagctgggcaacatggtgaagctcagtctctacaaaaaatacaaaaatcagctgggcatggtggcgtgtgcctagtagtcccagaccactcgggaggctagaggtgagaggatcacctgagcctggggaggatgagactgcagtgagccatgattgtaccactgcacccctagcctgggtgccagagtgagcaccccgtctcaagaacacaacaaacaaacacaaaaaacaactcaggggaagactgcgcaaagcaaacgaaaacataggaaaaagggaaacaaagatttggaaaaaagacacaatcccaatagaatagcccaaggacaggaaatgcacagatgggtcatgtccctccctatagtcaatgaaagtctctactgccttcccttaatgctagtaccttggctctgctgacaagttgggagcca

SEQ ID NO: 558131 - DNA, 216 bp, Homo sapiens
ggaaatttttcccccccccccttttttgggtgtttttttaaatttttttttgggaaagggggccccgggggaatttttttctcccccatttaagggggccgggggggggggggttttttcccccgtggttttttttgggttaagggggcctttttttttttcttttttccgggggccccccctttttttggggggaattggggggggtttccccca

SEQ ID NO: 558132 - DNA, 86 bp, Homo sapiens
tcctacagcacaggccccaggtgggctacatcagggtacgattttatgaaggctctgagttggtggctgactctggcgtcaccata

SEQ ID NO: 558133 - DNA, 151 bp, Homo sapiens
gcctcggcctcctcttttgattgtacagctttgtgacctcctatgttctgacttagccacccttggtgttaattgccccaagaaagagaggccaagattacctggtgtggggaaacaaaaaatgtgacgtgaaaagtgtcgcactgtgtac

SEQ ID NO: 558134 - DNA, 197 bp, Homo sapiens
actgagcacccttcgaactggtattacagtacagtgaggcaactagcaggtgatacgccactagatctggaaggcaactgggaaggttctccgcatgaaggtagaagcgctactaggggttgttgttgtcagacgttgcactcattaggcaaaaattcatttttgacggcaccctcatagagaattccagttgtcgt

SEQ ID NO: 558135 - DNA, 644 bp, Homo sapiens
atcacgagccgaaagagtaaaggtgctgcaatgatgttagctgtggacactgtggataacgcaagaacataataaactagaaaacagaagaaataaataaaaaaattgccagtgggtggaaagatcccttagagaaagacatcctgtgtgtgcagcgatacgctcactgattatccatcatcagctagaagactacgatgaaagatcactctttgcatatggacttgattcactcacgttgaaaaatccgcacgtgctaagcagtcttccagtaagagggacaccgagtggtcacttcgaactgtgcggctgtgagcaagcggaaacagctgtaagcgcattgtactcaagaaccaccagtcccggtttctgactgtcaacacagccatattgatagctttgaacaagagggagtatgaaatcccatccaacctgactcctgcagatgtctttctcagggaggtatcccaagtagataccatctgtgagtgcttactggagcctgaggagcaagtctcgagggatgcacctatggattccatcgaatgggctgacagtggttgatcaacgtgaacaaaaatctcaaggatatgctgcaggctgctagatcattatcgcaaaatagaaaatctcgtatagaaaga

SEQ ID NO: 558136 - DNA, 205 bp, Homo sapiens
gagggatttcggcctgagagcgggccgaggagattggcgacggtgtcgcgcttgttttcgttggcgggtgcttggctggtgggacagccgcccgaagaagcaccatgatttcggcgcgcagtttttggatgagttaattgggccgggaccaaacctagccccgacgagaagcacagaacgtcggtgggacacgagagctttgaaa

SEQ ID NO: 558137 - DNA, 563 bp, Homo sapiens
  misc_feature (27)..(27): n is a, c, g, or t
  misc_feature (89)..(89): n is a, c, g, or t
  misc_feature (93)..(93): n is a, c, g, or t
  misc_feature (99)..(100): n is a, c, g, or t
  misc_feature (125)..(125): n is a, c, g, or t
  misc_feature (133)..(133): n is a, c, g, or t
  misc_feature (135)..(135): n is a, c, g, or t
  misc_feature (137)..(137): n is a, c, g, or t
  misc_feature (272)..(272): n is a, c, g, or t
  misc_feature (304)..(305): n is a, c, g, or t
  misc_feature (307)..(308): n is a, c, g, or t
  misc_feature (315)..(315): n is a, c, g, or t
  misc_feature (330)..(330): n is a, c, g, or t
  misc_feature (335)..(335): n is a, c, g, or t
  misc_feature (337)..(338): n is a, c, g, or t
  misc_feature (369)..(369): n is a, c, g, or t
  misc_feature (382)..(382): n is a, c, g, or t
  misc_feature (393)..(394): n is a, c, g, or t
  misc_feature (429)..(429): n is a, c, g, or t
  misc_feature (439)..(439): n is a, c, g, or t
  misc_feature (494)..(494): n is a, c, g, or t
  misc_feature (501)..(501): n is a, c, g, or t
  misc_feature (521)..(521): n is a, c, g, or t
agtccccagtatcccatctgataagangcttcaattctataaacaaaaatatttcaagaaagtatgttacacaatagtacatataagtnatantttggnngagttttgggctctagttgttcatncccccaantntnaaattttaaaattcaaaaataacagttttatttaacatatgttacaccttaacatttaaaatatcatgctctagttaaatatttcatcaacaacactgtatacaaataaaatattacataaaatatatttaaganaatgttttggtctttgatctgaacaataaatnntnncacaggntcttctacatagtcnggggngnngttactactcaataataatcttgtataagcngcatgtgaaaatntggcaataatnnattctgggattttaaattggcaaaccatctatgcnaaagtctgtnacttcaaccttttcactcaagttcaaaatacatatgccttcctggtccatattgnaaattcnctaacacgatatggttgttngcggcaattcaatcttcagttggccatttagggatcacactg

SEQ ID NO: 558138 - DNA, 124 bp, Homo sapiens
cagtttacagcgttcagggcagtttacagcgttcagggcagtttcagcgtcagggcagtttacagcgtcagggcgtattgaattcaagtataatattaagtatgcatggacctctagagctaat

SEQ ID NO: 558139 - DNA, 542 bp, Homo sapiens
  misc_feature (3)..(3): n is a, c, g, or t
  misc_feature (51)..(51): n is a, c, g, or t
  misc_feature (146)..(146): n is a, c, g, or t
  misc_feature (184)..(184): n is a, c, g, or t
  misc_feature (276)..(277): n is a, c, g, or t
  misc_feature (436)..(436): n is a, c, g, or t
  misc_feature (491)..(491): n is a, c, g, or t
ttnactatatagttcatgtcaaagagccaataatattaatgggtgctcgtngttcagcggcaaatcgtaacgtaagtatgggcggacgctttatcgttcgtaatagttcgacgcgttatggtattgtctatggacaccaaccattncataaagcaggagcggatccaccataacacataagtgncggttgtataatttccttcttaggctttaacgtacgtcgtgatggcataatattgggttcgggccatatttcatgtgatatcgggagtcgtnnaattgttccacgatattgcgtgtgtccaggtcccattcatatgcgcgtctggacaaacgccgattatttcggtcgtgtcttatttccgtcgagttgtgtcgtcttggcagcagttatatgttttccaaattcgtctattggtgttgtgcgtttaaacgnctattacatatttcgaaagccagtaatgggtgttagtccgtagtagccacatctntacccgtggaacggcgacttggtcacgtcgtgcttcactgtgggcggaata

SEQ ID NO: 558140 - DNA, 331 bp, Homo sapiens
gagaaatgcaaatcaaaacaacaagataccatttcacaccagtcagaatggcattattaaaaagttaaaaaaaaacagatggttgcaaggttgtggagaaaagtggacacttattcactgttggtgggagtgtaaattagttcaaccattgtggaaagtagtgtggcgatttctcatagagataaaacagaaataccatttgatccagcatccattactgagtatgtacccaaggaatataaattgttctgtcataaaacacatgcccagtatgttcactgcagcatattacatagcaagcatggaccacctaatgccattatggtggact

SEQ ID NO: 558141 - DNA, 1019 bp, Homo sapiens
  misc_feature (706)..(706): n is a, c, g, or t
ggctcttctggaccgtcttcgcacgcaaacctcgagtacagaagtgcggagaactcgaaggatcgagtgcactcccactgacgatacttacactgcagccatggcgcacatggacctatgccatatctagacggaaacggtcgatgttgctgagaggggcgatctgcccctgtctatctcaccagactagaagagggatgtcacctgacaagagggagaggtaatccccgaagggtctcactaggtcggacccgccatgctagcattcgcaaaagccggaactttacacgtataagcgccccaaggtacatcatggctatcgacctagtcaggacgtcgcacgcctcgcatgcacagaccacatcgtgaggcacgcacctcaagtaactgttgccattcacgagcatcgatcaaggccactatgcgcacatcacgcgaagacatcaccatcgagaccttatcatctcccgtgaagcaccggacaagcgtggatacctccggttgcaagccatgtggtgggtagcctctcgagggacgtatcctgtcttctcatacccttcatggggtcgcactcaacggcgatactcacgctctttgtgagcttcgacatctttctagagaggacttcccttgtcggtccgagaagctctcgttgaagcacatcttttgaactccatcggtagcgctagcgtcgtactctattttntatacatagtagatagctacgtaagagagaccggataggtcataataaacaaacaaaaaacgatataatccatcccaattcggggtgtgtggcgtacaagatagtacaatttattgtggtgatgttcagtgagaacacaccccaaaggtagcgttcagaaggggaacgcacaggacggggacggggggggggcacggattggaggcgtttacgctccgcctgtatgttgagcccacaggacccgacatattggaattggggccttagaaaattcgcctggaagaaattcccgttccggaatggggggttccca

SEQ ID NO: 558142 - DNA, 458 bp, Homo sapiens
ccatatcttgcttatacataaatccttgaagataccaataattttggtgcattttgtaggaatcagattaacgagatacattctagtggttagagtctttgatctcttccttgtcagttagattttatgcttattgacaaaccctctaaaccatgttgcacagcagtgtcttcagacttcccattatatttctgaaggttgcagtagcgctgatgggattgttgcttttcagcatcagggacttccttattgaatggtgtctgataacattccgtctccaggaactcagcgagatcggagtatgcattcagaggattcagtcccttctcaagagctttattcgaatagtccatagcatattgctttagtgcttcaatcatctctttatttccactagcttcagattctcctgtattctgcatttgtcttacttttgccttgtagcagcaccaccagga

SEQ ID NO: 558143 - DNA, 243 bp, Homo sapiens
aagtatctgagaagttgtttggcttagctcatactcgccgcagctgtggggaaagagggcagcaataagcattcctcggtcatcttcagatctccgctgccgcacccccaagtaactattaatagctcagcctgcaacatgcaccccagagcaagacagaagtcaatgaaacttggctgagaacacaacctgacttccccactatacctcgactatagattcacaccccaactacccagtatg

SEQ ID NO: 558144 - DNA, 1029 bp, Homo sapiens
gagggatcctgtggctgtaacggaggaggctccacacggacggtgcggctaccgcagacacgatctgggcatgcaggcacggacatgagccctccgaggctctgctgggtgtggctgatggcttgcggggaacctcagaggcgtgaacgagtggtgacatgcgggtggccaaacttggtgggactgccacctaaccagggcacgggctgagaggaatctctctgagcagagcggccgcaggtggggcactgctgtgctggaacaagctgatggggagcctgacctgagtgccagcgtccgtgtgccgggcccctggtgcttcgcagtaacgtcgctaagccagcgtcgtcgtgggtgctagagcatgcgcttcgggacacatggatcaggtcccactcatgctggacgaaggtccagtgacaccggggaaccgaggccatctgctggccgacatgctgaggtccctggcgtattgggcgtgacaagagcaactgcaggccatgatgagacgacgcctgcgtgtggctctgcaccaactgaaagccagggagcagcctcacaccattggcaccgtctccagggagcctctctggagggccttgggcagatcttctgacagcaggaaggggcttgcgacctgttccttgcgagctgtgaatgtgcaagggctgaggacgccgctggagcgtctgtggacacgatcggtcatgcatgatgtgccaacctggtagggccaggggcgtggtggagggagcggcggcagggattgtgaccatgcagtgtggctgcggagtgtgtgcgcttgggtcgaagggtcctctcaggtacgttcgtgtccggatggttgggcatcaacctgttcgtcagtcaagtgcttccaaagtggctctgctatggggcaggcgtgcggctctggcaacctttgcatctctccccggcctgttcagagccctggcgttctttcgggccgggacccgtgggaactgcagttcggcggatggttgggagtggcagtccctcatttgcggc

SEQ ID NO: 558145 - DNA, 845 bp, Homo sapiens
  misc_feature (3)..(3): n is a, c, g, or t
agnacaggagaatgtgataggagcgcagcgccccccccgtagtgtgctttgcggctcccggtgtctcaccaaggttaccaattgtttgggatgatatcaagttctagacttggcacctgggccgattcccgtgcaccgcctcgtcagggtcccggtccccccgcgatgcccccgtcccacgatggggttcaccagcgtcacgaacaacggactcttcgcttacaccagactgtcggcatcttggtcgaacacctcgacaggccccaactttgtgagcctggggcaagcccaccggggaaaggtccgcgccacaccccaccctgttggggagctttttcaagcaacttccacacccttgggagcacccctgcctttgtctgttgataagtacacccaccgtgtcgccccggggggtcttacacacgcaccggacgacccacaaggctgccgaggtcctggcacgagtggcaccccaacgtttccccccacaggtacgagaagtgcgcctcaacagacttctatgcccctttttccccccaccccaccttctcaaacacaacggtgtgaaaaagaccgcttaccaagaccctctcattctcacaattccccaacaacaattattcacttcgaacaaccgttacagtaccaacaagccattcttaaccttcaccaacgctaaagagaaaatttcagggacccctcatgtgttctatttgtgtggtaggaccgaccagtacagtataacatctattctagacaaacccacacttttttattaggcaaaaaccatacggccccaacatccccgaacttggcaccccccaaaaattaaaaacaaacaaaca

SEQ ID NO: 558146 - DNA, 1916 bp, Homo sapiens
gggtagtagaacaatgggattatgctgtcacaaaaaacaaagaaaaaacataatttcttaaatcatggtctgtcactgaatctggttataaaaccttatcttgcactagaaggatctgtagcttttccagctgagaatggggttcaggataccgaatcaacactagaaaagagagaaactggggatgaagaaaactcagctaaatttcctgtaggaaggagagattttgacacactcagatgtatgctgggaagagtctaccaacgttgctggcaagtctgattctttttttgatatggacctgttggtccatatcatcttttcagaagaaaagcatttaattgccaatgggaggagaagcccataatgttactgtaacttgggtattatgttaactgtctgttttaaaagaaagtagcgttaagatagatcagtaaccaaaatcataggctttttctgtgcattgaattttgtgaaaatgctgtataattttgacttactagtatttttgaacaatgcttaacatactaaccttacatacactctagaccaaaataaggcatcataatttacaccttaatctcaaaaattaagcatgtctttggtgaatggttttatatatacataaacctaaaacatataagacaaaaatttatgtttggagcctgtgttctgtaaagagaaggttgatttgtcttttagctatcgtatttggagtggaactataatacaaatgtataatattctttttttttttttttttgagatggagtctcactctgttgcccaggctggagtgcaatggcacgatctcggctcactgaaacctctgcctcccgggttcaagcaattccctgcctcagcctcatgaatagctgggattacaggtgcccaccaccatgcctggctggtttttgtatttttagtagaggcaaggtttcaccatcttggtcaagttggtctggaactcctgaccctgtgatccacctgccttggcttcccaaagtgctgggattacaggcgtgcaccactgagtccagcctatattcttgtttatcagttcaaaaatgctctgcactgtttttgactctttaaaaataacttagattcaaatttatagtagaagaaaaaaaatctttcagataagaggtgttctccagaatggaagaacgacttggcatgtaagaaatagcgtcagtgtcctaatgcatattgtgactgtttgcatatacttctgtttgtaaaaatatcggttttattttcagaggatttgtaagaaacatttaaattttcattgaaataaatgacaagtcatactgtcacttaaaaaaaaaaaaaagacctttgtcaaggagagtgcagtcaaccagtaaactgcagattctcagaatgtttattgacgtactgattattcattctgttatactctaacatctgtatatttttaccagtattctcagaccacttctaccaaaacataaatctgtgattgtgatctctgaaagtcagtccttttatctactcaataactgatctgataatgtcaacttttgaaaacagatagttatgactcaaggctttgagaatgtaaagagaccaccttcacttgttgagaaatggtacgatttcacgttatcagtgcagttccgttctcgggggaaagcccatccgtactaccaggagactggatccgcaaagtagacacttggtctcatgaagccactgctgggctccagagagaagggaaaactaagaggttttaaaacccctaccctccttggtttacctccatcattaaaaaacaacaatgacaacgacaacaaaaaacaaaactaaaacgacttattatttattaattatgttgtggcagacaatatgctgaacattagacataattaaatctttttaaaaattga

SEQ ID NO: 558147 - DNA, 1515 bp, Homo sapiens
  misc_feature (833)..(833): n is a, c, g, or t
  misc_feature (837)..(837): n is a, c, g, or t
  misc_feature (991)..(991): n is a, c, g, or t
  misc_feature (1188)..(1188): n is a, c, g, or t
gtccacctctgtgtccgcccttatttttaagggcgacgcaccgttatgtaggaaaccacagagtgtggtgctacccgcagaaaaagaagcccgcgagcgctgtggtgtaacccgcggtgtgcccgggggaaaatttcccgccgggggggtagttttctgcgtctgggtgacacccccctacaggcgctgttctcccggcccccggaccacacacaccagatgggggggtttttttccgggcggagcaaccctgttgtggaataagagccccccttcggcccccgggcctcctccacacagaggtggtcctccaagacaaggaagtgtaaacccctggagcgggggcatccacaagaaaggccttcaacaaattctcgcgaaggggggggttaattggtggccccaattgacacacaacaagaccacgaattgtgtgggcgccaacagttaatatttgtggaagagacgccgcgcatggtgacacacggcccccccacacccgcgcccgtcgtgcgcagaagaaccttttggtgttaccacataggcccgcgttacacggcttgtggggatgaaataaaagattgcgacacaccgtccaacaaagttgttctttttctcgcgaggaaataaagggagataaaaagggccccaacggcccctctggccaccacaggggagagggtgagaaagaagataaagcccctttttgggcgcacaaaatataatagtgggggtctccctgtcccccgagattgtgtggggagagagacgccacgccctacaccacagcgagataaggtggggaggagtcctactccacgaagattagtgtntaanagagatgtgtatagagatagtgacacactgtgggaccttctctctttgtgagatatctgtgatagtagatagagagagagagaggatatagatgtgagagagagagactcacacaagagagaggtctctaaagagggaaatgagaaacacgctntctgtgcgacgcacacattattgtgagaacttctacacagagagaaatcgcccactacaatataaccctcggcacacctttgtgttgtccacaacaggtctttctctcactctctcttactactctttagagagtgtgtgagaacaccctctgtggagagtgagatgagagagacacagaataatatggcgcgaganaattatagagaggagagtggcgtcacagagagcacatttcaagccacgagccgcggcttatatttctcgggggcttcaattctataaactatgtttccacgctgggagatatccggagaattaaagagaaacttcacaaataccacgtgtgtatgttgagaagatgagtaaaagttggagacacgaataatgctggagggaggcacgagtcacctgcttttgagggagctaatgtgcacgtccactggagatgtggctgctttcacacaccaagaatttaaaatccatcctggatcatggcatttaaataaaagattgaaagattta

SEQ ID NO: 558148 - DNA, 1841 bp, Homo sapiens
gggtagtagaacaatgggattatgctgtcacaaaaaacaaagaaaaaacataatttcttaaatcatggtctgtcactgaatctggttataaaaccttatcttgcactagaaggatctgtagcttttccagctgagaatggggttcaggataccgaatcaacactagaaaagagagaaactggggatgaagaaaactcagctaaatttcctgtaggaaggagagattttgacacactcagatgtatgctgggaagagtctaccaacgttgctggcaagtctgattctttttttgatatggacctgttggtccatatcatcttttcagaagaaaagcatttaattgccaatgggaggagaagcccataatgttactgtaacttgggtattatgttaactgtctgttttaaaagaaagtagcgttaagatagatcagtaaccaaaatcataggctttttctgtgcattgaattttgtgaaaatgctgtataattttgacttactagtatttttgaacaatgcttaacatactaaccttacatacactctagaccaaaataaggcatcataatttacaccttaatctcaaaaattaagcatgtctttggtgaatggttttatatatacataaacctaaaacatataagacaaaaatttatgtttggagcctgtgttctgtaaagagaaggttgatttgtcttttagctatcgtatttggagtggaactataatacaaatgtataatattctttttttttttttttttgagatggagtctcactctgttgcccaggctggagtgcaatggcacgatctcggctcactgaaacctctgcctcccgggttcaagcaattccctgcctcagcctcatgaatagctgggattacaggtgcccaccaccatgcctggctggtttttgtatttttagtagaggcaaggtttcaccatcttggtcaagttggtctggaactcctgaccctgtgatccacctgccttggcttcccaaagtgctgggattacaggcgtgcaccactgagtccagcctatattcttgtttatcagttcaaaaatgctctgcactgtttttgactctttaaaaataacttagattcaaatttatagtagaagaaaaaaaatctttcagataagaggtgttctccagaatggaagaacgacttggcatgtaagaaatagcgtcagtgtcctaatgcatattgtgactgtttgcatatacttctgtttgtaaaaatatcggttttattttcagaggatttgtaagaaacatttaaattttcattgaaataaatgacaagtcatactgtcacttaaaaaaaaaaaaaagacctttgtcaaggagagtgcagtcaaccagtaaactgcagattctcagaatgtttattgacgtactgattattcattctgttatactctaacatctgtatatttttaccagtattctcagaccacttctaccaaaacataaatctgtgattgtgatctctgaaagtcagtccttttatctactcaataactgatctgataatgtcaacttttgaaaacagatagttatgactcaaggctttgagaatgtaaagagaccaccttcacttgttgagaaatggtacgatttcacgttatcagtgcagttccgttctcgggggaaagaagtgtgaaactgtcaggaagacagatgaaatgatttgcctgaggccgtatcatcaaacaagaaattcatattcacctttctggaattcttaggataatgattacatgtgttcaattgttaaaaattggcagataaaattttatgtatttaccacgtacaacatgaaattttgaaaca

SEQ ID NO: 558149 - DNA, 697 bp, Homo sapiens
gggtagtagaacaatgggattatgctgtcacaaaaaacaaagaaaaaacataatttcttaaatcatggtctgtcactgaatctggttataaaaccttatcttgcactagaaggatctgtagcttttccagctgagaatggggttcaggataccgaatcaacactagaaaagagagaaactggggatgaagaaaactcagctaaatttcctgtaggaaggagagattttgacatattctcagaccacttctaccaaaacataaatctgtgattgtgatctctgaaagtcagtccttttatctactcaataactgatctgataatgtcaacttttgaaaacagatagttatgactcaaggctttgagaatgtaaagagaccaccttcacttgttgagaaatggtacgatttcacgttatcagtgcagttccgttctcgggggaaagcccatccgtactaccaggagactggatccgcaaagtagacacttggtctcatgaagccactgctgggctccagagagaagggaaaactaagaggttttaaaacccctaccctccttggtttacctccatcattaaaaaacaacaatgacaacgacaacaaaaaacaaaactaaaacgacttattatttattaattatgttgtggcagacaatatgctgaacattagacataattaaatctttttaaaaattga

SEQ ID NO: 558150 - DNA, 141 bp, Homo sapiens
accttctgcttctgcagggaagtgctgatttattagagagatccaggatgagatacacatggttttgggggttttttgagactggttcctgaaaaattccaccaaatctggctcctttttctgaggaatgactttgggaag

SEQ ID NO: 558151 - DNA, 318 bp, Homo sapiens
ctgtgcctagcttacctagggtcagtttgcagctggtaagccatttaccaagatagtgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggtggtttgtgattagctgtttctaacaattgttcatacaataattgttcattattgttctcaacttggggctctccccaacctggggacccttcctta

SEQ ID NO: 558152 - DNA, 835 bp, Homo sapiens
caatggtgtctcatgcctgtaatcccagcacttgggagcctgaggcgggcagatcactttaggtcaggagtttaagaccagcctgaccaagatggtgaaaccccacctctaacaaaaaatacaaaaattagcaaggcatggtggtgtatgcctgtagtcccagctacttgggaattgcttgaacctgggaggcggaggttgcagtgagccaccactgcactccagcctggtgacagaacgagactctgtctcaaaaaaaaaaaattccacagtggctttggaggggtaaatattttttggtttctaaatgaaagccgaaatacaaagatcagaacttttataaaggcggggcatgggggctcacgattataattccagcactgggggggccaggcaggcacatagtttgagaccagcctggcaaactggaaaaacctagtctctacaagaaaaaacaaaaaattttcgccgggatggtgacttgtgcctggtggtaccagctacccggagggcggggaggacggaatattgtagcccagggggttggggtgtgctgtgaacgcaggggatcacttacacgcgcggcccaaccgtgggtggacgacgcaccttcgtgttcttagagaaaaaatgacagaacactcgtcgacacacctagacaacaaaaaaagtgttggggcgccccgccaggagaatattataacacctatggggggcgcgcgcgcgtgagaatgagatgatggagcaaggtgcccaagaaacacgggcaatcggggggtgctcacaaaaaaagccggcgggcgcgggtgtgacaaacaacagtggcgggcactcg

SEQ ID NO: 558153 - DNA, 452 bp, Homo sapiens
ttaatgtcaaaacagagatcagaaggctgacagaactgaccgtggcaataagagccccagttacaaacaggacccaagaccatgtcagacgagggttaagtcaagtcatgcaccctgttagtcacccctgccccatgtttcgggtgcagatgtcctcatcgctgactctaggttttagataaagctttgctcctttaaccagccgcaaactgaagactctctgaatccacctataaccgataaggcttgcttccagatatcccgcgtgttcgagctgagccaatatatatctcgtccacctgtaacgcctgtcccctaaagtgcatgaagccagactgtaatccaggcacctcaggaacactcactctaggcttcttgggtttgttttttctccaagctgtggtcaccgtattaggggtcccaataaacctctttaaaatgttaaaaaaaaa

SEQ ID NO: 558154 - DNA, 510 bp, Homo sapiens
  misc_feature (364)..(364): n is a, c, g, or t
  misc_feature (369)..(369): n is a, c, g, or t
  misc_feature (373)..(373): n is a, c, g, or t
  misc_feature (389)..(389): n is a, c, g, or t
aatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccccaccggggagtgggccttgatggccgggcctcgaaggccacaaacaaggcgtcgaggaattggaaagatttncacancctncagaaaggagagacgnaatctccggtccctcccatgccccacttcggtggaacagcttcctctcactgaacggagagcccccttggacgaacgtgctgatcgttggttctgaggctggtttgtcttatgtatatatg

SEQ ID NO: 558155 - DNA, 289 bp, Homo sapiens
  misc_feature (182)..(182): n is a, c, g, or t
  misc_feature (221)..(221): n is a, c, g, or t
catgcccggcagggtcgacgtctagagggatctcccggcgcaggcgtgcctgatgatgcgtctgcagttgttattaaagaaatcacgcctaaccatgacaactctcatttccgttagtaagcccaagttaggattaacggcctataaacagtgttgggaacaatgtttaacattttgtgccnatttgtcctgtattcatgtatgtaagttacagatctacncttcatttttaagttccttgtacatcatggtcattttctagttttttaccagactcccatgctcacaa

SEQ ID NO: 558156 - DNA, 581 bp, Homo sapiens
  misc_feature (27)..(27): n is a, c, g, or t
  misc_feature (36)..(36): n is a, c, g, or t
  misc_feature (46)..(46): n is a, c, g, or t
  misc_feature (72)..(72): n is a, c, g, or t
  misc_feature (76)..(76): n is a, c, g, or t
  misc_feature (97)..(97): n is a, c, g, or t
  misc_feature (99)..(99): n is a, c, g, or t
  misc_feature (105)..(105): n is a, c, g, or t
  misc_feature (107)..(107): n is a, c, g, or t
  misc_feature (113)..(114): n is a, c, g, or t
  misc_feature (129)..(129): n is a, c, g, or t
  misc_feature (206)..(206): n is a, c, g, or t
  misc_feature (218)..(219): n is a, c, g, or t
  misc_feature (229)..(229): n is a, c, g, or t
  misc_feature (231)..(231): n is a, c, g, or t
  misc_feature (235)..(235): n is a, c, g, or t
  misc_feature (240)..(240): n is a, c, g, or t
  misc_feature (293)..(294): n is a, c, g, or t
  misc_feature (296)..(296): n is a, c, g, or t
  misc_feature (301)..(301): n is a, c, g, or t
  misc_feature (313)..(313): n is a, c, g, or t
  misc_feature (315)..(315): n is a, c, g, or t
  misc_feature (338)..(338): n is a, c, g, or t
  misc_feature (340)..(340): n is a, c, g, or t
  misc_feature (345)..(345): n is a, c, g, or t
  misc_feature (357)..(357): n is a, c, g, or t
  misc_feature (382)..(383): n is a, c, g, or t
  misc_feature (385)..(385): n is a, c, g, or t
  misc_feature (390)..(390): n is a, c, g, or t
  misc_feature (394)..(394): n is a, c, g, or t
  misc_feature (408)..(408): n is a, c, g, or t
  misc_feature (418)..(418): n is a, c, g, or t
  misc_feature (448)..(448): n is a, c, g, or t
caagctgcagcctcggctgctcagggntcccttttnacttattgtngccactgccccttggatgctgtgttngtcncagtggaaggaggggaagatntnggaaancntgtaannaccaataaggatgantctctgccctgttggggccttaaatttgggggcttttgggcaacctctccgtgtactgcgtctgtccacactcgatngggccccaggtnngtatgaggcncncttnataangtgctcaggccagtttcaatgtctgtcatgtaacgtaggcttttgatgtgttnngntggangtgaatggaccngngactgtgttttaatcttacttcntnggcanttgtgcatcacngccttctgttcccgggggaacatgnntnttttntccncacttctttctaantgggaaggcntgagggctcccttgtccccatcatgcaggnatgttgggctctgcccaaccccacacttactctgaaaaccaagtgtcaccagccccttccccttgtttttattttactgttataataattattaacttccttgtaatataaataaaatttgtacttcgagttc

SEQ ID NO: 558157 - DNA, 925 bp, Homo sapiens
  misc_feature (258)..(258): n is a, c, g, or t
  misc_feature (263)..(263): n is a, c, g, or t
  misc_feature (280)..(280): n is a, c, g, or t
  misc_feature (294)..(294): n is a, c, g, or t
  misc_feature (296)..(296): n is a, c, g, or t
  misc_feature (299)..(299): n is a, c, g, or t
  misc_feature (315)..(315): n is a, c, g, or t
  misc_feature (721)..(721): n is a, c, g, or t
  misc_feature (925)..(925): n is a, c, g, or t
gggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctcttttttttttttttttgggaaacggagtctggtctgtggccaggtgggagtgggggggtgcaatctcagctcacntggantctccacctccggggtncaagaggttctccngnctnagcctcctgagtagcngggggagctacaagcttgcaccaccacacccagctaatttttttttttttcgagagagagagggaggtttcggctttgggtccgccacagggtttagatgtggcaggggcgcgcgagatcccgggtctcatgtggaaaggctctggtccccggggcgtccagggccattctcgcgggtttagaaccctccgcgagagttagtccccgagggagtatggggggacatcagcgggggcccaccaccaaacccagttaatttggggatcgcaagacaacaaaggggggttccacccggtttacccgggggaggggtgagaccctcgagaaccctgggaacccggccggcgtggggcccccccaaaggggcgcggggcactaaataggcggggagacgcccacgggccgngggggacacaatttgtggtctttctcacgcccacaacgcgtgggcggttaccccccgtgggtgtgcgcccacggaggtgtgcaccaactctgagccctttgggtgttttgtcccaccctttgcgcctccccaaagctgctctgacgactattgggggggttaacccccaactctttagcataagaggatattgtaatcttccan

SEQ ID NO: 558158 - DNA, 470 bp, Homo sapiens
tactgtgtgtacatacttatagcatgacaccagacctatatgtaatgtattgaaaagtacagctgtcaaggaacgaacaagtgacgtgttgaaattaaattgaggacatagctggactgtctgctttggtcatagctaaaataatattttagaccgctgctgattcagagggtggttatcatacagattgttgcttgttttccaatcactactcaatatcatcatgcacctgcacggtgcctttggaattcgagttccagtaccaaatgcattgtaaacaccaacttcaaaccgaatttcataatcctgaggtggtgtcacccctccacacatgacaggactatgtggccggccaaggaagtcacgctctctgatgagttcctgaactctgggtttatgaccagcagcgagggtgtttacacacacaggatgcacatccgcattcacagtctgctgagccactgcacgag

SEQ ID NO: 558159 - DNA, 226 bp, Homo sapiens
tgccattggaaattctcaatgaatttccctgtgtggcttggccttggaacctctcctaaaattctcagattgttggcttgaagctcaaaaaaatccaaagataagacctattcttcatgacaccaaagtgaaaaaaaaatttacggactttgcaattcaccctgtggttttccttaccccagcttgttgccgaggcttaccttcaaaccccgttggaaaagttggt

SEQ ID NO: 558160 - DNA, 647 bp, Homo sapiens
ccggatcgtttttgtgggtcaaacactccgccacgggccgtcctgggggcccccacgtcttcttcgggtattcaggcttaccaattatccacggcatcagatcccccctcccgggggagaaaacccttggttacccgctgggggcccctctgggggcggttgatgaattccccctcccgctcgcttcgagtgtcgccgcacgctgcttctattgcagcccgctctttcttgaccccccgggtgtgcatgggacacttggtgtcctttccccacacagcttgctttgtttggtaagcgcacacagcgccgccagtggtgcgatgcacgtccttgctcataggatgggtgtataatgcgcccgaaccaaccacgctacgttgttttctgtcggccccctatgtgtataaaggcacgacatgcctacagaagacccacgggcctttgttgtccaacgcaccctcgctgggaagagagggtactcctctcgaaaagattgcaacacactggtggggcagttggttggattatgacacgctctacaccgagcgggcaacacagtaatctccaccctttccccccccgtgattaaaggtgatagccccgggcaccccaaaacaaaaaaacctttttgtctcgccaacaaaaca

SEQ ID NO: 558161 - DNA, 109 bp, Homo sapiens
tacaagatccgggtcccagccctcagttccagtctcccccagccaagcagacatcacattctcgaagcagacaccccgtgaagcccctacaagttctccagacaaccag

SEQ ID NO: 558162 - DNA, 193 bp, Homo sapiens
catagctttatgtctagaaaaccctacgtacataccttattttaaaatcctgctacacaatgttgtgatcattagaggactcagcaagttggaacctattctgttgtgtagggccttgccttgatgttgatgggctgctgactgatcagggcggttgtcgttcaaggttgctattgaaacttctaaaactagg

SEQ ID NO: 558163 - DNA, 160 bp, Homo sapiens
attactatttgcaggaggtgggggtgtatgcaccgcacaccgtggctatgagaagcaagaaggaaggagggagggaacaggatagagggaaaaagaggaacaggaattgaactatataaccttatatatacctattttcccaattttgaaaaatttcaag

SEQ ID NO: 558164 - DNA, 327 bp, Homo sapiens
gggagacgaatgtacccgcaatttcgcgaattgggtgccgcctacgccatggaccccaagagtgacgcgggcatctattggacgggcttattcggcacgcaataaggttgagcgccggcccaacccggccaataatgacggcgtgcaaatagacaatgaaatcaaagtgctatcagggagataattgcgctgaactgaatgcggtcattccggtctgttgctagtcggcctgactcttcaaagctaaacaatacgtagcaagcaaggtgtgaaccccataatgaattggctgcaaggcagcagcgaaatggcagagcgggttcgtca

SEQ ID NO: 558165 - DNA, 169 bp, Homo sapiens
ttatgctggaaagaaacatgctcacatcagtcccaaaggacagcacctctgccacccagtccagtgggctgaggagaggctgaggaacctctttcctctgtatgcactcactcgacaaacactccgcggtactttgccgatgctgggccccgtgctagagtgctgagga

SEQ ID NO: 558166 - DNA, 1259 bp, Homo sapiens
gttccacatgtttcttcctgctgccaccgtggagtcttgaaattcctggagctgtgaaggactatgtagcagctgcagggtttaccaaacgtgggagggcagcccagtactgtccctctgccttccccactttgcagaatatggcagcccgtttcattcctggctagggcgtacggggcagaccacttgcaagtagaacgccctcaacacgccagacttcttccctcttactgtgtgtactccaggaacgaacaagcgaagactcatgctttgataactctagactcggtctttcccctagggcaacgcagggccggatcctagcacgccaacagtccactaggtgaaccactagggaccaggcaccatgggcatagcagagcccaaacatcccttgcaccagccgtcctcccatggcttacgcacacaccccattgctcgcccgacttcacacccccacccttcgcacaccttactcacgcccttcctcccccagccggctccactcgcctcgccctcaactgcgctcccaccgctcccacacatcgctgtcgcgcccctaccttgcgcccacgcgcgcccccgcgtccccatcttacaaacgcataaacctcctctcctggcgcatttctccacttcacacacaacacaaataataggcacacacacattcgcccacagctcgacctttcccgccaacacgcacgcgctcttgagcaccttcgcgacataattccacaccccggtcacaacacacacacttacacgccctagcaccacaaacgggccggaacaccactccatcgcacgccacacacctcgcctcgcacccagcacccaattggtcacacacagcgttggccaaccacatctcactgagcgcaccacccaacacctcttgaggcccccacacccaaagctgcacactctcgcaccccagccccgcacctcctcccacagtctcaacgctacacaaccgtggctccctacaccccttgtgccaccacacccggcagcataccaccccaccagccgcactcacacccattcggctagcacacgcaaaacgcctaagacacacacgaccaaacaccccccagcccgacacaccaacgcacacaggacccccgcgcaaccccaccaaccccccccacctcaccacgacacccaccatgcacacaccgccgcccaccacacccacaccacaacacgcacacaaaacaccgcccatacaccaccacacccccctcccgaccagc

SEQ ID NO: 558167 - DNA, 186 bp, Homo sapiens
tcgaatcgagctggtaccggacgtacactgcagatgtcgctgctgccgcaggacgcgcagacccgcgaaggctcgtggaacgccgtgctgcgcatctccgagctgcaacggctgtaccacgccaagcacgacgtggtgtcgccgcaggacgtgctgcagtacatggtgcgcgacgccgagaacccg

SEQ ID NO: 558168 - DNA, 303 bp, Homo sapiens
  misc_feature (203)..(203): n is a, c, g, or t
  misc_feature (285)..(285): n is a, c, g, or t
tgtcagagatcccgtgatacacgcattatagcagctccgtgagcctgccagcagttcccgccttgacctaccaaagtgctgggattacaggcttgagccatcatggccagcctagatatttttttggtcagagaaaaagtgagaagaggaaataaccaaagagaatgcactagcctgactagttcaagtacagggttcatgtngactcaggcatgtatctattaaatccttgcaatgtattagtctgatagaggttgggtgtagtcacattaaaaacatttggcntataatggctgtgtatcg

SEQ ID NO: 558169 - DNA, 916 bp, Homo sapiens
  misc_feature (558)..(562): n is a, c, g, or t
  misc_feature (564)..(564): n is a, c, g, or t
  misc_feature (567)..(569): n is a, c, g, or t
  misc_feature (576)..(576): n is a, c, g, or t
  misc_feature (578)..(580): n is a, c, g, or t
  misc_feature (585)..(585): n is a, c, g, or t
  misc_feature (587)..(587): n is a, c, g, or t
  misc_feature (673)..(673): n is a, c, g, or t
  misc_feature (695)..(695): n is a, c, g, or t
  misc_feature (699)..(699): n is a, c, g, or t
  misc_feature (705)..(705): n is a, c, g, or t
gcacttcgcctgccgcggtcgggtccggggtctgcgctgtagcggtcgccggcgtgccctggaagtagcaacttccctaacccagcccagatacctggtccccgtgccaggcacggcgtgagcgtgaagatgagcagtcatcataggaggtgtcctggaattctcctggattctgtgggctccgtggcaattgaagttcttctgtgaaggtggattgaaggatctacagtccaggacaaattttaatacttgacgtgggagctcaagtagagtcaggtccactctagctactacgtacaaaggcctcttagtatccatggatactcgtgtgaccgtgcgatgccttgtactgacagtaacctggcaatgtacaaagcgcgcctatactcatgagctgaaccttggagttgcacgcgagtgcgagcctgaatgatgcctttgatgagacttggatccacggcccagctacatcctataccaaccgtggcatcgcccaagatgttgcgaaaacgtaccagcaatggagactttggttcactgtcctcgtgtgtactgtgnnnnncngcnnntgcttcncnnnggccntntcagacatcccaggtgaagccatggtgaagctctactgccccaagtgcatggatgtgtacacacccaagtcatcaagacaccatcncacggatgcgcctacttcggcnctgntttccntcacatgctcttcatggtgcatcccgagtaccggcccaagagacctgcaaccagtttgtgcccaggctctacggtttcaagatccatccgatggcctaccaggctgcaaggtccaagccgccagcaacttcaagagcccagttcaagaagattcgctgattccctcccccaactgtcctgcagtcttggcttttccttactttgtggcacc

SEQ ID NO: 558170 - DNA, 371 bp, Homo sapiens
  misc_feature (14)..(14): n is a, c, g, or t
  misc_feature (38)..(38): n is a, c, g, or t
  misc_feature (168)..(168): n is a, c, g, or t
  misc_feature (294)..(294): n is a, c, g, or t
  misc_feature (331)..(331): n is a, c, g, or t
  misc_feature (338)..(338): n is a, c, g, or t
ggaccaattccccnaaaatgggaaatgtgtgttaatgnccccatcctgaacagatggaaatttggagataaaaccctcctagggttaaactccctgcctcccctgatgtggcagatgccaggacttcacccggcagaaaagtgttttacaatctccttaacctgcctncccggataagccgtatctttttctgaggcctgcagcattaagatgggttaaggaatggaacgtttgtgcatcggcaaaagctgcagaaaccagtgcatccgccctttgattaagttaaaaggcccngggaggttagtatgtgctctcatatgagtaatatagnaaggggnatgtctttgttgtactgcttgttgtaaagaatg

SEQ ID NO: 558171 - DNA, 896 bp, Homo sapiens
  misc_feature (105)..(106): n is a, c, g, or t
  misc_feature (478)..(478): n is a, c, g, or t
tactcactcctcctgaaatatattacccgcgtattctctcttacccctcgatgaatccactctgcttgttacacacacacacttctcgccattgacgtatgcatnnatcaacagtgtgcctctgtccccaattaagtcacccaattttcctcgtaacatcaagtgtccgcgccatcatatcgccgactacaaccagaattggcggtccagtttttaaatgctcacccatacaacagctcttgtctcgaaccactaatagcgaaggcgcgtaaattttcacacaaaactgtctattctctgtatatccaacaagtgtactttcttcttatctacaaaggggaaaaacaaagaactgtctgtcagattgcttattatggcgttctccaacaatacctccccaggggtttattgtagtcttgccaccacgtcgagagatacttcaacatagattttgcacacaccgtgaatgattgcgtgncccacgacgtcgggcacaatttattagctggacacagtaaaagggcagacgctataaaaaatactggtgccacagaggcagccccccgtacgggtctggtcaccaccattaacactcccatgccccgcactacacgctattaacactgcgtcaaaagcgactctatatcccccaaacatctcccatcaccccactttatgtgcgcactttgtgtcttaaacccaaccagatgagcctatccaacatgtaagacccctaatgtggcgccgaccccactacacgccctctcgacaattcatagaggcctttgattctctcttcagatgattgcatagtacagccccgcctcccctgttcattcctaccgccccctcgattatttttcgcaatcgcgccaggattcccccccacaaaacaa

SEQ ID NO: 558172 - DNA, 416 bp, Homo sapiens
  misc_feature (30)..(30): n is a, c, g, or t
  misc_feature (240)..(240): n is a, c, g, or t
  misc_feature (269)..(269): n is a, c, g, or t
  misc_feature (380)..(380): n is a, c, g, or t
  misc_feature (405)..(405): n is a, c, g, or t
  misc_feature (415)..(415): n is a, c, g, or t
aaactcaccgggctcctgggccatatcccntggacccctgtcattgaagcctggcccagctgttctgggtctgaggcccagatatcaccagtgtccagatatcacacagatcattggttttctgctctttttccctcctcagggaggaagaggcctggcattcaggacagtgaagtcaccgaagaaaggtggcagcaggggagactgggggtggactctccagcccgtgcccgctggaanccctctcctttcccttcttaagcacctgncggatggaagcgtctatgcagctaggacttgttataatggagggttttctccccgccgtggactctcttggaggctatggacttgtcttgctttgcccaatcattcttgtncccaacacgttgtctgcatgaagtnaaagatttgng

SEQ ID NO: 558173 - DNA, 421 bp, Homo sapiens
gaatctcataattccccacaagggatggattcaaaatttttatttcaaatttagaagaggatttgggggtatgtgggttataaaaagggaataatttacgtagcactttctgtagcacttttctcttatacatctattaacatttctttcttcctcttaagaatatggtgaggtaggaagctcaagagattattactcccagtttatacatgtggaactaaagctaaaaagaataaataactcacccaaaatcacaagcaaattaggaatgcaaactagaaatgagaaccaagtctcctgatcccctaatgttctggccagcagagctcggctcaaccagcccaatcattcctgtcatcttcatgccaacagctgatcacaaagtgactgacggttaggccccggtagtggtcatctcgtc

SEQ ID NO: 558174 - DNA, 133 bp, Homo sapiens
atgcatactactgaacttaatcatatgaccaaatattcacttatggtaatcttactctactgatttccccccagactgtgatattagaacgtaatgtagagactgaaaagcaaataaataattgcattagcat

SEQ ID NO: 558175 - DNA, 522 bp, Homo sapiens
ccacgcgtcgcggacgcgtgggtcgacccacgcgtcgaaaaaaaaaaaaaaaaaaaaaaaaaaaaaaaaaaaaaaaaaaaaaaaaaaaagagggggggggaaaaaaccccggggggccaaaggcaaccttttttgaaaaggggggccccaaggggggactgatttaattagacgagaagagcaggggggcgcgtattaaaaaacggatgggtgcggggggaaaaaagagatgaagcgtgggaatatcttttgatgaaagaagagaacaaccatcaatattagggtggggggtgggggcaaaaattaggttggggaaaaataactatcctaaaagagaagtatttgtagggcagctactaggaggagaaaaaaataaacaatttaacgaggagttattagggtggtgtgaaaacaagcagctaataatatggagggggtgaagaaagataatggtgtatcagagggattgttgatatggaagaaaatattatataagagaggaatttatagttaaaaaggcgg

SEQ ID NO: 558176 - DNA, 635 bp, Homo sapiens
  misc_feature (544)..(544): n is a, c, g, or t
  misc_feature (564)..(564): n is a, c, g, or t
  misc_feature (571)..(571): n is a, c, g, or t
ccgcacttagcctgagaggattttcttataaaagaaatagataaattgatagacatttaggttgattccgtatctttactgttatgaatagtggtgtaatctacatggaggtgcaggtatccttttgatatattgacttcctttcttttggatacatacccagtagtgggattgctgactcatatggtagttctaggtttagtttttgaagaaatcgccatactcttctcataatgactacactaatttgcatttccaccaacagtgtagaagagttcccttttctggctggtcgcggtggctcacgcctgtaatcccagccctttgggaggccgaggcaggcggatcacctgaggtcgggagtttgagaccagcctggccaatatggagaaaccctgtctctactgaaaatacaaaattagccgggcatggtggcgcatgcctgttggtcccgctactcagggggctgaggcaggagaagcgcttgaactcgggaggcaaaggttgcggtgagccgagatggtgccattgcactccagcctgngcaacaagagtgaactctgntctcaanaaaactgcccggcgtttacacgtcggactgggcccttggggtaccaactttcgcttgagacttc

SEQ ID NO: 558177 - DNA, 173 bp, Homo sapiens
aactgcttgcgcacgcggacgatctcggcgcggctcagcgtcgacgtgcgctgggtgctgccatagcagaccagcaccgcgttgcactggcccgaggccagcgcgtgcagcgccggcagtaggtgcgccacgaagctggagccgcccagcatggtgctgtctatgaagctggg

SEQ ID NO: 558178 - DNA, 184 bp, Homo sapiens
ggatagatgtgaaaggtcagtggacaatagacggaaagatggagacggtcagtggacaacagacagattggtggggagtgtcagtggacaacagatagatgaacagatgtgagacgtcagtggacaacagatgtatggatcgatggatacgtccgtgtgacccacactggactggactacggtg

SEQ ID NO: 558179 - DNA, 235 bp, Homo sapiens
tgactaggaggagttttttattggggatcctgattgcaggtaaaatttatcattgggcttctaaaagtatgtgggtatcttctaatatcgggagtctgtctctatatctgggcattcgttcttcccgtactactgtcttccagttggggacttcaaacttcgtagtcttctccaaattgtttcatcctaccactcccaattaatctttccattgtcgagatagttgtaaatggcg

SEQ ID NO: 558180 - DNA, 234 bp, Homo sapiens
cccccggggttttttcccccccttgggggtggggtttcccccccccgggcccgttttttgggccttttttatttaaggggggggggggggggggggggcccccccccgggggtttttttggggggggggtttttttttttgccccccccttggggtttttttttcccggggggggggggaaaattgggcccctttcccgggggggttttttttaaattggccttggggggggga

SEQ ID NO: 558181 - DNA, 241 bp, Homo sapiens
tcttagctggcactccatacccccaaccccttccccggagctctcttcagccagggaatgagcttcactagaccggccaccttgcaccctattaagcacagcagcttagtttgcaagggcctttggagatagagaccttcacagcacactatatctgagacatcccgctatctttattgcaatattatatgttcagagagccaggttgccactgtacaacccgagaactgctatttgcata

SEQ ID NO: 558182 - DNA, 915 bp, Homo sapiens
  misc_feature (389)..(389): n is a, c, g, or t
ggccgtatgttggccaagccgccattaagagcgtttcctctttggccagcgtggcccttcgcccgtttgaggaccccggcttccccttctgtattgccggtgcccccccccggtgtgtatttcagaactctccgtttgaccgtggacaaaatcgctgttttccgcggagtttctccgggcttccaaaactttgcgataagcgccccaccccggcctctgacattgataacgcccccgcccagcggcttaaatacattgtgtccgcgaccgtggtccatggcactcgagtggttccgccacacacaccacgaaagttcccgccgggctcttttaacagagcgtcctatcctgccctcattaatggacgaccctcggtgggatcttcgctnacagtggggcaactgttccccgtcccgcgagggtggcgccccccgcgtggggcccctcttggagaggttgcggctcggccccccttcatgcaccgctgggaggaaagcgttttcccaggaatcattgctgagacaattaccacgcggcctgttatttgtaaacgcgccctgctccccacgcggttagaacttatatttctgctgctacgaccacgcgaagtgctgcacaacacttttggtgcccacaaattgctcttccaaatcccagtgaccctagtttatcaatccttgtgaccctctcttgtttacagctgaaatgattttctctctttgtgcaatctatcttcttcggaacgatatctcaattcttaaaactcctctatcagggagattgcagacctctatctcgcaactatagaaaaattagtacccttctatattagtactcccacagagtctccccttctttgcccgcataaaacaagttcatctatttcggcaacataacaaaaaaaacgaacataaa

SEQ ID NO: 558183 - DNA, 340 bp, Homo sapiens
cccatcctgttttcagccttctgtttataattagacattgtccgaagcttcatctagtgctttacaaatgtggggagataaatcagacttcacatgtatgcaagatcacctcacttacacagtatggtccacatagcaaaaataggaccaggtgacaacatgctagtcattttttaaaaccatctacttggtcttctgcgtgcgtctgttttctctccattagaatcaaatgtgtccttgatgtaaatgcaaagcacttcttcccgattcaattgtagatgtagactttacaatataactcaatacataaaaagtaattaacctctaaaacaaaaaaaaa

SEQ ID NO: 558184 - DNA, 117 bp, Homo sapiens
atgcccagaatgggcagtggccacacaggggtatttggggtatccgtcacctcatggactggtcattctaagtgttggggaagacctcctgtcctctcttctcactgttttaaagta

SEQ ID NO: 558185 - DNA, 740 bp, Homo sapiens
gagcgggctggggcggggcaggatattacggttggttgaggacatgccactaggccatgctggtgtgggggaactggggacttttgggcttcatgacagccccacgtgtgatcacaggccaggggctcagtgcttgcctttctgctaagccgctgccagagagcagagtgagccattctcccccgagctcccctctatgttcccctttcctggacaggcttcaggctggaggtgcagctcccagcaccgtgttgagccgggggtgtggagtggcgaatggggcagtggctgggggagaagagacagagtcagtcgtctcaggtaaggcagggatttgacagtagacaccgcaaggatcacacatgcatcctaccaattgccctctacaaccttgcatgcaggggaacccagcacaggacacctgggaaagatgtataaacccgacctcagtatggctccccggacgataacgcggaaagagtaggtcgaccccgagcaccacggaagggggtcaataatgacggtaccaggatggacaggaacccaccgacaagatcagaggcccagcgaacagagaaaaaaaaagagagaagcaaggaacacggacacagacgagaaacgaacgagagggagagacagaaagagaagcaagaacaaaacgaacaaccacaaagaagaggaaggagagcgagaggagaaagagaagaaagacgagcagcagagagacaacaagagagaag

SEQ ID NO: 558186 - DNA, 1079 bp, Homo sapiens
agcgggggcgggggctgaggggctgccatggcggcggcgggccggctcccgagctccgggcccacagacacttgcactacctacagcaggtgcgggcagctaacgtaaggaggagcaaaggaatacccagcgtcatgcagcagcgcaagcgggcacgagccgaggcactagtagagagtccaatgatccgggaatgatcgccgaggcagatgggacgtgggaccttcaatgaccgagcgaaagcaaataaatattactaacggtagctaatcggggaataagatgagcggagagcgtgcagtaatattcaagaccaggaagaacttggcctgtagaagatatcctcaaaataaattaataggaatggtgcaggaaaatcatcaatatgcgagagagaaatcgaatgaagaggccctatttaacaaataggagaggggagagcaccgggaagaagagacttaactaaatgtgaatacagcccaggaaatataaatctcaatgatgaagataaatagaggcgagggatcggacgaaattacaaggatgaaatcaatatataccgaaagcagtagatgagggcgaaagcactgaattggacggagactggatggaggcacggattaaatagttttaggcagtaattaaagacaaaggagccttacttagataagttgaactctaagatagaggactcaagttggggctcagtaagcataaaaggaacttttattgatgggacacaggtcatttgcaactataaggccatgggagcatttgagaaattcttaagagacctaatttggaacggatcatttgtatgacatctaagcataagtaagtgagcatggatgacaagagagctcgggaccaatttaaagatgagatgtgcacgtggaattggaggccaagggcaattttgaacagtgatataaattgtgaacgagatggattattattgcaattgggaatttattgtggggaaaggttttggggattgttttattttaaaaagaggggattaagaaactgtacggtatggaattgtgagtgtaatttaattagttgtttcatggggatgg

SEQ ID NO: 558187 - DNA, 258 bp, Homo sapiens
  misc_feature (6)..(6): n is a, c, g, or t
aacggntgatgcggttgtcgtggatctcgaggcgagaggctcagtagaccctttccagattcgattagagccatatgcacttatcatccgaggggagagctacattgggataactgagaggaaggcttataagatgtggagccacagcgacgtgatgcatcagcagcctgtgaagacatgatcagcgactgccgcatcattgaaggctagcccgagagagcgataataaagacgactagacgtgcctcacacagacga

SEQ ID NO: 558188 - DNA, 319 bp, Homo sapiens
  misc_feature (22)..(22): n is a, c, g, or t
  misc_feature (32)..(32): n is a, c, g, or t
  misc_feature (58)..(58): n is a, c, g, or t
  misc_feature (139)..(139): n is a, c, g, or t
  misc_feature (157)..(157): n is a, c, g, or t
  misc_feature (178)..(178): n is a, c, g, or t
  misc_feature (189)..(189): n is a, c, g, or t
  misc_feature (200)..(200): n is a, c, g, or t
  misc_feature (205)..(205): n is a, c, g, or t
  misc_feature (231)..(231): n is a, c, g, or t
  misc_feature (237)..(237): n is a, c, g, or t
  misc_feature (264)..(264): n is a, c, g, or t
  misc_feature (281)..(281): n is a, c, g, or t
  misc_feature (283)..(283): n is a, c, g, or t
cttctgctccctgaactcttanttgaataaancgtccagcagcaaaaaaaaaaaaaanaactcgaaattcaacatcgaatacgccgcagcccttcgccctattcttcatagccgaatacacaaacattattataataancaccctcaccactacaancttcctaggaacaacatatgncgcactctccnctgaactctanaaaanatattttgtcaccaagaccctacttntaaccnccctgttcttatggattcgaacagcanacccccgattccgctangnccaactcatacacctcctatgaaaaacttcctacca

SEQ ID NO: 558189 - DNA, 904 bp, Homo sapiens
ctctcgcctgcggagccggcaagtattggggacaagaacatgatgacaatgactcacccacatgaaggaacaacgggcaatggagcgccgggacctggatgacctccagaaggaggtggctatgacagagcacaagatgtcagtggaagaggtcttgccgtgaaatacaactaccagactgtgtgcagtggttttgacccacagcaaatgcccatgtgagatccttggccctgggtatgggcctaactgcactcactgccaccggctaccacccctagagttgggtcaacgtttttgcctggcagactcttctgggggcttctccatcctgctgtggatcggggctatccgtctgcttcctggcctactggtatccatggctgggcaccgaggacgagccctctggtgacaacctgtacctgggcatcgttgctggctggcctgtggtgatcatcactggctgcttctcctactaccagtgaggccaagagctccaagatcatggagtccttcaagaacatggttgccccagcaaagccctggtgatccgggaatggtgagaacgatgcatggtgaacgctgaggaggtaggtggtcggggcacctggtggagatcaagggtggagaccgagtgccagctgaccctgctggaatcatctcagaccacggctgcaagtgtggacaagtcctccctgactggcgaatccgagcgcccagactcgctctcccgactgcacagcacgagaaccccttggagactcgagaacatcaccctatcgataaccaacaacttgtgtgggaaggcacgtgatcgagggcgtggtggtgtacacggggcgacccggaatgtcatgggactgaatggccacccctggcatcaggactggaggtgggccagagccca

SEQ ID NO: 558190 - DNA, 252 bp, Homo sapiens
aggagtctagctccactggttggcatggtgcttatcaagatgagcatctcattcaaacagtcaaaaaccgagttaaagtagctcagacacgcatagaagggattggctgctgttgtggcctctccgagggtggctccatctgcaggccctgttggcacccgtacccaaggatgatgtcccagcatctgtctctccgggatctcagctttgtaccctgccctcactggttgcgtctcatatctgcttccctac

SEQ ID NO: 558191 - DNA, 222 bp, Homo sapiens
  misc_feature (186)..(186): n is a, c, g, or t
cccgacaccgacagctgggcgtgggccaggctcagggcccacaggcgcaggtggaggcggtgttggagacgcgcccaggcagaactcgatggtgttgatggcctggtgcatgagcaccttcggaggggacgtaggctcggcctccttcttcgatcatccatggcccccttgccttttcctcatcgngagctccagtccagttcagcgagaatgctgctcaag

SEQ ID NO: 558192 - DNA, 443 bp, Homo sapiens
gaccttttcccttataaatttggtccaaccgaagggccccccccccaaatgcgctgtggggggttgtaaattaaactctttgggccccgacccctattttctccccggggcgcccaaggaaatgttttcttggggaaaaaacatcccccccttttgggatttttttaaaatacccccccaaccccggggctttcccaagggggtggggtttgtttttttttttttgggggctcttccccccagttaaaagtttcctgggataaaacccccgttcccccggttccaaaactgggaccgggttttttaatgtccccttttttgggtcccctgtaaacaaaaaacccttcccggggggggccccctaaaatttttttccttcccccctttatttggaagggttaaaaaaaacctgtttttttaaattaaatttttttttgggccta

SEQ ID NO: 558193 - DNA, 1397 bp, Homo sapiens
  misc_feature (356)..(356): n is a, c, g, or t
  misc_feature (521)..(521): n is a, c, g, or t
ttttttttatttttttcttaattgatatgtttattaaaaacttagactaattaatgtgactccgtggtgcttaaatgtgctcattgggtggtgtggtgtgcgtgattttccacaaaacattaattattaagagacctctttcacaaattacacttcgtggcgcagaaggaaaagaggtaacacagaaatgtgactggacaaagacatgtggcctatttacaagaacacagtctccctcttaaataatcttggtctaagaaaaccggatgtttggactatttactttaccaatttataaccatgttattggtccagagggcacaaagtgtacccgaggggtataagagggtaacacncgagaataacagcgagagaaactatcgcgtttcctataatcttcccacaatatagagcttttaatatatatttttgagctcttttgcagaggtccatgttaaccagagagccacaaatcttggtctcttttaacagagccgagaaaatttttatagtgtctcccnattctcgaagagagagtctctctcttttaccagccttttctcgtggggcgcctttattttcacttgtgtgcgcagagagagagcgaagtctcgaaacagcgtgtgttacaccccagggcctctcctctacatatatctgcggtgcccattttaccattatgtgtgtggaagtgtctccggtgggtcttctccatatatgtgtctgtgtcgtccccaaaatttctcttttgtaaacgaaatatacaatgtggggaggggtgaactctccgaacaaggggagggggccccagcgattacagattttggacaggacaccagtgtttcgccgggatatgtggaggacgagggaaggatcttcaagcatgttcccatcaggggggcaatttttctcccgggtttttacaaattctttcccactcccgggggggctcccacgcggcttttcacggaggagcaagaaggggcgccctttacaaatttcccggggagaacaattcacggcgaggacttctgtgaatttattaaaggacaaggtattattccaaagagccggcagcggagacacttcacttggacatttcttcacacaacggggtttggagtgcacggcaccgaaattttccttactcaattcgcgccaggaaaggcagggggcccggggatccttaagtaaaagtatatttcctacttcgcggagaggggggggcccccaaaagagttttatagacgagtagtaataccccgcaggatttttctcttgtggtatcccaagcaggtgtggtgttcctccatataatacggtgacgaggcaccggataatcaatataacggggtcataagaggacactagaggctccggcgacgggtttattacca

SEQ ID NO: 558194 - DNA, 107 bp, Homo sapiens
  misc_feature (7)..(7): n is a, c, g, or t
  misc_feature (78)..(78): n is a, c, g, or t
  misc_feature (81)..(81): n is a, c, g, or t
ggtctgntctgccatgacagaggaggcagctgttgcaatcaaggccatggaaaataactggctcccagggtggcggtngtngcagcagtgatcctctgaacctgcag

SEQ ID NO: 558195 - DNA, 706 bp, Homo sapiens
  misc_feature (4)..(4): n is a, c, g, or t
  misc_feature (6)..(6): n is a, c, g, or t
  misc_feature (8)..(8): n is a, c, g, or t
  misc_feature (23)..(23): n is a, c, g, or t
  misc_feature (38)..(38): n is a, c, g, or t
  misc_feature (41)..(41): n is a, c, g, or t
  misc_feature (59)..(59): n is a, c, g, or t
  misc_feature (67)..(67): n is a, c, g, or t
  misc_feature (78)..(78): n is a, c, g, or t
  misc_feature (80)..(80): n is a, c, g, or t
  misc_feature (102)..(102): n is a, c, g, or t
  misc_feature (163)..(163): n is a, c, g, or t
  misc_feature (175)..(175): n is a, c, g, or t
  misc_feature (177)..(177): n is a, c, g, or t
  misc_feature (194)..(194): n is a, c, g, or t
  misc_feature (213)..(214): n is a, c, g, or t
  misc_feature (219)..(219): n is a, c, g, or t
  misc_feature (221)..(221): n is a, c, g, or t
  misc_feature (224)..(224): n is a, c, g, or t
  misc_feature (247)..(247): n is a, c, g, or t
  misc_feature (254)..(254): n is a, c, g, or t
  misc_feature (263)..(263): n is a, c, g, or t
  misc_feature (269)..(269): n is a, c, g, or t
  misc_feature (281)..(281): n is a, c, g, or t
  misc_feature (290)..(290): n is a, c, g, or t
  misc_feature (298)..(298): n is a, c, g, or t
  misc_feature (302)..(303): n is a, c, g, or t
  misc_feature (306)..(306): n is a, c, g, or t
  misc_feature (308)..(308): n is a, c, g, or t
  misc_feature (319)..(319): n is a, c, g, or t
  misc_feature (353)..(353): n is a, c, g, or t
  misc_feature (363)..(363): n is a, c, g, or t
  misc_feature (380)..(380): n is a, c, g, or t
  misc_feature (383)..(383): n is a, c, g, or t
  misc_feature (412)..(412): n is a, c, g, or t
  misc_feature (483)..(483): n is a, c, g, or t
  misc_feature (515)..(515): n is a, c, g, or t
  misc_feature (539)..(539): n is a, c, g, or t
  misc_feature (584)..(584): n is a, c, g, or t
  misc_feature (586)..(586): n is a, c, g, or t
  misc_feature (591)..(591): n is a, c, g, or t
  misc_feature (607)..(607): n is a, c, g, or t
  misc_feature (621)..(621): n is a, c, g, or t
  misc_feature (692)..(692): n is a, c, g, or t
taanantncacaaaaccccaaanccttaaaaaacacanccngcccacaaagacaaacangaaaaaancaccaaagaanantaaaaaagcaggcagcaacccncaggaggggggagggggggagaaacgaccccaaaaccgcgaaagggacctaaggggggganccggggattccnanttggcacaaaagccccncccagcccccctaaccgcnncaccncncanaaggagtgttttgttgtgggggntgttagnaggcaggantgcccnacaccggggaanaaaaaccancctgagtnaaannccncngtgtttttgantttgtttgtatgtgtgttttaaagcaacaaccancccacagttnccaaggggaaaaaaaancanaagcaacaagtacctgtaccaaagggaanagcctaaaaagaacaacaacaaacaaggcaaccacaaaaaagccacccgacacattaattaattcattccntcaaaagaacttaaactagagaattaagcccnctttatgaagagcgatttcacggntgcttgaaccattcgaatttggatttgtgttcagcactttaaaangntcaantttttgcttctacccngattggtctcaggnctgtcttctcatccatccctttctaaagccaaagcacatttgtagcacataatccaggggaagcagaagtnaatgctatgactgg

SEQ ID NO: 558196 - DNA, 172 bp, Homo sapiens
ggtagagacgggttttctccatgttgatcaggctggtctcgaactcccgacctcaggtgatccgcccgccttggcctcccaaagtgctgggattacaagcatgagccaccgcgcccagcccataaatatatttttacttgtaaatgtatctactcccttctgtcgtcttctc

SEQ ID NO: 558197 - DNA, 715 bp, Homo sapiens
ccgcccttttattatcttttggacaacaaataattttatgtgcaacttcagaagccactcagatacccagtagtggtggaatgctattttctaatctgacatccttggaagaatgtaacaacatgaatggttcattatcttgcaagggtcggtagtgcataggacgaatgtgtactgaatagaaaatagtagcgagttctctataaaaagacttgaagtcggatatgggaagaggccaactggaggtagtatctagggccacaggcgcgtcatattgccctaaccaggtctcaccttcgatagcctccatgatccacgtggcagcttggaacacgaacttatgagtgaccactagttatatgatgttaacgaactttaaagtgttgccgtattacacctcacttcttgttgagctcaatcacataagaaatttctcgagcattaattcttcgaagaaaagcacgcttagacactttcttagaggaacagggcctgcatgcaccagcgagaacgtatgttagaggcccgaggtttccaatgacaatcattcatatcgccatttaagccctcctggatccttctcatctcccgtgaacttcctcttatcaaatccccctctctccccccgtaatcaaaatccggggccaaaaagcaagccatcatctcaccttcccagagcctgctccccgagttcctccccctttgccccggccaa

SEQ ID NO: 558198 - DNA, 169 bp, Homo sapiens
atccgaacccctgtaccgggggtgcttgctgaatgcagttgaagatgtgcccattctcatggtccgtgttgtacatgataggatactccggggtgttcttcttgcgggccttgcaaatattgatggctaggcgggccaccattataaagctgacagcaccaccaataca

SEQ ID NO: 558199 - DNA, 251 bp, Homo sapiens
gtgtgacaggggacaggcccagactctgtctccaaaaaaaaaaaggaaaaaaaaaaggaggaaggaggagggggttgcagttggttccaatgccttttcaacgggggggggccacagaaggagggcggcttttttgaggaagagggaaagccttaacaaaattttgaatttgtgggcaccttgatttgggctttggcagcctcaaaaattatgagaaaaaggtttttgttgtttttaaatcaccaatttta

SEQ ID NO: 558200 - DNA, 123 bp, Homo sapiens
tcaagacagtgcttctaggcactgtgtttggggtcagtgctgctgtgttggggtcaggagctgtgtgtttagggggtcaggctccgtgttggggtcaggctccgtgttggggtcagcctccgt

SEQ ID NO: 558201 - DNA, 354 bp, Homo sapiens
agaggtctcttgccctgtgcaagacaagcctttctgattagcaatcctagagagaacaggtggctcacgcgtgtagtcccagctctttgggaggatgaggcaggtgaattgcgaggtcaggagtttgagaccagcctggccaacatggtgaaaccccgtctctacaaaacatacaaaaaattggcagggcgtggtggcaggcccctgtagtcccaggtacttgggaggctgaggcagaagaattgcttgatcctgccaggcggaggttgcagtgagccacagatggtaccggtgcactccagagtgggcggcagactgtgcttttgtctcaataacgcaaactgtcatccaacc

SEQ ID NO: 558202 - DNA, 313 bp, Homo sapiens
gcccccccccccaaaaaaaaaatttggggcccccgggggggtttttggggtttgggggggaaccaaaaactttccccgggtttttcccctttcccttaggggggggggggggtttttttccccccctcccaaaaaaaacgggggtttgttttttttttcccccctcttttgggggggaaccaaagggggggggggtttgggttccaaaaaaaaaaagggggtccccccctcttcccccgggtttggtttttttttttcccgggggggggttcgtttttcccggtttttttttttaaggggcctttggggggga

SEQ ID NO: 558203 - DNA, 125 bp, Homo sapiens
atttgttggaaatgacgggcgtagaccacttacatcaacagatagtcggcgctttccttgcttggtggcgtagcgtttggcggtgatcaggcgattgaccaggtcgacacccagttgctcgcgga

SEQ ID NO: 558204 - DNA, 204 bp, Homo sapiens
gggcttttgggtgggccttggggtccaggccctgggaccccttgccagggagacccccgaacctttgggccaggacacctcttggtcccctggccctttcctgtttggtttaaacccccaaactgggggggggatggaaaaccgtaaagggcaggaacggggggggaattttaaaaacaaaaaccaattaaagtccctttccga

SEQ ID NO: 558205 - DNA, 549 bp, Homo sapiens
acggaagtgcctctcgacagcagatccaggctcggagctccagacgctgggacaggccgcccgcagaccacccccgccgcgcgcgggacacgactgcccccctgcaggaccctgcccatcagccctggaaaccccttggaagcttggtttttccctgtgaggccgtgattgccctaccctgtgtgatgcccaccaagagacgtctgcgtgggcgttccgcctgtggggtgccacccttgcgagtacttcgacgccctgcgcagttggcgcccggttgtgggcccctcgcgtggtctttgccatgtgtgaacatagggacgcgggccgcgacccgggaagaggggcagcgattccgagaacaaagagaagccgaaatgggccggggccaccaccgccacaaccggggaccccagccgtttacccagcagggggttggggacccccgagagcggaatcaccctccggcagaaaaagagaacgccccaggagaggcgagcgaaaacgcgcacaccagacacgaagagacagcgcacaggaaccggtgggggg

SEQ ID NO: 558206 - DNA, 217 bp, Homo sapiens
atgtgggcccacgcagcactatccttagcttcctccatcatccagaggcaacagggaataggaacaaagtcctagagcagtgccacaccatgatcttaccgcaaatggaaatgtgaggaaaacgatcaatttgcttcctgaaaatgacatttttattttctggtttctatgagactcgaggtggccttgctgaaattgaactcggtatgagctccct

SEQ ID NO: 558207 - DNA, 116 bp, Homo sapiens
aagctacctgttcaagacaagcctgggcaatagagtgagaccccacctccacaacaacaagaacagcaacaataaataaataaatagctgggtgtggtggtgtgtacccatagtcc

SEQ ID NO: 558208 - DNA, 210 bp, Homo sapiens
ttagccgggtgtggtggctggtgcctgtggtccagctacttgggagggtgagctgggagggtcacttggacctgggaggtggagtttgcagtgagccggtattgcaccactgcactcaagcgtgggtgacagagcaataacctgtcaacaacaacaacaacaaaaagtaatatggaccgggtgcagtggctcatgcctgtggtcccagcg

SEQ ID NO: 558209 - DNA, 112 bp, Homo sapiens
cgtgtgcggacggtggcgcgccccaccgaccacgcccgccgggactccaccccctgacaggactgtgactcactcgccgacctgcggacagactcgacggtggacgacacgc

SEQ ID NO: 558210 - DNA, 170 bp, Homo sapiens
ggtaaaaacatggatgcaaatgaaattcccccagagaacaaagtgaagatatttggtatcagtggggtgaagtcccaagtatgaaagccgtgtactcaaaaatgtaacccttctttcattgcgggacaatggaagaaggcagttcagtgggtggtcagtgtgctcaaaga

SEQ ID NO: 558211 - DNA, 210 bp, Homo sapiens
ccattcatagagaggcttcgtacaacttgatttcccgctatttcgtcagggtacaccctaggaccaaacctacgcctaaatccatcacactactcatatacactcggtgtgaatctcactttcttcccacaacactttctcggtctatccggaatgccccgacgtttctcggagtacccctatgcatacacctccttactgattaacgga

SEQ ID NO: 558212 - DNA, 398 bp, Homo sapiens
gtgagtgtaagaagactcatgcttataccatcacctattaatatgagcttgttcataatatgcatgatgtcaggcacataacagatactcaaaatatattggtgggttgaatgactgagtctggcatatatccagcatctgagatagtgcaaaggatcgttagctttcttttcatgaagaagaacactaagcagtctaacgtaggactaggtgttttctagtccagaagaaatgctgttaggcatatgggaattataataagtatcccaatatgaaatttccttcttcagataacaaatgacaatgtcaagatggttccatttcttttcaatcttgcccttctcctttctcaaagaaagccttgcggtttctgaacagtcattcctacatgcatcact

SEQ ID NO: 558213 - DNA, 181 bp, Homo sapiens
tgctgagacctcgagaagactgagagccatggcacgaacgggtcgtgcaggcgtgccaagcctgtccgtggcacagcttgctgccctgatcggctcaacagcgcaggtgccccttcagctaggtgtcagtcatgctgtagggagtccatcctcaggaatggctccagtggtccgaggcgcc

SEQ ID NO: 558214 - DNA, 142 bp, Homo sapiens
tctgggtggttgcctgctgtcccgtcctcctcctcggctgctctccgtactcggcgctggtgctgtcatcctcttgttcgccgtcctcgtctttcctcttcctcttcctcttcctcctcctcctcacatccgtactggcccg

SEQ ID NO: 558215 - DNA, 501 bp, Homo sapiens
  misc_feature (123)..(123): n is a, c, g, or t
ggcgtggtgcggcgcctgtgtcccagctacccagaggctgagcaggagaatgcatgaactcggaggcggagcttgcagtgagccgagactgcgccactgcactccaggctggggacagagtgngctccgtctgagagataaataaatagatagataaatatataaaaaagaaaaacaccaaacatgaaaaaatgctcaaccttcttttgattagagaaatgtaagtgaaaacaactatgatatatctttatctgtcagatttgctgattggcaaagattcaaaacatgtcaagggtatgttgaaatagacatttcccatgcatagtttgaaagaataattgcaatcttgttggagggtaatttaacaacatttatgagcatcaaactttcttctacagtttgacccagcattgccgtatttagaaatttatcctataggtatgctcaaacacacaaagatacttggaaaaaagattaattgcacattgtttatatttctta

SEQ ID NO: 558216 - DNA, 596 bp, Homo sapiens
aaaaaaaactgccccccccggttttataaaaaaaggaggccccctcttttcttcgggggggacaacaattttttatttttgaaaaaaaaaaattctccccccaaaaaaaaaaaaccaatatctctggtttgttataaaaaaaggccccacttccaaaatatttttttttaacaaatctttttgggccccaaaaaaaaaaaagctcttttaatttgtttttttttttttttttcccccccccaaaaaaaaaaaagggggggggcttttttaaaaaagcggggggttcccaaatagttttttttttcccccccccaagaaaagagtttttccccacaaaaaaggacaaaacccccccccaatttttttttaaaaaaaaaaacaaaattatttttccccccccccggggtgttggccccacaacccccccctctttttttttaaaaaacccccttgttttttttgggaccccattttcccccccttttttaaagaaaaaaaaaagccctaaagatgggtttttaatccggggggcaagggccacccctattgtttagtcccggagcccaagcctttaagtcagccctgcaccttcagct

SEQ ID NO: 558217 - DNA, 1539 bp, Homo sapiens
ttttttttttttgggggggtaggctctttattaaacggttatggctggtactacggggtcagagtgcagggtaagcagggtcaaaggcccgggtttcagcccaaaaatgtggtggatttttcttctctcccttattgtgatctcacaggggggtgggtttcttcagaaaaagccccagaaggcagggaccaggtgagcttccaagggttaaaagtgtggaacgtggaagggctctcagttcacatgtggcgtggttctccagcgctctccaggcggtgggcagacaaggagaggaatagtgtcccatgtgaccgtgtggccgagggtctctcccacattctgtgtaacacccgagtgtgaaagttctgtgggtgagagaacaagccgagcgcgcgccaacgcccgtgggcacctcgtggccgagagggaggcgccacactcgagtggcgatagcgccagacaaatgtgcgcagggggctcagagagggctcgtggagactcgcggaaaaatagggaagaccaggggcgcagaagagtgtccctctgtgtgcggagagagagggcgaacttctctgtggggcgctgtgacacagacacagagcgtctccaagtgtgagacgcccccctgtgggcggagtcatcaccagagcgggtggtataggtgcgctgttgtgggaaacccaaaagacgccaacaagaggcgctgttgtgattacaaaagtggggaggcgcgcactgtgcgcacgagaggggccccacacgggggcgccagaggcgagaggggcgataatatcacgcgcgagagaaaagctctggtgtgggtctcccccacttgtggtggtgtagccacagacagagagaggccttttggagtagggcgagagagctgggggggcagcacacacttattgtaggagggagggccacaacggccgcctttctttttactaccacgcacaagagcaaacagactgttttaaggacgggtgttctacaaccccaaaaggatttcacacaaaaattccccaggccctgtttggccttgtgagagaaaacggcgcccttctttttctccaaacggagagagagggcgacaagaaacaaaaatatggtggaactagttgaaggggaggaggaggaccaatataaagggaggacagaagggtttaatccccgccgacggagcaatatttcattcttatgaccaaaggcgggggaatgttggtgtattccccccgcgggtgggggggtctacatccacaaccctcttggggagatatagtggaaaaaccaattcattctcggtagggcggccccccacaaagcagtatgaggacaccgaggggaaaaacagaccacaacaaaatggcgtggaggggggggcgcaccgaacacccaacactatggggagcgcgcgacaccaaaaaacaccacgaggggaggcaaccacaaacacacccgcggagcgagcagaagataacctcgctatcacaaaggagtgggggtgggcgcaccccacagcgcgaaagaacaacaacg

SEQ ID NO: 558218 - DNA, 263 bp, Homo sapiens
gcctgctccgtctcacacaaacaaacaaacacacaaacaaaccatcatcatcagggttaacatacttctgaacatccatctacagacaacaggaaaacagactcccttaatgtactttcataaacaatatggcaactttatgccctggggcatatgaattttgaagcacagggggcaggcatccatttttctcatcaatgtccacctttccctcacaccttgctcccaatcccagacccattttacttgcacacacttgtctg

SEQ ID NO: 558219 - DNA, 185 bp, Homo sapiens
ccttctacgtctcatcactgtcccaattctgttcctctgtcgcttaccctgtatctttgtcttccgcgagatcttgctgaatctggacacgtgcctctctctctcttaaaaccttggcaaaactcacttggtcactacctgctgttcccttggatgctagttcctcagtgatgagacgtagaagg

SEQ ID NO: 558220 - DNA, 637 bp, Homo sapiens
agtggcaagactagattgcggctctgactctgacggacagagcagcgtgtagaggctcgcgtcatgaattttagctccagaacaaccataggaataaatcaggaaacctaagaggacccacagaccctctgaaggaagcagattgctcctacaggacccaagagacacccgaaatactatgctggtatccatggctgagagacccatagacggttcacatcacaggaatctgtgcagacaactcccgtaccagcccagagcctggtagacttgctgggtggctagatcagaagagagataacaatcaccacagctcggctctcaggaagccacatccatagaaaaagggggatggtattacatcaagagaacaccccatgggacaaaatctcaacagccttcagccctagcccttccctctgacagagcctacccaaatgagaaggaaccagaaaactgtgttggttttctgacaaaacaaggctctttaacaaccccgcgaaaatcacactagctcaccagcaatggatccaaaccaagaagaaatccctgatttacctgaaaaagcattcaggagattagttattaagctaaccagggagggaccagagaaagacgaagcccaatataacgaaac

SEQ ID NO: 558221 - DNA, 407 bp, Homo sapiens
actccgacagcctgttcttctgccatcatgtgtcctagctattcccagagtagtacaagcctcagataatcagtaacttcttacatatgacatcacaagctcaagcaacaaacgaaaatataataacttgtactacctcaaaataaaactttttctttattttgagacgcgatcttgctctgtcatccaagctggagtgcagtggcacaatcactgcctcgacctcctgggctcaagcgatcctcccacctcagcctccggagtagctggactgcaggcatgcaccaccatgtctggctaatcttttatttattgtagagatggggtctcactatgttgcccaggttgatcttaaactcctgggctcaagtgatcctcctgccttggtgtcccaaagtgctgggatt

SEQ ID NO: 558222 - DNA, 1441 bp, Homo sapiens
  misc_feature (150)..(150): n is a, c, g, or t
  misc_feature (152)..(152): n is a, c, g, or t
  misc_feature (156)..(157): n is a, c, g, or t
  misc_feature (160)..(160): n is a, c, g, or t
  misc_feature (166)..(169): n is a, c, g, or t
  misc_feature (180)..(180): n is a, c, g, or t
cgcagagagtgcagctgaccatatgctgcgtacagtctacagggccgacagtctttggcctgtcggaagaatgtcggcattggtgccatcgcgacctcgtatggatcctctacactagatatgtcatcatgaaacgagtgaatctgcacncnatanngantaatcnnnntaacctcaaancaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaaggcacacctacaccccttatccccatactagttattatcgaaaccatcagcctactcattcaaccaatagccccgcattccgctacgaccaacctcatacaccatcctatgcaacaaacttcctaccactcaccctagccatctacttactatgactactgtctccactacccatctacacactctccagcattcccccctcaacaccaacacccccacacacaacacacacaacacacacaacacaacaacagcacaaacacccaaacgcggggagaccgcgtccccctacagactatctcaccaccagagggcacaacaaagtaacaaaaagaagccacgagaagatatacagacgacaaaaaaacggagagccaccacacaacccccaacccacaacacaaagagcacacagcaacaccgagcacgaccggacaccataccaccagcgacacttccagcgcacacgagggaccgccacacgcgaaaccaccaccgccagcacccacacacgagaagagacaggaagacacaaaacacacaacgagacgaagagcacaaccataaagtgagacaaccgccacacccacagaagacaccaaacgcaacatagggggaaccagaacccttcccaccaccgtaccaagcgagggacaccagagacaaccaaacagaccgagcgcatcacacacccacacgcaaaccaccgcgcaacaatcaccccaccacccttcaccacaaacgaaacggagtaaaccacgccccgccgcccgccccacgccccaccaaaccactccgaagcccggacacaaacgccgccgcgcgcccaccacagcccccacgcagacgaagagagcaagccaacacaggacgacgaaggcaacccaagcaccaagaaagcaagacgcgcagcacgacgtcggacagtaaaagcaccagaaccggcgacgaggcagaggagcagctgacaggcagcgagcgacaaccgggacagaagcccgcccaccacagaaaccagaaccacacaggcac

SEQ ID NO: 558223 - DNA, 1480 bp, Homo sapiens
gggacgaccccggggatggtgcagcaacgtacgctgctgacactacttgtagacgcactgtcgcttgacagtctaccttgtactctaccggatggtgctcctacacgggacccacaaactaccgtgacctttcggacgacgacggatgtggacacactctcgtacttgcacaccacccctggacacgacctgacttgaccttcttacgacgtgtggacacacacacccaactctgacgacagacaccaaccctacccttggtcctctgactgacacgccgactacgacacttgcttgactactcgcgcgctttgacacccccaaactaccggacacgacttggtggactcacacactaacgaccctgactaacggcacacctctaacatgtggacgttgcgacctgtgggacgacacacgaacgtacagaccacgactctgcgtgacacgaactttgcctgacaaacgacctagtacttaccttactaaaaccactggggtggcacctatgacccctgaccgtggcacaaaccaaaaccactatccttcacgacttcggtggctgtgctgtccatgaccgtcaggcaagacgggcatgcaacacacagttcatttcagtctcacatggccaagcagacatccatggacgtggcagaacaggcaggccattcaccaagccacattgctaccccgccgggcaaagccgaacaaagaaacgcactggtggcatgcacgctatcaaccgcgcgacaacagcacatagggacgcgacgcagcccttgcgcgggatggagcccagggcaccactggggagcaacttcccccattaggatagaacccaagcacaggacccaaaacaacggacgcacggtgcaaccagaggggacactacacgcctggacacctaccacacacaacggagaaaccccagaccaaccgtaattacctgacagacagccccacaacgaatgatagggacacccaacaaagggggactcaacacatggccggcgacagacaacgccagacaacacaggaccaccaaaacagaagaccgagaaacccacaaacccgcacaacaacagggaccagacaaacccaaccagcacacgagccaagcagcaggcagctcgcaccacaaacaacaacaagagccacacgacgcaaccaccaaagtcatcacccgcaacagactaacagacagcagcaccgctgacgccgacacccgaccactagagaccgcagatcaacagcacacgaacccacaataaacgcaacagcagaccaaaccagacgacataaaccaacacacgacacgaccaaggagaaccaagccaacacaaagacaccgcacagccaccaccaacctacgagaccacaaccgacaaccagtaaacgagcaaccgaccaacaagggacgagcgagctagcacctgacgacgaaaacgagaaccacagctaacacaacaaacaaacaacc

SEQ ID NO: 558224 - DNA, 956 bp, Homo sapiens
ttgtatgtgcgtgagggatggaatggggtgcgagcgtgggtgttgagtgtgttgtgtgtgttgtgcgctggtgtggagccgtgcgatgcgtcgtggccgttgttggggctggagttcttttgttgtgggacggtgcgctgtgggagtgtgtgcgctgttcgacgttagggttggccttaggatggtcgatctgtcggtggttaggtcttttctgggctctgcggcctgctggaataggcggtggtgctccgtgtggtcgtgatgtcgccgagggtggactcctgctgtcgatgtgtcggtgtggttggcgctcgggggtagtaatgctcgtctgcgtcatatttgtgagttgctgtctgccgtggtctccgtggtggggcgtggcttgtggctggtgccgctcgtctggtcggtggggcggcggcgcagcgtgctgtgttcgttttgtgtgcggcggagtgtgacaccgcgcgtgagggtgttgtggtcgccgtgggtcttaggctggtgtcgtttgttcggttgtgttgcggttccgtcgtgtagcgtcggtgggctcgggtgtctgtcgccccatgaagacggtgtttcgtcggcttgtctgcgcgtcgtcggtttgactcgctcgtgttgcccgccctgtgtttacggttgtgtgggagctttctttggttgtttatccccgttgtgcgcgggcgctaggttgcaggttgctctgcgtcgagggttcggctacttgtcgtggtgtgcgcccacgattggtgtctggttcgtatgtgtgccgccccacgccgtggggggctgttctgagcccatgtccagtgggtcagcgataagtgcgatcgttgtcaccgctggtgaccaccctcgcgtggtgtgtacgcccgtatcccccattttcacgcctttgccccttccccccgaatattttgcggggttttccctttaaaaaaaaa

SEQ ID NO: 558225 - DNA, 739 bp, Homo sapiens
  misc_feature (150)..(150): n is a, c, g, or t
  misc_feature (152)..(152): n is a, c, g, or t
  misc_feature (156)..(157): n is a, c, g, or t
  misc_feature (160)..(160): n is a, c, g, or t
  misc_feature (166)..(169): n is a, c, g, or t
  misc_feature (180)..(180): n is a, c, g, or t
  misc_feature (633)..(633): n is a, c, g, or t
cgcagagagtgcagctgaccatatgctgcgtacagtctacagggccgacagtctttggcctgtcggaagaatgtcggcattggtgccatcgcgacctcgtatggatcctctacactagatatgtcatcatgaaacgagtgaatctgcacncnatanngantaatcnnnntaacctcaaancaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaaggcacacctacaccccttatccccatactagttattatcgaaaccatcagcctactctgtatgggggatctcgagatcccccatacagagtattatcgaaacatcagctatcatcaacaatagccctggcgtacgcctaacgtaaatactgaggcactactcatgcacctaatgaagcgccaccctagcaatatcaacataacttccctctaattatatcttcncaatctaattctactgactatcctagaaatcgctgtcgccttaatccaagcctacgttttcacacttctagtaagcctctacctgtactctgtatgggggatctcg

SEQ ID NO: 558226 - DNA, 691 bp, Homo sapiens
  misc_feature (150)..(150): n is a, c, g, or t
  misc_feature (152)..(152): n is a, c, g, or t
  misc_feature (156)..(157): n is a, c, g, or t
  misc_feature (160)..(160): n is a, c, g, or t
  misc_feature (166)..(169): n is a, c, g, or t
  misc_feature (180)..(180): n is a, c, g, or t
  misc_feature (513)..(513): n is a, c, g, or t
  misc_feature (535)..(535): n is a, c, g, or t
  misc_feature (547)..(547): n is a, c, g, or t
  misc_feature (575)..(575): n is a, c, g, or t
  misc_feature (588)..(588): n is a, c, g, or t
  misc_feature (603)..(603): n is a, c, g, or t
  misc_feature (607)..(607): n is a, c, g, or t
  misc_feature (609)..(609): n is a, c, g, or t
  misc_feature (624)..(624): n is a, c, g, or t
  misc_feature (631)..(631): n is a, c, g, or t
  misc_feature (649)..(649): n is a, c, g, or t
  misc_feature (678)..(678): n is a, c, g, or t
cgcagagagtgcagctgaccatatgctgcgtacagtctacagggccgacagtctttggcctgtcggaagaatgtcggcattggtgccatcgcgacctcgtatggatcctctacactagatatgtcatcatgaaacgagtgaatctgcacncnatanngantaatcnnnntaacctcaaancaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaaggcacacctacaccccttatccccatactagttattatcgaaaccatcagcctactcattcaaccaatagccctgggccgtacggcttaaccgttaacattaantgcaggccacctactcatgcanctaaattgggangggccaccctaggcaatatcaaccattnaaactttcccctnttacaatttatcatncttnancaatttcttaattcntactggncttatcccttgggaaatnggtggttggcctttaattccaaaggctancggtttttaacaa

SEQ ID NO: 558227 - DNA, 1198 bp, Homo sapiens
  misc_feature (150)..(150): n is a, c, g, or t
  misc_feature (152)..(152): n is a, c, g, or t
  misc_feature (156)..(157): n is a, c, g, or t
  misc_feature (160)..(160): n is a, c, g, or t
  misc_feature (166)..(169): n is a, c, g, or t
  misc_feature (180)..(180): n is a, c, g, or t
  misc_feature (418)..(418): n is a, c, g, or t
  misc_feature (425)..(425): n is a, c, g, or t
  misc_feature (427)..(427): n is a, c, g, or t
  misc_feature (443)..(443): n is a, c, g, or t
  misc_feature (454)..(454): n is a, c, g, or t
  misc_feature (456)..(456): n is a, c, g, or t
  misc_feature (459)..(459): n is a, c, g, or t
  misc_feature (464)..(464): n is a, c, g, or t
  misc_feature (469)..(469): n is a, c, g, or t
  misc_feature (476)..(476): n is a, c, g, or t
  misc_feature (1092)..(1092): n is a, c, g, or t
cgcagagagtgcagctgaccatatgctgcgtacagtctacagggccgacagtctttggcctgtcggaagaatgtcggcattggtgccatcgcgacctcgtatggatcctctacactagatatgtcatcatgaaacgagtgaatctgcacncnatanngantaatcnnnntaacctcaaancaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacagcccaccatanttacccncntactccttacactatncctcatcaccnanctnaaaanattanacacaanctaccacctacctccctcaccaaagcccataaaaataaaaaattataacaaaccctgagaaccaaaatgaacgaaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggcatccccttatgagcgggcgcagtgattataggctttcgctctaagattaaaaatgccctagccacttcttaccacaaggcaactacacccttatcccatactatatatcgaaacatcagctatcatcaacaatagccctggcgtacgcctaacgtaaatactgaggcactactcatgcacctaatgaagcgccaccctagcaatatcaacataacttccctctaattatatcttcncaatctaattctactgactatcctagaaatcgctgtcgccttaatccaagcctacgttttcacacttctagtaagcctctacctgtactctgtatgggggatctcg

SEQ ID NO: 558228 - DNA, 1138 bp, Homo sapiens
  misc_feature (150)..(150): n is a, c, g, or t
  misc_feature (152)..(152): n is a, c, g, or t
  misc_feature (156)..(157): n is a, c, g, or t
  misc_feature (160)..(160): n is a, c, g, or t
  misc_feature (166)..(169): n is a, c, g, or t
  misc_feature (180)..(180): n is a, c, g, or t
  misc_feature (418)..(418): n is a, c, g, or t
  misc_feature (425)..(425): n is a, c, g, or t
  misc_feature (427)..(427): n is a, c, g, or t
  misc_feature (443)..(443): n is a, c, g, or t
  misc_feature (454)..(454): n is a, c, g, or t
  misc_feature (456)..(456): n is a, c, g, or t
  misc_feature (459)..(459): n is a, c, g, or t
  misc_feature (464)..(464): n is a, c, g, or t
  misc_feature (469)..(469): n is a, c, g, or t
  misc_feature (476)..(476): n is a, c, g, or t
cgcagagagtgcagctgaccatatgctgcgtacagtctacagggccgacagtctttggcctgtcggaagaatgtcggcattggtgccatcgcgacctcgtatggatcctctacactagatatgtcatcatgaaacgagtgaatctgcacncnatanngantaatcnnnntaacctcaaancaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacagcccaccatanttacccncntactccttacactatncctcatcaccnanctnaaaanattanacacaanctaccacctacctccctcaccaaagcccataaaaataaaaaattataacaaaccctgagaaccaaaatgaacgaaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggcatccccttatgagcgggcgcagtgattataggctttcgctctaagattaaaaatgccctagccacaattactgtcctcagagaggcacacgtacatcccgtaggagactgaatgtgcaggggattctttagagtcat

SEQ ID NO: 558229 - DNA, 1068 bp, Homo sapiens
  misc_feature (150)..(150): n is a, c, g, or t
  misc_feature (152)..(152): n is a, c, g, or t
  misc_feature (156)..(157): n is a, c, g, or t
  misc_feature (160)..(160): n is a, c, g, or t
  misc_feature (166)..(169): n is a, c, g, or t
  misc_feature (180)..(180): n is a, c, g, or t
  misc_feature (418)..(418): n is a, c, g, or t
  misc_feature (425)..(425): n is a, c, g, or t
  misc_feature (427)..(427): n is a, c, g, or t
  misc_feature (443)..(443): n is a, c, g, or t
  misc_feature (454)..(454): n is a, c, g, or t
  misc_feature (456)..(456): n is a, c, g, or t
  misc_feature (459)..(459): n is a, c, g, or t
  misc_feature (464)..(464): n is a, c, g, or t
  misc_feature (469)..(469): n is a, c, g, or t
  misc_feature (476)..(476): n is a, c, g, or t
cgcagagagtgcagctgaccatatgctgcgtacagtctacagggccgacagtctttggcctgtcggaagaatgtcggcattggtgccatcgcgacctcgtatggatcctctacactagatatgtcatcatgaaacgagtgaatctgcacncnatanngantaatcnnnntaacctcaaancaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacagcccaccatanttacccncntactccttacactatncctcatcaccnanctnaaaanattanacacaanctaccacctacctccctcaccaaagcccataaaaataaaaaattataacaaaccctgagaaccaaaatgaacgaaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaaccgccatttacaactatctgcttgcattggtgaatatatagcagtcgagagttatacttacgtgtatacttgtggtaagtttagtgccataggaaaaaattatcttaaaactttggccatagttcataacattaaca

SEQ ID NO: 558230 - DNA, 262 bp, Homo sapiens
tgactgtataataaggcacaatattagtagacttcatcttctcaatgacagaagaaggggatatcagaggaaaacgtagggaggagtaactaaaatggccaatatattatcaggagtaacatttcatagatgaacccctaaagctcagttagagagacagcatttaaagggccattgtcaggtagtgcaatgtcatactcacctcaccactctacctcagaatatcatatgcttaatccagtcagcgatcagggttcgtgtt

SEQ ID NO: 558231 - DNA, 1107 bp, Homo sapiens
  misc_feature (150)..(150): n is a, c, g, or t
  misc_feature (152)..(152): n is a, c, g, or t
  misc_feature (156)..(157): n is a, c, g, or t
  misc_feature (160)..(160): n is a, c, g, or t
  misc_feature (166)..(169): n is a, c, g, or t
  misc_feature (180)..(180): n is a, c, g, or t
  misc_feature (418)..(418): n is a, c, g, or t
  misc_feature (425)..(425): n is a, c, g, or t
  misc_feature (427)..(427): n is a, c, g, or t
  misc_feature (443)..(443): n is a, c, g, or t
  misc_feature (454)..(454): n is a, c, g, or t
  misc_feature (456)..(456): n is a, c, g, or t
  misc_feature (459)..(459): n is a, c, g, or t
  misc_feature (464)..(464): n is a, c, g, or t
  misc_feature (469)..(469): n is a, c, g, or t
  misc_feature (476)..(476): n is a, c, g, or t
  misc_feature (1001)..(1001): n is a, c, g, or t
cgcagagagtgcagctgaccatatgctgcgtacagtctacagggccgacagtctttggcctgtcggaagaatgtcggcattggtgccatcgcgacctcgtatggatcctctacactagatatgtcatcatgaaacgagtgaatctgcacncnatanngantaatcnnnntaacctcaaancaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacagcccaccatanttacccncntactccttacactatncctcatcaccnanctnaaaanattanacacaanctaccacctacctccctcaccaaagcccataaaaataaaaaattataacaaaccctgagaaccaaaatgaacgaaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcctcggactcctgcctcactcatttacaccaaccacccaactatctataaacctagccatggcatccccttatgagcgggcgcagtgattataggctttcgctctaagattaaaaatgccctagccacttcttaccacaaggcaactacacccttatcccatactatatatcgaaacatcagctatcatcaacaatagccctggcgtacgcctaacgtaaatactgaggcactactcatgcacctaatgaagcgccaccctagcaatatcaacataacttccctctaattatatcttcncaatctaattctactgactatcctagaaatcgctgtcgccttaatccaagcctacgttttcacacttctagtaagcctctacctgtactctgtatgggggatctcg

SEQ ID NO: 558232 - DNA, 555 bp, Homo sapiens
  misc_feature (150)..(150): n is a, c, g, or t
  misc_feature (152)..(152): n is a, c, g, or t
  misc_feature (156)..(157): n is a, c, g, or t
  misc_feature (160)..(160): n is a, c, g, or t
  misc_feature (166)..(169): n is a, c, g, or t
  misc_feature (180)..(180): n is a, c, g, or t
cgcagagagtgcagctgaccatatgctgcgtacagtctacagggccgacagtctttggcctgtcggaagaatgtcggcattggtgccatcgcgacctcgtatggatcctctacactagatatgtcatcatgaaacgagtgaatctgcacncnatanngantaatcnnnntaacctcaaancaaatgataaccatacacaacactaaaggacgaacctgatctcttatactagtatccttaatcatttttattgccacaactaacctccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaaccgccatttacaactatctgcttgcattggtgaatatatagcagtcgagagttatacttacgtgtatacttgtggtaagtttagtgccataggaaaaaattatcttaaaactttggccatagttcataacattaaca

SEQ ID NO: 558233 - DNA, 364 bp, Homo sapiens
cgagactctgcgtggttctgtgcattgatgtatccttgcctagcattcactcctggcccgcatccaagagccccgccttgccggactctggtcatcgcctttctttttgtggcctgaatcgatttcatctattcgcattaacataactgccgtctccactgctgtcttatttctctgcagcttcacagccaatggctcccatatcccctagttccttcatgttcaccaatgtacccagtctcatccatttacaccccaggtctcatgagttctcctgggtgtgcttggcccgaatggagcttagtagactgatggtgcttgccccactgttctggctcaggatacgaggaatgatctctagcgc

SEQ ID NO: 558234 - DNA, 692 bp, Homo sapiens
  misc_feature (390)..(390): n is a, c, g, or t
  misc_feature (395)..(395): n is a, c, g, or t
  misc_feature (457)..(457): n is a, c, g, or t
aaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactcctgactggattttccatcttctgaacatagtggtgcaaggattggttccctcagggcttcaggatgctcttgcccttgagcttngctgngtgcagctgcagtgcagctctcatgagttggaagtgcattccctgcaagtctccagactggnatgactcacccgtagcttcacctaccctgggatcctgggcttgccttgctctgcttgcttcactaggcattgcttttacaggaagcctcttgctcagtcttgtgcctgaagttgtggccaattcaaccctttggtaatcaggtgcagctttcaaacccaacagttaatgcaacttaacttcaagacgagtgaccttatttgcaacaccaaggttaactacaggccctttgggggt

SEQ ID NO: 558235 - DNA, 330 bp, Homo sapiens
gtgtcggcctgcgcgctgaacaggccggcgaacggcgccggttggcgcggcgcagctgggcgtacagcgcctgcgggctcaccggtgcggcgaactgtgcgctccagcgccgcgacaggttcacctggaacacgtcgccggcacgcaggtagtcgatcacccggcgcacgccgtcggtgaagcgctgcggcgcgtcctcgcccaccgtctgcggcggctgccagtcctgcccggcatggggaagcgttgccgaggccagtgtcaccagcacatccagcagcgcctgctgaccggcctcggcaatgacgaagctggcgtcgttgtgatggt

SEQ ID NO: 558236 - DNA, 182 bp, Homo sapiens
ttgttgcacagatatttgtgtacctttgctagaagcaggtgttccagcgccttgggattaggttctcctatggaacaggcctggggcagcctgctcagacctgcattctcccagccctgctcggcccctgcatctctcccagccctgactcggacgctgcatctctcccagccctgcctcgg

SEQ ID NO: 558237 - DNA, 118 bp, Homo sapiens
tacgcatatacaaaatcagctcacaatgggtcagagatccatacaacaagatatatgcattgcaacagcgtactaatggcgccatcacaccagtgatagacaagcgccgctatctata

SEQ ID NO: 558238 - DNA, 455 bp, Homo sapiens
ttagaagaaaggctagcataatcaataacttgcagggctgccctatgggatgtagattagattcatttttttttatttctaaaatagaattggttaagattagaaagaaacaaatatctcaggctaccatgagatggaaaaatctatttactcctaggacttttaaaaaatgtaatagggtggctgggcgcagtggctcacgcctgcaatcccaacactttgggaggccaaggcgggtggatcatgaggtcagaagttcaagactagcctggccaagatggtgaaccccgtctctactaaaatccaaaaaaaaaaaaaatttagctggatgtggcagtgtgcgcctgtaatcccagctacttgggaggctgaggcacaagactcgcttgaactgggaggcagaggttgcagtgaggcacttcactccagcctgggcaacagagtgagactatctc

SEQ ID NO: 558239 - DNA, 204 bp, Homo sapiens
ctatttccacagggacacaatatgcctgtttatgtagtcttaggcccttcagataagattatcttctcactacaggaactccgtaggtttttaaagatgaacttcctaatttttaaacgtttttatatgctatcatagcatgatatatattttattgaaactagggtctcatatctgatcaaactaaatatacttttcaagtta

SEQ ID NO: 558240 - DNA, 254 bp, Homo sapiens
ctgtctccttaattttacacccgggagtcattcttaaccctggcctgggctgggcacggtggctcatgccgtgtaatcccaggaggctaaggcaggagaatcacttgaacccaggaggtggaggttgcagtgacccgagatagcgccactgcactccagcctaggcaacaagcgagactccatcacaaacaaacaaacaaataaacaaaaaacctcctggcctggcacagtggcttatgcctgtaatctcagca

SEQ ID NO: 558241 - DNA, 157 bp, Homo sapiens
ctgctggcaccaggacaccagtggccactcagtctccctgccattccactcacctgccccaggcggggcacagcttcctttctccacggattctccagtgctgacctgccccctcctgtgtctgtatcatgctctgcacgataaggtgatcttctgc

SEQ ID NO: 558242 - DNA, 1626 bp, Homo sapiens
ggtacccatgttgaccctagggaatcccagcgcaatcctattctagagatccatatcaagaataggggtaatcgaccgcgctagtgggatcacgagacatctccgagtgtggtgctaggcgcatatataacaggattcgtcatgttccaaacggaatctacacgtcctcacagtgtactctcgagttctaggaccggtagtagatctcaggtcgggttgtctgagtcgttattgtacagagagttccttgcgccatgggacggaaatgtgaacaaggacgcacacataatcggcctaaactttcacaagagatgctgccgttccgccctgctaaatttgatagtcaatcatccataccattgtaatgctactccaataaccccaaaccacccacccaccgcaagagaagaacgagcggtgtgttacgcacaacagccaaaaccaggcaacagaaacaacgtgccagagaccgcatgttcatcacagaggtcgagccgagtggccgcgcgctagaaacacaggagcgcgacaaaccataagaaacaaagcgtgacgcggcacaatcggggagcccaataaaagtggggggcaatggccaacggagaaacccaccaacgaaatgatagacgggtggagacccacagaaaacaagcaagaggacaacagagcagcaagccgccactgggggcagtcaccacacggcacacacaaggaggagagggaagccaccaacaacagaaacacgaaccgacccagaacgcgaaacacgccctgagcgctgcaactagcccaagttgcgagacaccatacacatgagaaagatggcagacacgagaacaccacgcgaaaaccacaggaacgccatccgggtagccgacacacagatgattacgccacagaccaatccacacgacgagaaaggcaccaacacaggaacaagtacaaccccgtatgcaaacaaaggatgggcaacaccacaaaggacagccaaggacacacaaaacgtggggtgactaacaccgaagcgaggaaccacaaacaccagggacccccgacaacacgggcaccagacaggacgagaaagggcgaccccacggtggaacaacaccacgccaaaaggcacggccatgcacagtaccacgaagagcaaacacggcgaacagagccaaccagaaacatcccaaagaagaaacaccagacacacaagaaactaggggcaaaccacacagggacatgaaccaaatcaataacacaaacaaacaagacaatcaccatagaagaaaactccacaaagaacacataacacaccaataaatataaaacacaaagacacaataacaaaacacatcgctacttacaatcatacaacatcagtatgtacacacaacttctataaacaaactatataaaacccaacacaatacaatataatcatacatagtaaatatcatgatatctcgcaacaatcaaacataataaatgacatataaacatactataatacaaccatacaacgacagtaaccccacaacccatgaaacaaacaacacacaaaaaacaaacagaaaaaaaaaaacaataatcacaatacataaaccaatcaataataacactacaaacactaat

SEQ ID NO: 558243 - DNA, 468 bp, Homo sapiens
  misc_feature (31)..(31): n is a, c, g, or t
  misc_feature (38)..(38): n is a, c, g, or t
  misc_feature (63)..(63): n is a, c, g, or t
  misc_feature (96)..(96): n is a, c, g, or t
  misc_feature (196)..(196): n is a, c, g, or t
  misc_feature (465)..(465): n is a, c, g, or t
  misc_feature (467)..(467): n is a, c, g, or t
gccttttaagttgtgcccgggtaccttaacnaatggtnaaaagcctattggtatagatttttnattccaatgtgaccctataatacatttcctgantccttcctgtattgaatgtccccagtttcccatattaagtgctatgcccctgtataacattaatgaatttaatagtgtacaattttgggcccaggcatgngtgtcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctntnt

SEQ ID NO: 558244 - DNA, 205 bp, Homo sapiens
ttttttccctcctcccttgcactgaaggccttgaaggccttatgaggccccgccaaacaagcaattttccaagctgggttataatcttttggcccccttattaatattcctgggacccctggccaaggagtttaccattgtccatcataattgctgaagaattcccctcccctgcccctggttccttgcccttccctccctcaag

SEQ ID NO: 558245 - DNA, 489 bp, Homo sapiens
gaccttatgaatgctggggacgtctagtaaaagagggaagtcgctaacagttattagaaacgtgagaagagaaaaatgtgctggactgctttagatagtctaattggcacacatgccacaagactaacgatcttgtatgctgaggtggaaatgagcctctaataaaagctacgacatcctctaatacaagatacaaaaacttatacattacaccagtctagctgaaacataattttttgacacgctttgactgaactttagacagaaaagacaaaactgaaatggaggaacgtaatttaagtgtggcagaaagttgggaatcatgcggcctgatatacaaagataaatgcatcactgaggcatattcccctggccttgaggtatgcaggcaaaggagaggtcacaccttcctgggagacaaaggatcaaagttgacacagagctccaagaaaatatttaccagaagaatgtgatgattcatttatcagt

SEQ ID NO: 558246 - DNA, 431 bp, Homo sapiens
  misc_feature (168)..(168): n is a, c, g, or t
agatggattccaagattttcagattggcagttggttgaaagagtttatctaaagacctagaatccatagaagggagtatctgggttgagataaagggttgtggagaacaagtttcttcttatgcagataaaacctccaggtagcaggcttcagagagaatagattatnaatgtttcttagcagacttaaaaaggtgccagaagatcagggaaaagacctggaaagggaaagggaatctctatagaatgtcaattatcctcacaagagatagctttgtagggccatttcaaaatatatcaaaggaatatattttagggtaaaatacttcagtttctttcagggccttctatgtgccatatgatgctgtactaaagtaaggctggaattttttttattgctacaataaaactcttttattgctccaaaaaaaa

SEQ ID NO: 558247 - DNA, 904 bp, Homo sapiens
  misc_feature (451)..(451): n is a, c, g, or t
  misc_feature (531)..(531): n is a, c, g, or t
  misc_feature (534)..(535): n is a, c, g, or t
  misc_feature (564)..(564): n is a, c, g, or t
  misc_feature (570)..(570): n is a, c, g, or t
  misc_feature (585)..(585): n is a, c, g, or t
  misc_feature (613)..(613): n is a, c, g, or t
  misc_feature (636)..(636): n is a, c, g, or t
  misc_feature (640)..(640): n is a, c, g, or t
  misc_feature (711)..(711): n is a, c, g, or t
  misc_feature (725)..(725): n is a, c, g, or t
cgatttgcacctttctgttttcctgcatggtcaggctggtggcctgcagggacctgagctttgctacccaagcagattcctcatagagattcctaatcactagtttcttgtattcataaactcagagatacagatgggcttggtttgacagttggggtgagatgaaacctttgctcttgagccaaagctctggggcctagtcattgccctgtcattgggttgatgactgtcagcatcactgccgcaggccatgcgttgagtaaggtacctggatttctaggccacagccaccatccgttgtatgtgaccttgtcagctctggccaagagtggcgacagggctgtttaaccacaaataggcagcagcatgcaatacctagtgacttgctgcacaggtatagtatcataattacaggaagttcctattttgaaaactggatctggggtatatncatttgccccatcacctctgtctaaaggcccaagtcctagggctgccatggtcacaagcacactgatgctccttaagatngtnnatctggagcccacatagtgtggaacaaanagtcanctagaaagcatcctnggtcatcattgtctccttcccacctggnccagagatgcttaaatccaagtngttnctccagctgtcacctcccccaggagatcaggattccactgacgtcctgggcagccagtgaatttaattttncatgagaaacaacngagttaacctgtggcattaggagacctacttcatgtggaccctttttttccttcagtttaacttttctggagcagtgtgttcatgtggaccctttttttccttcagtttaacttttctggagcagtgtgctgcgtagttcggcctgagtttgtgcagcttgttaagacaactcttgtgt

SEQ ID NO: 558248 - DNA, 126 bp, Homo sapiens
tgctggggcaggtactccggatacttggtatttagctttggttcacaagagcgtggggtgatccagtcaccgtcgtgactatgtaccaccatttcgctccatggctttagctatggcaagaaacac

SEQ ID NO: 558249 - DNA, 903 bp, Homo sapiens
taagcgtacagtcgaagtcgggcggcaaaagaaagtaaccggccctgacgggcactgtgggacagacaggggaacggatccaggtacagggaacacccccatggaagagagggcccccgatgggccatatgacgacagctctggtgcaatggacgggcccttcaatggcgctccgcgaaactgttcccggggcccaaagggctgattcccataacacgggcgttatgcccccacacagagcggtccccgaaattgggagcaagaagtacgcagcaatgaggggaacgacaaagaaggggggcaaaccacacagccacaaacatgcggcgttctctggggggcacaaaaaagcggcccccctccggaacggccccacatctatgatcaatggggtgctccaccaagaagagcacaaaagggcgcccaggcttctcttatcaaggccggacgattaccgaagcgaggcgctggagggcgcggcattacacaaaacacgttctgggggcgcgcgcgtcccccccgcacgcccaattcctaggagaactgccccccttcgagggcgcacacttagccccgccaaacgcgtgggagaggcgcccccaccgcacaacacacgaggatgtctccccaccgaggggtgagtctcccagaccgcgcccgccggaatggatcacgtcacgcccgaagggcagatgcgagaagcagtctactaaaccgcgtggaacgacggagaatggcaacagcacatccaccatgagggagaaagcgacccacacggagacggtccgaagagaaccccgtggggcaccgctataacgtagcccttggggcctccacgacaaccatcccgcgggggctactttccccagaacacaaaagacaattatccgccaaacaatgaca

SEQ ID NO: 558250 - DNA, 149 bp, Homo sapiens
  misc_feature (22)..(22): n is a, c, g, or t
  misc_feature (27)..(27): n is a, c, g, or t
  misc_feature (80)..(80): n is a, c, g, or t
gatgcacaggtgagaaaaattncttgnccgccagtccacggaaggtgggtagggaccagtacctcgaaggtagttacttntggttgctactggttcagcagctctgcagaaaatgtcctcccttgtggctgcctcagctcgtacctttg

SEQ ID NO: 558251 - DNA, 909 bp, Homo sapiens
gcgccgcgctggggagagcgggtgtttgaaggctccgcggaccggcactaggagccgggggcgggtccgtgaccctccggctgctcggagtgaacaggcggccaggaaagaagcgggcctgaacaccatgatccctttggagaagccaggcagctggctggctcctccccatggcgccacctcagtgctcgtggccggtgcatgtgcctggggtcttgatgcgggcctgtgcctggccgcctgcctgcctgccccatgtgccctgcgggcttggtgacagagaatacgcgcctgtggtgcgcaccgaggcccttccagggacgtgctacatgccgtgtgccctgtgggccctggaagcttggggcaggcggcggacacattttgcaggtgggtgatgaaaaatgtatagacaggacaacgattctgcgtgaacagcacatttgcctgcaagaggttcatggagaacaacatgaagagaaagggcaagattgtcgggatggaaataattcacttgagattgcgtgtactttgaactaggcacaaagacaatccttggggtcaattaatttacattgaacgtttatgaggactgcatcaggaaaattgattcttaggttcttggacatatgctgcttgggggttgaaaatctttgaccagtggtgtttgcatgacgagagaaagaagccttttaaagaggacaggagaatgttcaaaggaacttatgcggacagatttttagaaaggtggacactttcatgttagcaccacctcggggacgggacagttcatcctcgcacttttgaacgagcctccagaaattaattcctgtgtgacaaagttgaaatctaccaatggggatggaccgtcacaggattgggtgcatgctgggtgccctttccacgaagttt

SEQ ID NO: 558252 - DNA, 603 bp, Homo sapiens
gatgaactgggggcgctcgccttttctgcctcactcgcagatgccgggagttgcggacagagtcgcctgcctccggaccggagtgcagacctgtgaccctggagacgctcggccgctgggaaccgtccccttgggtcggcggctgtgccgcccgtaggtccccggacccgaggggtatcggctgtccgcggtgtgggtcgaggtcagcatgagccaaggggtccaccgtgcaggcgctgggcagggggtcgcggccgcggtgcagctgctgagcaccctgagcgttctgcggagcgctgtcgaggcgcatgtcactggagttctggatgatagcttgtgtgatattgacagcatcgataacttgaatacctacaaaatcttccacatactgaaactattgcaagatacgagactatgcttcgagattacaaggataatctgaagcgaccttgtcctttctgcgcagaagatggccactgttcaatgactggcatgtggagccctgtacagagagtcaaagtccggctggaatcaaagctgcgcattctaagaagtactcggagctattgacagcacagtattggtccaggggagctttctttt

SEQ ID NO: 558253 - DNA, 395 bp, Homo sapiens
gttgtcgtgcgtcgtgcctgcgtgcccgtgtgggccagctgtccgtgagtgtgccgtgatcgcctgtgtgtcgcgccggtgtgcgtgcgtgtgtacgtgtctgtgtgtccgtctctgtgcgcgtctgtgtgactgtgtataagtgtatgtgtgactgtaagtgtgaatgtatgtgaatagtgtgtgtaaatgtatgtgactgtgtgtgactgtgtgtgtgagatgtggtgtctaagtatgtgtgtgactgtgtatgtgtgaatgtgtgtgaatgtgtgtgaatgtatgtatgagtgtgactgtgtgtgtaaatgtgtgtatgtgtgtgaatgtcagtgtatgtgtgagaatgtgtgtaagagaatgtgtgcgtgtgaatgagtgcgtgtgaatgt

SEQ ID NO: 558254 - DNA, 268 bp, Homo sapiens
  misc_feature (11)..(11): n is a, c, g, or t
  misc_feature (40)..(40): n is a, c, g, or t
  misc_feature (47)..(47): n is a, c, g, or t
  misc_feature (114)..(114): n is a, c, g, or t
  misc_feature (149)..(149): n is a, c, g, or t
  misc_feature (257)..(257): n is a, c, g, or t
ttgcgcgggancggactgagcggtgcatgcgcgcaggcgnctcgacnggggcgggctgctactccggaatctgctaatcccagtcggtgccgcatccccagcccgccgccatgncgcctacaaactggtgctgatccggcacgcgagangcatggaacctggagaaccgcttcaggcgtggtacgacgccgacctgagcccggcgccaacgaggaggcgaacgcggcgggcaggcgctacgagatgctggctatgangtttgacatct

SEQ ID NO: 558255 - DNA, 151 bp, Homo sapiens
cccttacgcgagcttccatcaactcccctcctcttatttttttccagctatgaagctcttgcttaaagtagtatgaagtgggttctggtcaccagatgacaattatataaacagatctcatcaatatgaactggatggaagcgtcgcgcat

SEQ ID NO: 558256 - DNA, 127 bp, Homo sapiens
  misc_feature (24)..(24): n is a, c, g, or t
  misc_feature (51)..(51): n is a, c, g, or t
  misc_feature (80)..(80): n is a, c, g, or t
catggtggacatgggatgagacgncttcagtcttctcttgaccccaggctnctgccgctcatgtaggacaggatgtccancttgacgttgctgaccgtggtccggtggtgccagcgcatgatgggta

SEQ ID NO: 558257 - DNA, 112 bp, Homo sapiens
ggccccctgtggaatagaattcatctagtgtcttattcaagtaataaataggagtacttggaggcatatagtaggctatagctagctctacaccaacagacaatatagacta

SEQ ID NO: 558258 - DNA, 572 bp, Homo sapiens
  misc_feature (115)..(115): n is a, c, g, or t
ctcagggccttgtctctaggaagatttcgtcaattccaaatacagttttgaagatacaaaaaaaaaaaaaaaaaaaaaaaaaaaaaccgtggtgctgcggcgcgcgccctgggancccctagaaaaagcttttcatgaaacccattcgcgtggggagcgcgcgcggggcccccagagaggtcagagggaaaccggtggcccaagacggcgtgtttccctagaggagaaaccgcgggcacagagagaacacagagggcgcggggatattcatccacaccaatataaaaaacagcgcccgcgggggacacaacccgcgagcggcgtttctgagaacccaaacttcccaagagaggggaagttcatcgcgaagagagctcccaacacagggggatctctctatcataaaaccggggggaggcccacaaaggggagagacccctcagacatatcacaaaaattatagcgcgccccgggagtcggggggggaaccgccaaacaacgcatagctgaccaaaacaaataacaaccacacacacacaaaaaagaccaacaaacaacacaacaaagaccaa

SEQ ID NO: 558259 - DNA, 323 bp, Homo sapiens
  misc_feature (4)..(4): n is a, c, g, or t
  misc_feature (23)..(23): n is a, c, g, or t
  misc_feature (61)..(61): n is a, c, g, or t
  misc_feature (70)..(70): n is a, c, g, or t
  misc_feature (73)..(73): n is a, c, g, or t
  misc_feature (222)..(222): n is a, c, g, or t
  misc_feature (315)..(315): n is a, c, g, or t
agtngtttgccttttgcaattgngcctgggaatcccctcaagaaagaacttaaactttggnctgggaagntgnggaaggaaactgaaaaaataccacttccatgggcagacccattatatccaaattcgtagagaacgagaaagctatgattttatcatcttatgcttggaaatcttaatgaacagtatcccgattgaggaaagtctttaaaatttatgggnctgattcttctgccgattcttggtaccatcaaggtttccccgagtttcatctctccgcctctccttgcaacccctttgccatgttaacagcanccaaagca

SEQ ID NO: 558260 - DNA, 326 bp, Homo sapiens
caaagtgtgaacccgtctctactaaaaaatacaaaaattggctgggcatggtggcgtgcgcctgtaatcctagctactcaggaggctgaggcaggagaatcgcttgaacctgggaggtggtggttgcagtgagccaagatcacaccattgcactccagcctgggtgacagagtgagactctgtctcaagaaggaaaaaaaaaaaaaagatgtgtactcattacagattttgggtaagctcatctcagtgttttaaggccatttattatcgagaacccttttttcccgtgccacagaaagcttttaaattttcccccttaggagtta

SEQ ID NO: 558261 - DNA, 493 bp, Homo sapiens
cctcagggaatgcttaataattcaactatttgtcagactttcatagctcaagctctgcaaccagttagagacaagttttcagactgttatatcgttcattatgttgatattttgtgtgctgcagaaacgagagacaaattaattgaccgttacacatttctcagacagaggttgccaacgcgggactgacaatagcatctgataagattcaaacctctcctcctttccattacttgggaatgcaggtagaggaaaggaaaattaaaccacaaaaaatagaaataagaaaagacacattaaaaccattaaatgagtttcaaaagttggtaggagatactaattggattcggagatattaattggatttggccaactctaggcattcctacttatgccatgtcaatttcgttctctttcttaagaggggacttggaattcaacagtgaaagcacgttacctccagaggcagctaaagaaattgaatttctcgtag

SEQ ID NO: 558262 - DNA, 185 bp, Homo sapiens
actccccaaaattatttctaaaaataaataggctgatgtcacttattaaataggttacaaaaaccacttctatatcagtatgcctatatatgtttatacttatataatggttgctgagttcattcagaacagttccatattctagaaaatgttgaaaaaatcaagtaaatttattaattcatttg

SEQ ID NO: 558263 - DNA, 548 bp, Homo sapiens
atctcagagtattgaacttgtgagctaatttggaagaaacattaaccctgatgagacattgctagttgggtcacgagcccatttctcactgactgccccgaagactgccccagctcaggccccaggatgagaaaggggatctgaggctgcagctcaccctgctgatgctggagctccccgaggacgatgtacagggagcccacctgggcgtggaagggctaccaccaactatggtacagacaagaacctggtgctgatacggatccgtgctgagccatctgtttttttctggactgaatcatgtcatagaggcacaacctggaaggcagaagaaatgcaataatttccatccatacgtagaatcaccaccacgctcaacaggtttgcatggccaagaaatctatagaaaagtgctcagcctcagtcctcatcacaggaaatgcaaattgcagcaacaaaccagaaaaaaaatgtttcagtctacactgtagaatatgaaggaattcctttaattttcaatctcctttgctcaattttcttaatggcat

SEQ ID NO: 558264 - DNA, 149 bp, Homo sapiens
agcagagacacacggaggaatggttactggagcatgagcattggggcgccggaaggcccaggcaacgcctggccctgagtgagcacctggttacccactgacaacgttcgtccatcggctccactggcctcctggtgtatgacttacca

SEQ ID NO: 558265 - DNA, 324 bp, Homo sapiens
aaagagaaaggagagccaggagcatttaaaaatcagcatctgggccaggcaagatggctcacacctgtgatcccagccattttgggaggccgaggcgggtggatcatgaggtcaggagatcgagaccatcctggctaacacggtgaaaccccgtctctactgaaaatagaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctc

SEQ ID NO: 558266 - DNA, 302 bp, Homo sapiens
ttaccggtcctgggtagcaggactacaggtgcgcacaccatgcaggctaattttgtagtttagtagagacaggtttccccatgttggccaggctggtctggaactcctgacctcaggtgatcagcccgctcggctcccacagtgttgggattacaggcgtgagccaccaaacccagctgtaaaactgtttctagtagtcttaattgcatgttataatggcaactcttagaaattttaattttgatgtaaaacctggtgagttatgttcaataaggtttgatgtatagtcatgactccacaca

SEQ ID NO: 558267 - DNA, 375 bp, Homo sapiens
gtgtgtacgagataagacattaatcaaaatgtaggcaggatgcagtgactcacgcctgtaatcccagcacttcgggaggcaagggcaggtggatcactggaggtcaggagttcgaaaccagcctggccaacatggtgaaacccagtctctactaaaaatgcaaaaattagctgggtgtggtggcacgcatctgtattccaagctacttgggaggttgagccagagaatggctgggacctgggaggcagagttggcagtgagctgagatcgtgccgctgcattccagccttggtgacagagcaagactgtatctcaaaaatgaaaaaaagaaatatcttaaataacttttcaacgttcaaacttactcgtacacac

SEQ ID NO: 558268 - DNA, 108 bp, Homo sapiens
tctgcagatctgtgtcatcccttcgtgagaggggttggggcggcaggagtttgaggaaatatacttcgctgaaaactgaaagagcagtaagaatgagtcaggtgaaga

SEQ ID NO: 558269 - DNA, 291 bp, Homo sapiens
cctcggaggcgattcacgctggttcacgaatgaagcctgagcactctcgctatcgccacggcgcacatggcttgcgcaaaaactattgaaggttggagcggctgagcggaaacctttcgatagccttttcttattaagaaaaggcggatacttgggccagaagaaagggtattgacatttacataagcgtttcttggggctaaaagaatttgagacgggggttaattttgggtggcgacactaccatggttgggaagcccaaacaaaggatttttgcccccctaaaaggac

SEQ ID NO: 558270 - DNA, 222 bp, Homo sapiens
  misc_feature (34)..(34): n is a, c, g, or t
cgcggtctcccagtctctcgcgctcaccatcttnctcaaagttgatgagattctccaccagtgtgtggtttccctcatggatgaaggtcatgtctatggagagatgggctctgttcacaggtccccagctccctccccttccagccgccaaggaaaggtgcagggttaggaacagtgtgacaggggcctgtccccttccactcggccctctgcctcccactc

SEQ ID NO: 558271 - DNA, 386 bp, Homo sapiens
gagaactgtacccactgactcattcattcatacactcactcatccatctattcactcattgtttgattcatttatccatccatccatccactcacccatctatctacgcatttattcatttacccactcagtcatccgtccatcctcattcatttatccatccatctccattcatttactcatccacccactcattcattctttcatccacccactcatccatccactcattcatttgttcattcatccatctctatccactcatccattcattcattcccattcactcattcatccactgattcattcattcattcatctgggtattcacccatccactcacttatccatccatgcatctgtctgctcactcatccatcctactg

SEQ ID NO: 558272 - DNA, 650 bp, Homo sapiens
gtccagtatcagttacttcctatttttatccttaaaagacccattgcaaatcagctgtaaggcgtttttccagataattactcacagcacttgtgttaaaagtttgcaaattctcttcagccattataactacatatccttctcgtggtgaaggacaacttgtgcctggagtttaaccaattaaaactgattcatctcacttgacctgggcttgcgcgcactgctgcacactgcgcaaatggatcaaccacacactgctcaggctgctgcaaccttggacaacgctctccatgctaattctcccaatatcaattacgcaattgcctaagacaccattataatctatacactatcagaaactgcttgcacaagttttcccgattttaccttaaagcactaaccttaagcgcaacacttggcacaacacgcttggaacggaagcaactctctcccttaaaagcacccattactatgtgggcccgggcaacatcaacggagttgggagcgtgcttcccaagcttttacttcctatctggtgcggcttccttccgggggaacccattacctttacgcactttaagggacccacggtgggcaaccgaatgccaacgacttttataaatttaacgtccccaaacgaaatcatccct

SEQ ID NO: 558273 - DNA, 812 bp, Homo sapiens
  misc_feature (646)..(646): n is a, c, g, or t
  misc_feature (650)..(652): n is a, c, g, or t
  misc_feature (812)..(812): n is a, c, g, or t
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaacaaaaaaaaaaaaaaaaaaaaaaaacgggggggntttnnnggggggggggaaacaagacgagtcacagaaagggcgccaggtggccaagagcggtcccgtggaccccagtttccgggccacacagtcgtgcgaaccagcgcgggacaccccattaagggagcccgaataagtcagaataaccacgttaacccggctaggn

SEQ ID NO: 558274 - DNA, 771 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaacttaaaaaaaaaaaaattgggggttttaggagggggggggaaaaaggggtttggaattgggcttgggtattagggttgttcctggacccagtttttttggcccaggggtagtctggggggttccctaaagggagcgataattgaaaagcagtaactgta

SEQ ID NO: 558275 - DNA, 419 bp, Homo sapiens
  misc_feature (3)..(3): n is a, c, g, or t
tgnaccttgtggatcctgccccgcctcggccctaccttagcccaactttttaaggacaagtcccagcccatcccttatcccttccacagccaaataacaaacatagtgatttgtgggggtgaagagatgttggtcaaggggtatgaaagtacagtcagataaaaggaatgtgtcctagatttgatagaatactagggaaattacagttaacaaaaatttattgtacacttcaaagtagctagaagcaaagaactgtaatgtccccaacacaaagaaaagataaatgtttggggtgataatatctcaattactctgatttgatcattacacattgtatgcaggtatcaaaatatcacatatccccccaaaatatgtacaactgttgtatattaataaaaataaatacaaacaaaaaaaaa

SEQ ID NO: 558276 - DNA, 1644 bp, Homo sapiens
gccaaggccggggcgtctgagtctccccagagcatgaccaaacctcagctggagggagcctctgtcttcagtgtcccgtctggactgactatttcatgaagccgctcgccatcgagagtggcctcggctacaagtcataaccatgacccatggtcttatcctctgcggctatgaacccagccaaggggaagttctccatggcacttatgggtccatggacgagagggtcccttgtggatctccatgggtcgattgtgcgttgcctcgactcataacaggcaccttgactgaacctgtctcacgtaatgacaacaaaattgctatgtccagattggcctgtagatgagtcttttgccttggccaagagtagaaattgtgatcagtactgcgttgacgaaggtgcgggatgtagaggctcatgaggccactgtccaggcccatcgtgtgtctgactcatcggagtacactccttgatgcgatggactgatgcagtgttagatgcccagctctggtgatcttatcgtacctacacgcaatgggttgaatgtgaaacgtgggaacatcgggggcaagatgattcagagatatgggggggtttacaaaaaacacccgcaacactacatgctaagagttagcgcacgcgagggaaggcctgctctttatcccccttctagggtatgctaaattcatgtgtgtctcctcgaagattctccgcggagattgaccccggatggatccgcgtaaaagtataattttcacacttcccaccgatttggaatcgccatacgacccaaaaatagcaataatcttggagaggggaccacttctgttggtgccattagtaataggactcttgtgagttttggccccaagtataggggaggcaaaggtacccgcaccaccaaaatagttccatttcaagataccgacatataggcaagacagaagttaggggggcgcatcctttctggaccattagagtaccatcccccataagggtacccccatgcaagtgcccctattctgcattgtgtgcagcaaggcaggcacccaagctgtagattgaggtcccccttgggagcggaaacgacacgaaatgggggtaattgggtaagcatcccgcgagggaggagatcgacttatacaccagtgtcaaaccctgtgaacccaaatgggtagtgtatcaccgcgcgcaagtggcaaagagggtcaactttcgacaaattaaaggcccccagagttgggtggcacacaccccgaaaaaataatgttacacatgtgtgtgcacaacaagttgtttcagcgcgtaacgagtatagaatttcggggcccattcggcatcggcgaccagcgcatcccccacagaggctcggtatagagcggaccccggagccaacaacaacaacatagggaaaacattaaaaagaggttaccgaagtcagagcgaaatagagcaccaagacgccaaatcaaagcacaacgcgtatgtgaccacatgacccgaagaaaagagagaacaacaaaggaacaacacagaggaacagacatgacgagagcagcggaaaccaagacggaacacgacaagagaaaacaaacaaagatcacgttagacgagacatcgtcatactagttaatagccagaaa

SEQ ID NO: 558277 - DNA, 737 bp, Homo sapiens
  misc_feature (667)..(667): n is a, c, g, or t
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaagagagcacaaagggagagaagaagcaaagaaaccgaggggggccgngtaccaatcgcctataggagcgaattcattcctggccggcgttacacgtcggatgggccggggtaccgtt

SEQ ID NO: 558278 - DNA, 658 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaaaaaagtcgtatcgatgtcgagcgatcatgatgatgatgtcgacc

SEQ ID NO: 558279 - DNA, 1102 bp, Homo sapiens
  misc_feature (18)..(18): n is a, c, g, or t
  misc_feature (20)..(20): n is a, c, g, or t
  misc_feature (23)..(23): n is a, c, g, or t
  misc_feature (25)..(25): n is a, c, g, or t
  misc_feature (27)..(27): n is a, c, g, or t
  misc_feature (85)..(85): n is a, c, g, or t
  misc_feature (163)..(163): n is a, c, g, or t
  misc_feature (165)..(165): n is a, c, g, or t
  misc_feature (197)..(197): n is a, c, g, or t
  misc_feature (199)..(199): n is a, c, g, or t
ttatttctttttttcttntntantntntccaccataaatattattttcatactcatatctcgctttacactacagtacgtccgtncggacaatcactcgccattcgcactctactgcctattattgttaatgttatcatcttctttatactatattaaattananactgactactaatttattaatattcaaatgcntntcgcacccggaccgccggcggcgcaccgagtgaaggatagcgggtaagagcgggaggcagaggggaggaggagaggtcgaacaagccacccacgagcagaaccctacgcacactcccaacgcgccacgaaacaaagacacaacgagctgcgtggcttgtcctcctccccgttgtcacgccgacacgatccgccacgaagcctcgagaggagccgacatatagaggtcaagatcgtgtctgtctgatggggtgaggttgaagggagaggagaagtgggtttaatatttattaacaggctgagattgttgctttgttcctactacgcgctacgacatactatgcttactttatattgatttgtaagttgagagtcgttactagagtcgggagacacataacaacatgtagtcgctcgctcgggtcggcggtatatttatacgctgaattagagacgatcagacaaaggaagtgtataagtcctgacacgcttccggtgccgggcgtcgtactactccggctcaccgttggctacacgcgtttgctcgtgttctagcgtgctgtaatatatgtttagtgttggtatggacgatggatagtgtcaggaatgcagatacgcgaacggtagaggagcggtgagtcttagatgagcctatgattacgagcgatgccggcgtcttaattcgtataatatctgtgctttgagcgaagtcaagagtatgtctgtgttgtcagtcgtaccctgcgcgtgtaatagtccagtctcgggtgctctcgtcgcggtacctatgagtaacgagcttgtaagatcgacgatagtggagggataggaggtgaattgtagacctgtagtgtgaggctggcgtagatctaggcactctatgtttatatttattgttttcagcg

SEQ ID NO: 558280 - DNA, 775 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaattcagaggcacggaatgctggtggagaacctgtatcgaggaccgggctgatgattgactgtgtcaggaatgtcatcgcaaagtcccactttggctcacccagtattctgtggcacctgttcttgagcaggtgatgagccagatcggggacacgcaga

SEQ ID NO: 558281 - DNA, 744 bp, Homo sapiens
  misc_feature (249)..(249): n is a, c, g, or t
  misc_feature (258)..(258): n is a, c, g, or t
  misc_feature (285)..(286): n is a, c, g, or t
  misc_feature (307)..(307): n is a, c, g, or t
  misc_feature (314)..(314): n is a, c, g, or t
  misc_feature (316)..(316): n is a, c, g, or t
  misc_feature (345)..(345): n is a, c, g, or t
  misc_feature (378)..(378): n is a, c, g, or t
  misc_feature (412)..(412): n is a, c, g, or t
  misc_feature (415)..(415): n is a, c, g, or t
  misc_feature (428)..(428): n is a, c, g, or t
  misc_feature (463)..(463): n is a, c, g, or t
  misc_feature (470)..(471): n is a, c, g, or t
  misc_feature (486)..(486): n is a, c, g, or t
  misc_feature (489)..(489): n is a, c, g, or t
  misc_feature (491)..(491): n is a, c, g, or t
  misc_feature (512)..(512): n is a, c, g, or t
  misc_feature (518)..(518): n is a, c, g, or t
ggttgagtgcgagcatggccggcaatcgccgagtcagagggccaggaggggcgcggccattcgccgcccgtgccttgttcctgtggctggttttctccgcgggcgcctcgggaggaacctgggagataatgggcagcacactgggggagccctggctgggtgcggctcgctctttgcctgacgggcttagtgctctcgctctacgcgctgcacgtgaaggcggcgcgcgcccgggaccgggattaccgngcgctctgngacgtgggcaccgccatcagctgttcnncgcgtcttctcctccaggtgngggcagngngtttctgggctggtggagcatgtgctggngacaggacagcatcctcaatcaatccaacagcntattcggttgcatcttctacacactacagctatngtnaggttgcctgcgngacactgctgggcctctgtcctgatgctgctgagntccctgnntgtctctcgctggtnctngnctacctggcctggatcctgtncttcgngctctatgatttcttgcatttgttttgtatcaccacctatgctatcaacgtgagcctgatgtggctcagtttcctggaatggtccaagaaccccagggcaatggctaatgatgtgcactgatgccctcaacccaatgccaggctgacctcatcttgcttttgcttttggcattgtgatgccttgcctaagggggcatatctgggtcctagaaggcctagatgtggg

SEQ ID NO: 558282 - DNA, 252 bp, Homo sapiens
tcgaatcgagctcggcccctattttgattgggaaactggcgcaatcaatatagtaccgcaagggaaagatgaaaaattataaccaatgcagtatatagcaaggactaacccctataccttcgtgcataatgaattaactagaatataactttcgcagggagtagccaaagtctaagacccccgataatccatgacgaggctactctatagaacagtctaaacagagcacacccagtctatgtagtcaaaact

SEQ ID NO: 558283 - DNA, 707 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaagaggagtaaaaaaaaattttgggggggtttggggccttaaaaaagtttttaaaacatttggtttggggggggggccccaaggttaaggtacgtgg

SEQ ID NO: 558284 - DNA, 214 bp, Homo sapiens
  misc_feature (5)..(5): n is a, c, g, or t
  misc_feature (41)..(41): n is a, c, g, or t
cggancaaggcaaggagcaggctggctgagctgagaggtgntcctcgtggcctgtatgacggacccgggtgtgaagtgactgtgaggcgcaagacagtcactccagcctcctcggccaagacgtctcctgccaagcagcaggccccacctgtccggaacctgcaccagtctggattcagtttggctggagctcagattgatgacaacattcccc

SEQ ID NO: 558285 - DNA, 691 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttactggattaaaaagtaagagacagctgaaacccctcgtggagccaattcttgggggtcccctaattggggggaac

SEQ ID NO: 558286 - DNA, 337 bp, Homo sapiens
caactttggccccagtgggctggatggtgggatgcaatgaaccatccaacttggtgactaaggctctttctaaccctggagtgtggacaaagggaaagtctgtcatcagcagacaaagggtaagttgtctgtgaatcccaatgacacgtgccccataggctacctgtttaaggagctagaaggttattccactctaagaagctcacctttgcctggtggtccaagggacttgctggacattttccagagaggaggaaggaactgcagacaggtgtggttttccagctcacctggccccagactgttgagtattccttcccctcccatttaggcttca

SEQ ID NO: 558287 - DNA, 679 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttagcatgatgggccaaaggaataatgaatgtgccatacagaatacaagtgccggatggctgtcg

SEQ ID NO: 558288 - DNA, 571 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgaccaagaaagccgaggctggggctgggtcagcaaccgaattccagtttagaggcggatttggtcgtggacgtggtcagccacctcagtaaaattggagaggattcttttgcattgaataaacttacagccaaaaaa

SEQ ID NO: 558289 - DNA, 219 bp, Homo sapiens
acacttagctcggtacccatcctgaagttctggaattgagtcccacatcgggctccctgcatggagactgcttctccttctgcctgtgtctctgtctctgtctctctctctctctctctgtgtgtgtctttcatgaataaataaataaaatctttaaaaaataaaaataaaaaataaaacatacagaaacttgtctatgtaaaatatataattttttct

SEQ ID NO: 558290 - DNA, 154 bp, Homo sapiens
ggaatcagccttctccatgatcctgtcgatctggcgattctgtgtatcgatctcattgaccatatccagggacatgtgacggaggtacccgatgatgccgctcaacctgctctagagtaaacatccatttaatttactcgggcatcatttgtaa

SEQ ID NO: 558291 - DNA, 165 bp, Homo sapiens
ggcaatagagcttttgaaaataaatgtgaagctgggcttaggagctcatgcctgcaatcccagagactagggaggctgagaagggaggatcgcttgaggtcaggagttagagaccagcctgggcaacacagcaagaccccatctcaaacacacacacacacacac

SEQ ID NO: 558292 - DNA, 523 bp, Homo sapiens
ggtggcgctgagctgtggcttgctcgctgggtctgtggatgtcgggttcgaccactgtggccgatgggaatggtctgtcacaatctgctcctttttttggtccgccacacgtaactgagatgctctttaaataaagcggttggtgttcaagataaaaacaaaaaaaaaaaaaacaaaaaaaaaaaaattgtggtggggggtatggggccctgggagaaggtttttggaaaaaaggcgggtggggaggcggagggcccaccagatggcgtaagagggaaaagtgtgccaaacagggtgttccaaaaggaaacaccggggaccacggaacagagggcgggaggaatcctccacacaaattaaaaaaaggcgcgggggggaccacacgggcggtgtcgagaaaacatccccaagaggcgggcccagaaaggcccataacgggaggaactttacaaacagggaggccccaagggagagcgcgagaatctacagttaacccccggcggggggagaacgccaacaacgg

SEQ ID NO: 558293 - DNA, 432 bp, Homo sapiens
gagctcggtaccccgcctaggtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaa

SEQ ID NO: 558294 - DNA, 1120 bp, Homo sapiens
agcggggcgtttcctccttcccgcctgaggcgagtctgggcctcatgctaccatgctctccggcgacggcgcaccttcagggcacgctccgggctgctgcgagtgaccgagggcatgcgctgctgatagggcgagagcaatcgacctgtgtcctccatcgaacaatcacataccatccttccctccctcagacactcctccaacgctttcgatactcccttcgtcttccatcgcattcctctgtgcaagactcgagaccagtcatgctgatgcgtgagaagaatggtgagagcacacaaggagcagtcaggtatggacaaggatagtcactgtggtcgtaccattggttgcccgggcagctcccaatacgctagggtagcctaaggcaagggccaccttaggcgacggccaagctacgacagggcatcctacttttaggacacacgaagacaaggggggacacgctgagagaacaccgagacgagccacgatggtacttactccttaccccatagagacgtgttgcttggcattaatcccttaaacacgagaacattcctttgctccagttgactccgtgaagacagcgtttagcgcttcgtagtgaagagataccgagttcctccataaggtttgcgacaaaactcatagggccattgaccaccgttcgatgcgcgattgtgtccccttaatcatcgcaaactaggcctctctaaacgagctgcgtcctgttcaggccgaccatgggccttttgtcgaatcagagtaggctaggtttgcttcggtggcaacagcccgatgcaaatgttcccatatttcctaagtgggaaaaaccttgcggagcaattgacccggccattgtggggctagggtaatggccttgcgttttcacgtactctcccataggacttttcactctacctcggttcgtgtacggtttagcaacaaccttgggccaaaaggtttggcgaaaccaccgcgaacaattcctctcgtcgctttggtaaccgagggtctttatttcgccggttcctctacagtggagtcctttggcacagattcaaatccaacaggtgcaaagaaccaattatgtgcgccctaaccgactggcgaacacttg

SEQ ID NO: 558295 - DNA, 913 bp, Homo sapiens
  misc_feature (913)..(913): n is a, c, g, or t
gctctaccggcggtatttgatggcgcttgatgtctcacagaatagttctccgctgcccaggatgtgggtccctcaagcttcgctgtctcggaatgcgcggtcgcaggtcatcgtgtggaaggtgaagagcttccctaacggatgacccgctcacaaggccggttctcacctctaggcgaagggccttgccgttggcgaatagcagaggctggtcagagaccttccggtcgatcggtgcgtggccaaagtctgagccaggcctggggaatccacaccggtgatacaagtaatgatgtggtggaggctgtgaccattgtacgaaggaaccggcccatccccatggtttcgcgctaggtgtgtgcccatttggaggcgctataccgtttgagaaaacgcgcgctcagtaggtgctcgtcccgcgacactctcggaagaagcgttgtcctttctgtccatgaggggcacattcatggtcgactagcacgtttcgctgggaatgacggctattcctatttacaggaaatttttgcgcggtaaacacttcttatagggaagggtaacacgggcctgtgtgtaggcccataaggtcatccttgccatttgcaaacactgtgccacgcgattggaggcgattgcgccataggaacagccatgcttgggccgcaactggcctgttcgagggccatggcattgaaatgcaatcgttccagtgcacaagggtctcttccctgatgttccaatttagcgcccaccaatgcgcaacatagtgcaggccttcgctttctcttcttagactgccctaagaaggagcatgtgggtccctcccgtgggtttcgcgaggatcccattgtgttggatggccgagttggggccctggttggcccggagccactctggctactgggggccccgn

SEQ ID NO: 558296 - DNA, 1868 bp, Homo sapiens
  misc_feature (402)..(402): n is a, c, g, or t
ctcattgtctcccgtcctagatcgggtgtgcgagtaccgaaaatagggcgtgtccgctgtctgccatcattcccaaggtgtataatccgagtaactacaccatcaccattcatcaatgcgcctcctatggagctgggtcttcacacgcatatgccgtgaacgcctcgtagacaactcataacgaagcattcgagacacactttagccatgcagagcgaacgattgtggacattcacacgcattgttgcgtcattcgacacccaggcttcaactacatcgactgtctgggtgcctctacatagcgtaattaaagcgcacactgttgcccatatccgcaaatccgctgctgcgtgcatgtcccaagaacataacgtaccatgccgagtattgatagcatttcanccaatataaggctattatagcttttgcgtttacctaattgtaccctggtgtaactcagctatttcaaaaacattcttaccatgaaccagctacaaactgctggcactgacgtaaactaaccttcgcctgcactcgggttcaggatttcccacatttaccacggcttactacaccatcttggacaaaccaatatccacacatcaattcacacccaactttaaacattcaacaactcaacgtgatcgagacttacaataatataaaacacccattcctacccaaaccaacgatatacactacatcaacaacagcggtgcgccgcgggcaacaccgagaccactatcacgatggaacaattactaaccatcccccttgagacgcggagtacgcacctgacacacaccaattgtgagcaccaacaacaaccacataccttggaaaattattacatacgattcacccaacacgaagcgggacgacccaccgcaccgcaaagacagagagagacaggacataacaacaacaacaataacacgaaacgcccagtcggaccccgaagacccgagccgagcacatatacagacaaacgactacgcgccagtgccacagggctgtgacgaccagaccaccacacctccgcgaccaatacaccgccacggccaaccgttctcactcgagcgatgagacgggcaccgcgcacacacactaccacaacccaagataggagcgcgggagcgagagcaacgcacaccacacagaaggcgagtcgcaccatgccctacacaccccacaacgtgaacgagcaagtccaatccaaacccaacgccagaatgggcacgcacgttagatcgcacaaaccacacccaccctcttgcgacagccagcgtagtcacgtcaggcctagcagacaaactatccatgacccgcacactaatgaccagcgagcgcgccgcgcaagaaaacgcacgacgctacccaacgaccatgacacgatgatccatgagcagcacacatctatcccgccaccagccacaagcaagacgaccacacaagcccgaacccaccccaacagaccaggatggaaagacaaacacacgcacagacgcgccgccaccgaaagcaatcaacaccatgagaggaagacgtgcgtcatccaccggacaagcacagacccgcggcaaatcgagcagcactcactgcacgaaccaaacaccagcacggcgccctcctccacccgaagagcggacggcgaccagagcaagccagccacggacagagacgcaggaccgaagagccacgtagcaggcagcgagaccaagccgaccagagcgaagaacacagcagcaagctgctcagaaaatcagccacaacaacgctacctacttcaccactgcagcgacacacaccacaagtacgaataacacacacggcagagcaggacgcgaagccagcgtcacacactcgac

SEQ ID NO: 558297 - DNA, 705 bp, Homo sapiens
  misc_feature (75)..(75): n is a, c, g, or t
  misc_feature (200)..(200): n is a, c, g, or t
  misc_feature (268)..(268): n is a, c, g, or t
ttgggcttactttggctaaaggggatctcatttaccttcaggtaaagtgggttaacaaggaagccacccggcccnaacaggtctaaaatggttgaaccagcaaaaaaaccgggaaaatagcccaagagaaggcctccagttaataaataaggattcaaatctgtcctccccgtgaccaagtgccttccacacatggcatntttcaaggggtgagtcaaagggagtagctgctcaccttggattggtatggcaagaaaaggtacttagnctgcagccttagcaaaggtgagtatgcatgatcccacgaagtcaatgcaaaagccatttgaaaatccctgcttttcaaataggtgtaagggtttctgtccatgacaaggctgttctacttcagtcttttaaccatgtatccacacagtcccagagatggtcactagtgtcttcctcacctttaacttcctccttggaaataattttcacatgctacgttcttgacctaccaggacaaattctatgaattcttcacgtatgtgtcctgggaaggaatagccaaaagctttgacaagaataactaagtctgggctgggtgtgatggctcgtgcctgtgatcccaacactttgggaggccaaggcgggtggatcacgaggtcgggagttcgagaccatcctggccaggatggtgaaaccccatctctactaaaaaaaaaa

SEQ ID NO: 558298 - DNA, 454 bp, Homo sapiens
ggatctcggctcactgcaacctccgcctccggtgttcaagtgattctcctgcctcagtctcccaaagtgctgagattacaggcgtgcaccaccacgctcggctaattttgtgtttttagtagagacggggtttcaccatgttggtcaggctggtctcgaactcctgacctcaggtgatccaccctcctctgcctcccagagtgctgggatgacaggtgtgagccacctcacctggccctattttatttttattttttgcaaggaaggaatgaagggatttattgaaaatggaagtaccctccacagcgcgggaggagaccgagaagaggagctcaaagactaaagggacgggcttttaaagacatttaattaaaaggaattaagtttcccttatgacatttagaaaaaagtcaagtccaaatggtacaaaacggtcagcttgctttgtgccttg

SEQ ID NO: 558299 - DNA, 806 bp, Homo sapiens
tgcagtggcacagcgaggtcggcagcggcacagcgaggtcggcagctgtgcagcgaggtcgcgagcggcagagtgaggtcggcagcggcagggaggtcggcagcgaggcgcgctggtgctctttccggcgggacctcttgaattcatggcggacgacaggccacggagtgtgcgaacctcgggtgctcgggggccgaacagcgggctgccttcaaacgtagggaacgacatgactaaaggtggcattcggagaccagcgaggaggtggatgtgacccccagttcgaccaccatgtggcctgctgttgaggacccttgctggtggcatctaccgccttacggttttgaacacaccaatcagaaatccagacagggagcaatcaagcagatcatcaggggagaagatgtcactcgccacagtctcaatgtcgggcaacaggaaaaacagaccaccttcagtatctcaggccctccaggtgtcggcatatccagggttcgtgaaacctcaggcttggatcttggtccccacaaggacgatgttggggctggtgcagatcccaagcaagggtgctggcttgctcctccgtgtggactaacatttgaattgtccagttgcgcatgccttgcattttgggatgtgcacccaattgtggggcgagggactatcaggaaagcttgcatatccgggacagacaatgtttgtcgcgggcacctccaggggcgatgatatggatattgattccgtcgcaaaaaggagtaagggacacgtgcttatcaaaatgttcgttttgtggataaagcgctgat

SEQ ID NO: 558300 - DNA, 1617 bp, Homo sapiens
  misc_feature (446)..(446): n is a, c, g, or t
tcaatcatctagcgagcacacgtacacactgcgttccgtaatactatcgacaaataaactcgcataatatccgtagagtacctaactctattcatccctctcaaatcgactacatctaccacactacttcaatatcctgtgagcacacacatagaacgaacacaatgaacaaaaatcacatatacaccacattagacacccacaagctgcgcaagcgtcagccccaccatgcccgccgacactctcgcacacaggacccgccatccagtttatcggccatcacctaccccgctacacgctactaccgagatacgagccgagcaggcacccgcctccctcgaggccaagccccacccaccctgccaccacccctggcgtgccaccccacaccacgcgtaaggcgccgcctagcaaaacgacgaccaccacatgccaacatgagccgnacaccctctccccaccagctgaaaggcgggcgtccctaatgaccaaccacttaacacacccccccaaacaccctactctccacaccccccgaacccccaagccccgcagacagcccgcggccctgcccctcgcccgtcaactcacctgctaacctgcgcgcagacaccaccacactagccgcatacactggcacggaagaggcttcgcaagcaccgcagcaaaggcgccagaagagaaaccacccaccccacagcgcgcacactcccccaccccctccgcccctacccaacactaccacgccgcgcccccctcctccccacacccaccccccaacccccccctccccccccaccacatcctaaccaaccccaaaccacttccacttactaatggtcaacgcactaccttatcgctccgtgttattcgacctgtctatctaactttttcttatccccctcccctaaccctaccactcaccctcactcccccctcccccccacttccccctccacccccccctccccccacccacctccccccttacaaccacaaacagcacaccccccccccaacacacaaccaaccccccacaacccaccccctctcacccacactcacacccacccatacccacccactccaccaacacacacccacactcacccgacccatcacctgtcatccaacacacaaactcacaactctcactctcaactcaaccaccgacgctacccgaccctcactcctcaatacacaacactataacacacaacataccaacaccacactaactaatcatcacccctaacacacctactactcccaccccacactccacaactcactacattcacactatgctattccacatccatccttcgactccctcttctgtcacttctatccttacttacactagacattcttacatctactctatatcgattactcctcacttcacaacaccacactcacaacttactgcctcacatacacgtaactacctaccatccacacacaccccgtctcatccccacacaatccactccacacacaactacagacatcgactacacagacaactaaactaccaatctcttgagacatactacactcacaacatacaaataaaactaaaaaaacaactgtcacttcactttttatctacag

SEQ ID NO: 558301 - DNA, 452 bp, Homo sapiens
  misc_feature (28)..(28): n is a, c, g, or t
  misc_feature (50)..(50): n is a, c, g, or t
  misc_feature (214)..(214): n is a, c, g, or t
  misc_feature (404)..(404): n is a, c, g, or t
agccagaattcatggcccctctccatgnattggaactttggtacaggttnagtatcccctaatccctgaaatctgaaaacacttgtggttcccaagcattttggataaggcaaattcaactttcagtctcttttctgggggaaaaaaataataaacctagcctagccaggcgtggtggctcatgcttgtaatcccagcacttcaggaggctganatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttngccattgcactccagcctgggcgacaagagcaaaactaaacaaaaaac

SEQ ID NO: 558302 - DNA, 398 bp, Homo sapiens
cgggcaagaggacagcgccgggagcgtagtgatctgctcacgttactggccaggcgtgcaggacatccgtctaagtttccccctgcaaaaactacacttgctagatactgacaggaagtgcagcacatacgacaacagtcaggcaacagcatctgtagcttagatttagtgtccaactcctagcgctttagcttcgggcacttgaggtaaacccacatatcatgcctcagttctccctttctctgggccacattcatttggccttgctagaggcttccacagaaggaagctccatgttgatcttatcgtatgaaaccagcggtgtttcactaaaaacccatgccctggccgggcgcagcggcctcatgcctgtaatcccagcactgcgcctcgtgccg

SEQ ID NO: 558303 - DNA, 145 bp, Homo sapiens
gtaggcatgaggcgggatcagggacggaggaggcagaagtcaggattgcgggcgtggactgagatgaacgggcattaaagagctggactcaggccaggcatggtggctcacaccttttatcccagcactggtgaggctggacggg

SEQ ID NO: 558304 - DNA, 150 bp, Homo sapiens
tccaccctggaatctctctagaagctaatcccctggatggattttgcttccatggaataacccacagcgatatctgaacgtctctgtggcattctcatctttctattcgtttggagttccgtgttcctgtacaagactggtggatcagga

SEQ ID NO: 558305 - DNA, 501 bp, Homo sapiens
  misc_feature (476)..(476): n is a, c, g, or t
  misc_feature (482)..(482): n is a, c, g, or t
tctcagagcaccaaataaggaaagtgtaattggatgtcattgctgtcagtcagctgggctataaaagagagagtggggttgcctcatcccctgggtatccacagtcagctgtgtccctagagcttcttttctttcattgctgcccagctgggtatattgcaagtatggattataagaggggaagggacttcactgttttaacgtttgaaacaaaaaggaaaaaactcagaagtagtaagctaaaaacaacttgtgcaaacgttctgggattattacttaattttaagaatttttgctaaaaacaataggaacatcgttgaaaaaagaacccctttgagtgatgactgtttcatagtgttctacatctcctactccctgccttataaaaataaagctaattaattgaagttctggcaaagagaagggagtattccttggcctttgaccaagaattcccctcaccaccatgaacattnccccgncgagccctatgcagtctca

SEQ ID NO: 558306 - DNA, 486 bp, Homo sapiens
aggaccttgggagccttaacctacactttaatttctttttcagatggttgctgtggcatatggagatgctttatagtggtgaaagtgggtatccttttatgttccagatcttagaggaaagtctttcagtttttccccattcagtatgatactaactgtgggtctgtcatatatagcttttattatgttgaggtgtattccttctgtactcagttttttgatggtttttatcatgaagggatgttgaattttatcaaatgctttttcagcaatgatcatatggtttttgtccttcaatctgttggtattatgtatcacactgatggatttgcatatattgaaccatccttgcatccctgggataaattccacttggccatgataaaatgatcttttaaaatgtgttgttgaatttggttcgctagtattttgttgaagattttggcattagtgatcattaaggatactggcctgtagtttgcattt

SEQ ID NO: 558307 - DNA, 239 bp, Homo sapiens
aatttcccctaaaccctgacttcccacctcagcctcctgagtagctgggactacaaatgcgcaccaccacaccaagtaaatttttgtatgtttttgtagacggtcttgccgtgttgcccaggctgttctcaaactcctgggctcaataacctgcctgcctcagcttcccaaaatgctaggattacaggcatgagccatcgcgcctggcccttcccatgttttcaatgtgcctctttgtg

SEQ ID NO: 558308 - DNA, 1093 bp, Homo sapiens
tgggaaatggagtttcactcttggtggcccaggctggagtgcaatgggcggcgatctcagctcatctgcagccactgcctcccaggttcaagtgattctcctgcctcaggcctcccgagtagctgggattacaggcttgcgctaacacacccagctaatttggtacttttatagtaggagacgaggtttcctccatgttcgacaggctggtctcgaactcccacctcagcctcccaaacgtgcgtgggattacagggtttgagccaccggtgaccagccaatgtggtgccttctatataggtgtcatactcattgtggctctctgtgttctgcccaggtgataacaagtgggaataacgccgtgcatacacattcttctcatggtggtgaaaaccctttcccctgtgtgtgctggagaattaaatgaaactcttaagaattattcaaatgagttatatttctcctttgaaccagccttagcgttggaatgaatttataaagcctttatgttttaattatacaccaagggaaagtataacgcagctcaataatgtgcgtaatttgtgcataaacctccttaatcttattggaaagtggggagaaggctctcttaacaaaatttctcccccgaggtataacgttttataaagaatctcaaaaagccacctattcctattttgggaagccaccccccaccattgtgtgtggtgtccccagggggtgagcataacaaatgagggggtgccttttctacatataacaacaaagttggtttccctccaagattctcccgtggtgagagggctcccggaaaactttatatccctccgtggccattttgtggaaaaactctgtgggaggggaacacacacagtcgcgcccaagaagagtttgccacagagaaaaggtttataccctttggccccttgaaagaatatacacccataagggaaaagggggagaacccccttctaaagaaggcccggggcaaaagttgaaatctcttgggggggtcccccttgtgtggaattggtacaaaagccccccaatatgtgtctctctttccccaatcttggcaggaaaccaatggggc

SEQ ID NO: 558309 - DNA, 143 bp, Homo sapiens
  misc_feature (109)..(109): n is a, c, g, or t
ctgcgtggaggcggagaccgaggtgaggatcgagaacgcgaggagcgcgaccgccgcctggccccagaagctgttgccgaacagggtcggcgcgatggccgaggggacntccgccgcattagactccacgccgaggccgatct

SEQ ID NO: 558310 - DNA, 154 bp, Homo sapiens
accgatcaccgagcagccgtgagtgtctctcaaggccataactaagatgccgctactcatcctagcaccacaacctgaatgtgtgttaatatttttttgttagttttccccaaaatgtttacgatcccaacaagctttcttttctaaacctgca

SEQ ID NO: 558311 - DNA, 130 bp, Homo sapiens
cattggcaatggggagctattagggaagggagagtttgtttgacttaagcatctggactatggtggattaaccacacaccaatggaatgtcataaactttatccttagagtcttcagtgtatgtcgacgc

SEQ ID NO: 558312 - DNA, 108 bp, Homo sapiens
acccaattttttgtagactaggaaaaaaatgcttgtgtttttcggaagtgtaatgcttttttttgactgccaaacttttttatggaatatatttttatattaatgcta

SEQ ID NO: 558313 - DNA, 224 bp, Homo sapiens
cgtcagatatgcttgttatatttaatggctgatctatgtaatcacagaggccagatatgtacatgacaagagtgggaggtttaatgttcttggtctcttcctccttggataaagtcttgatgatctcctccttcttggcctggaggcgctcttcacggcgcttgcgtgcttccttggtcttagacctgcgggcctcagcctggtcagccaggagcttcttgcgg

SEQ ID NO: 558314 - DNA, 118 bp, Homo sapiens
cggtcgctgaaacaggtgtagacgtacaggccattgaattggtcatgtcacaccgcacctgtgtcgagagcaacggccgtccgcgccctgaagaacaacagtaatgatcttgtaaatg

SEQ ID NO: 558315 - DNA, 117 bp, Homo sapiens
ctataatataagcgcacagaactaatcatatttgatatcttcttcgaaagcagactgtatccccaccttggttatcatcaaccgatgaggcaacagccagaacgcctgaacgcaggc

SEQ ID NO: 558316 - DNA, 455 bp, Homo sapiens
gcggccgcctactactactactgctcgaattcaagcttctaacgatgacggggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaa

SEQ ID NO: 558317 - DNA, 208 bp, Homo sapiens
ggagatgcacatggacattgatgagactacccatcgacactacagcgacggctcaggcccgtacccactgagaccacatgctggctaggtggctggcccagtgcggttctcatctgagaggctctccgtgcaggcgatggggcaagacagaaaatgtgctgagctggggaacgccggggtgtaacttctctgctgcaaccttgcgcct

SEQ ID NO: 558318 - DNA, 356 bp, Homo sapiens
  misc_feature (344)..(344): n is a, c, g, or t
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggtgaccggctacggngtaccgagctcg

SEQ ID NO: 558319 - DNA, 106 bp, Homo sapiens
tcgaggatccctccccccggttaaaacatacaagtttcttcttttttcccacaataaattgcagcttataataaaaatttgaaaggactgtcattggaagcaatga

SEQ ID NO: 558320 - DNA, 268 bp, Homo sapiens
ggtctacgtgcctggagtcactgccagtgaacctggaccctctgccctcctgccagggtccccagcccggtcactctgagcctcgttccccaccagcctttccgagctattgttctagaaacagaagcggagccacccgagcctggacccttgccctagttcctgtcctgcctgtcacattgtcctgctcctctcgggagggactgcatcccgccacccagctgcctcatcccaaactgtccaggctgttggaagaggagggctaatg

SEQ ID NO: 558321 - DNA, 580 bp, Homo sapiens
  misc_feature (578)..(578): n is a, c, g, or t
gtcgagcaccgtggccggcacttccttgacgccttgatagacgttgaagaacacgatgaagaacaccagggtcacgccgagcgcgaccttggaccagacgccgagcccgaaccacagcgcgaagatcggcgccagcaccacgcgcggcagtgcgttgaccatcttcacatagggatcgaacacggcggcgacgcgcggctgccgcgcgaaccagaagccgaccaggatgccgccggccgagccgatcacgaaggcaaggatggattcccacagcgtgatcgcaaggtgcttccagatcactccggtcgagaaccacttcacaatctggctgaagacgtcgaccgggttggagaagaagaacgacggcagcagcaccttgccgaacaccggcacggtggcgaagacctgccacagcgccagcgtgacgaccgcaaccaggacctgcagcgccagcaacgtgatgcgcgacatcaggcggctcccgcctgcgtcgactgggcatagcccttcatcacctcgtccttcagcacgccccagatctcgcggtgcagggcatggaaatccttctccatcctgtnct

SEQ ID NO: 558322 - DNA, 288 bp, Homo sapiens
ggaacatgtagcccgtccctatcagtcaacatgttgcccgtcggcgtaacagtcaagatgttgccctcccgtccagatcaacatgtagccctcccgtcagacaaacatgtagccctcccttcagtcaacatgtagccctccctccagtcaacatgaagccctcccgccagtccacatgtagccctcccgtcagtcaccatgtagacctacccttcaggcaacatgtagcccacaactaccagtcaacatgtagccctagcctatcagtcaacatgtagccacctctat

SEQ ID NO: 558323 - DNA, 216 bp, Homo sapiens
cctttctctacaaaaataaaaataaaaaattagctggatctggtgatgtgtgcctataatcccagctacttgggaggctgagatgggaagacagcttaagcccagaaggtcgaggctgcagttagtgatgatcatgccacttcactctagcctaggcaacagagcgagaccctctcttaaaaaattaaaaatcaagcaatctgctgttctcagagg

SEQ ID NO: 558324 - DNA, 818 bp, Homo sapiens
gcaggttgactgcgcaatgcagaggctgcaggtagtgctgggccacctgaggggtccgggcgattccggctggatgccgcaggccgcgccttgtcctgagtcgtgtgcccctgcagtgcctcgtgtccgcgtgactgtggttggtgtgtgcactggtgctggctgcactggccatcttgccgggctggtgccggcggctggcttcaatggacaccacgccccgaccgagcttctctcgtgcatgtcattgacctgctggttctcaatggactgtgaatctagaggccgggaacagctgggggacatctgtgtcgtgacatcccggagactgtgcctttgtccactgtcaatagacagtgttcgtcggtgggctacatgggcagtggcccagcatagcatgggtggacgtccatgtccctggctgacagaggggaacccttgggaaatattacttcgcgcttgatggagaaggacaatggccaggagattgcctgattcctatggggataacctctgagactgtggctgagcggtttggcatttcaccgggacgaagcatggatacctttgccctggcttcccaggcagaagtgatgcaagaagcccagagcaatgggctgtttccaagctgacgattgtgcctgtgaccaccaacggtccatgatgacaagggcaccaaagaggggccatccactgtgacccaggatgacgggtatacagcccaaacagcatcatggagggcctggccaaacttgaagcctgccttcaagaaagatggttctaccacagcttggaaactctagccaggtgacgtgatg

SEQ ID NO: 558325 - DNA, 329 bp, Homo sapiens
cctcccggattcaagtgatggttctgcctcggcctcctgagtagctgggattacaggcacgcaccgccacacccagctaatttttgtatgtttggtagagatgaggtttcatcatgttggccaggctgaccttgaactccttgacctcatgatccgcccgcctcagcctcccagagtgctgagattacaggcgtgagccaccacgccccgcctctttcaaacacatttaataacttccataaagatcttgcatgtcttttcttagatttcatcccaggaactttagatttttgttgcttttataaatcgtgtgggcacacattatggag

SEQ ID NO: 558326 - DNA, 191 bp, Homo sapiens
tttggcaatttaacggccacggtagtagcatgcatctcggactcctttcgtttgtgttgaagacctgacctccacgcccatgaagaccagagcgcgaatctcgcgcaaacaaacgggggagtccatcccatcattcaatccggacgcgccgcggaattgggcccagaagcgtgctggtgagcgtacgcctt

SEQ ID NO: 558327 - DNA, 448 bp, Homo sapiens
tagaaatatctgtgtttcagcacgggattggatttcttcaggagactctatggggcagtatattgattctcctaaggggtgaccagtgcctgggtggaggcactggggtaatgaactcaccaataacccatttgaacttgagacaaccacaagggaagcagccacaaagcattttgcaacaatgggacattgctagcctttgaataattaattccaagagacatacagatataggactcaaccctgacaaattccaggtttgatgctttgttaattaaaccctgtcctccattgaaaacacacacacacacacatacatctggtacagaacatagacactgctatatcaccagtacctcattttaacttcttggttcaggatgcatataaacctctggagtacttttcaaactcaccaaaaaataaaatcattcgattgatcttaaaa

SEQ ID NO: 558328 - DNA, 364 bp, Homo sapiens
gggagcccaacggacattccgctttccgcttccgtcccgcggggcccatcggggttttggggccgcaaccgggaccctcccggaaaatgaccttgtacaaaagctttccctccccttccccccaacgccacggccaaggcaggcccccccccccgctgttttccgtgtcaaccgtgtttgattttgggacccccgagccccccagggacccttgagggccccatcccgttatccgagacccttcctacccccccttcctcggcgctgggagctttttttgcccaagggggggggatgggggggctggcgccccccaacctgcccatttcaacttgttactcaataaacaaaagtgcccatcgga

SEQ ID NO: 558329 - DNA, 118 bp, Homo sapiens
tgtcttcccaccagacagtctcaaactcctgggctcaagcgatcctcctgccttgggttcccaaaccgctggtattacaggcgtgacctacttcgctggcctacagcacatgccgggg

SEQ ID NO: 558330 - DNA, 1040 bp, Homo sapiens
  misc_feature (719)..(719): n is a, c, g, or t
  misc_feature (731)..(731): n is a, c, g, or t
  misc_feature (784)..(784): n is a, c, g, or t
  misc_feature (786)..(786): n is a, c, g, or t
  misc_feature (788)..(788): n is a, c, g, or t
  misc_feature (791)..(791): n is a, c, g, or t
tctgtctcttctctgccggtcttcttctgttgctctctccctctttgttctccctcttgtactcttggtcttctcttttctttcctcgtgtctgttgttctgctgcgtggctgtgctaggctcgtgttctcgcgtgtggttttcctctttggtcctttgatgtccttttcttcctatcttcgtcttgctcctgttgttgagtgtgtctccgctgcctgccgtttggtcgggttagttggctttggtgtcgcgctgggcccgcgtgttggtgtctgtttcgtgttcgcttgtgtttggtgggttggcgctcctatactctgcgtctccggtgtggtctgccccttttcttctcgtggtgccgttctgagtggaggggcgttctgtcgtcggagtgtgctttgagctcggcacccttgattgtccgtggcttatgtgcttgtcggtgttcagggtggtgtctcgcacgcccgtctagtgagtcttccggtgatctccgggagatagtgtgtgacgtcttgttgatgctccatgtggagcgtcgttgtgtccagtatgtttttcctggtgtgtctcataggtccactttggtgttcaatgtctttcatcccttgactgtctggtgaggccaccatcttccaacgttttctcctctcttttctggccactctcacttagtctcctttgtcatttctttttgctgttcctgccttaaatatttntgtggtttattnatttttaatattacatgaaatgtgatgggaaatacacaggatcactgacaatntntnttntaattgaagttccacttttcatctaaagaagtttgagaacagtttagaccagaaaccttaagtgagatcttgagtttctactgactctaatcttgagactctacagacacaaacctgcctgggaatagaggacagaatgatatgattagacgtgtggcacatgctaggttcatgtacctaatcagccacacagggtaagggctgccagaaaaacatattagtcaatctagtctttccttcctttcttct

SEQ ID NO: 558331 - DNA, 946 bp, Homo sapiens
catcttgggacttttcttaaaagttcagtaataagctaactgtgtttataaacatgtaagtctcttacagaccatcaagtagcttggactgagacagtctgtgacttcatgactaggaaagaggacggactgcggtctggggttctttaacagtctctggctgggctgcctcatgactttaatcagctgtgaactggccagtgcaccagcaacttaagcgtgtgcatgcagcagcaattccggatatacgtttatcattttctaacaaaagtgtcacctccaaattcaaagcaagtgtaagtctagtctcttaaggctagaaggtccaaaatgcttgcctctggtcttccaacaggcattatcccaattgtggcacagatggcccatgacctgggtcagcatacttttcctccgtattaccattctggggtttcctttgacggggtcactcattggacgaccacgcagggcctctgacgaggggccctgggttcctaagacattccatattggcaccttggacggggttaaccagcctgggctttattttcaatggcattggtaacttctttggactgttctttcaattcctggtcaagggcctccacgcgaggcctattcaactgacatggtgttcctcacaactttaagtggcttccccagggctaagctacatagggaaacctcccaaatttcaaggggcccacagtttacacacggctccacactctgtggtgggcccacaaacgtataacccctttgataaacaatattgcacttcgggagcaaaccttgtttcgccaataaggtcccaacagttgtacacagatcaccaccttgggtcactctttcccgcacttggtacctccttacgcagaagtttaacactatttatcacacccggggtttttaacacgagaccctctaaatattctcacccattctt

SEQ ID NO: 558332 - DNA, 482 bp, Homo sapiens
ttttgaattttcagtttgatatcttgtccttattcattgttgtataaagcaactgtactttaatactacttgaaattaaagtacagttgtttatacaacaatgaataaggacaagtagtattaaaagtatttcacttcagtttggggggattattatcaatttataattttataaaagtattttaaagaataattgtaaattttccataaattacaacttcctgccatcttttattaaataataatcttgcttaaggcatatagacagacattattatgagtattccagtaaaaaaaatctacatcaacttgaccattctggctaaaaattaaaaagcacttttttatatctgtggttgtcatttgtttcaaagcatttctaaatttattgttcttaaaagtatgtctgcatgttctagcctttgacctaggtcatctatgaaccctctttgtgtctaataaacatatctgtaaaggcatat

SEQ ID NO: 558333 - DNA, 255 bp, Homo sapiens
aatcagtgtcatccaaggccgtaactatagactttagtagggataagtagcaacaattagaactacctcaaaaacgaactgtacagagaagtgtatgcttgaaaactatttcaacttgatctcagtggggatgtcaaggtcccaaaccagaagtcatctttcagcttggaacacagagagccatgtatgttggatgggtgagatacccagtcagagaccgtacacatgggggacaaatgtttttggagctcttac

SEQ ID NO: 558334 - DNA, 262 bp, Homo sapiens
ggtcgaccaaagccataggggaaaaaaaaaaaacatgaagacgttaaaaaaacaacaacaaaaaacacacacacaaataaaatgtctgctgtgggggccgttttttttttttttttgacagggtctcaccctgtcgcccaggctgggatgcagtggtgcaacctcagctcactgaaacctctgacccccgggctcaagcgattctcctgactccgcctcccaaaaataggtgggaaacaataaaaaagaaagtcgacgcggc

SEQ ID NO: 558335 - DNA, 86 bp, Homo sapiens
ggatttgctggtgcagtacaactaggcttaatagggacatggcgtctaaaatggatggcatacaatgcaaaattagcattcaattt

SEQ ID NO: 558336 - DNA, 302 bp, Homo sapiens
tctactacaaatacaaaaattagcagcggcgggtgcctgtaatcccagctactcaggaggctgaggcgggagaatcgcttgaacccgggaggcggaggatgcagtgagctgagcacgtaccattgcagtgcagcgtgagtgacagagtgagaatccttctaaaagcaaaaaaaggacatttcttcctccatttattgtggaacccctgtggaagcccttattagggtaccccctttgaatatttatacccgggaattgcaattctcaaagggttcaaaaacacatctttgagccaggttaac

SEQ ID NO: 558337 - DNA, 181 bp, Homo sapiens
tacctagcaggatccttaaaggcgagtcgggtattatacttgccatctccaaagcattagctctgaaggcataaccttttcttttttttttcttctgaaagagacagggtctctttgcatggctcaagctggagtgcagtagctatccacaggcatgatcatcaagcaccacagccccaaa

SEQ ID NO: 558338 - DNA, 141 bp, Homo sapiens
actaatccagcacatcccacagtcaaccaggctcaacgcacacaacagcgtcccgtgacagcaccaccacctacaggcctacagcacaggaacctacaaattcccacagacagccaagggctcaacgagaggcacacacgt

SEQ ID NO: 558339 - DNA, 419 bp, Homo sapiens
cgaaagagaaagaaagaaagaccttaaaactctaatacaatataatgggtttttaaataaaaaagaaaatagaaatcaccttttcctctagcccctcagttcagcattagtcaagctttttaacctactcttgaacgtatcaagagccttctttacttggcccaccctgggtagaactgggattctccccagttcctgaagtttccatggctctactctgtaacaaggaaaagggaaacatgcgtcctccgtccgctggagtttctccacaggtgagtcctttgctgccaaaggttgtacctgttctgccaccgccccctgctggtgactcttacaaggcgccctgtcttcactggcatccgagcaggttggaatttaagggaagtatctagatccacctagatggggcttggtgagga

SEQ ID NO: 558340 - DNA, 418 bp, Homo sapiens
  misc_feature (56)..(56): n is a, c, g, or t
catgagttcgagaccagtctgagtaacaataaaagactattctttcaaaccatccntcccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctc

SEQ ID NO: 558341 - DNA, 218 bp, Homo sapiens
ggtgggccacttgaaggagcccgacgccggcgggtgatgctctctttcacccggccctcgctggtcaccttcacagagaaggggctgccaggcacgtgcgggtcggcaaacttgatgtggatgatgtagttgcctggctctgtggggcagtaggtgacccggcacgtcccgtcctccaggtcctcggggttgatgtccacccgtgaagggagcccaaa

SEQ ID NO: 558342 - DNA, 204 bp, Homo sapiens
gcgatggccggcccggctctcgtagatgattgatcctttgctgacatgatatccagccgtggaatgcagtactggagcatagtctcccactccagccagggtccctatttggcatttttgatgttgttctgatatctgctggctactttcttcatgtgctcccaacgctgaagtgaattgtgagactttggaagctttgttgaa

SEQ ID NO: 558343 - DNA, 738 bp, Homo sapiens
ctggctgggagtgatcgtcaataacaccgagagcatcctacatgtcctatgatcacgtggaactcacattgcaatgacatgaagtaacgtgccacgaatgccttctaagggaccaagaaaggcactgtctaccttaccccttaccgggtcatcttatcttgtaccaatgggcaagaggatgccatgcatgtccttcatttatgccacttttatctcatgaaacgactgtgagatcaacgcatgcccgtattttgcgtgcagaactacatcaactgggaacagtgaaggcggaagcgggaggtggctgggcaagggctctgcttcctagcaatgcttgacctttcaccggcagggtggtcgccagttgtatgcttcgtgaccatgcgtgctgctccatgcgtggcagtctcagatgccttccatgacggttgatagtccccagtgtgacgcctactggtgtaactcttatcattgctcctagtcgggcgcgctatgtctattcgccccgcccacggtcgcccctggtgcttgtgcccctggccttcctgggtcgaacccctgttcaaccgctccgcctaacctgtagttgcctagtcccagagattcggccctatgttgccagcgggctcatccgggagacggagtcaggcggcgaacaatggcgctatcctgttgggcctgggtgccccggtctgagtgccccatgtgctctccctccggatgcgtcccagtgggaag

SEQ ID NO: 558344 - DNA, 257 bp, Homo sapiens
cttagaggacaagagggggaccaggcgtacagtggcacagcagccaccagccccctgctgcctgtacttgtatctccctttccccaggcctgtgcttgaacctgaggcactgcacagccccacactcatgacacactggatcctgtaacccacaccctatagcttaacaatgtttatccaatcaataatcaatcttattttttggtaaacaaatgagagtttctgacaaacaacttggtatcagcccaccctctttc

SEQ ID NO: 558345 - DNA, 540 bp, Homo sapiens
tgccccgttcatagaggacccggtgtttatcgatagcattcactgctcgtcatctatccagacaggaccctacctcctgcggaaccaccaccgagttcctcatttcaatgcccttttctatatctataagtacttatatatatatttttttaactactgtcacccacggttgaatatgcagtggcagggatctcacactccgccgtcccaggctccacgtgattctccctgcctacagcctccgcgatgtacctggagactaccaggcatgtgccagacacacccatgctaattatataatcatttacgtggagacggggtttcaccactgtaggccaggctggtcttcaactcctgacctcaggtgatcctcccgcctcggactcccaaagtgctgggattacaggcgtgagccaccatgcctgggctcccagttggtaaaaatctatcacattctctgtgaggtataacttatatgcaaacccgcacatacttcaaagtataccactagataactttttacatatatacacatgcctg

SEQ ID NO: 558346 - DNA, 451 bp, Homo sapiens
aatcatgctgtgtgggatcgatattattcaaaaccaaaaccaccgaaaaaaatccatagcaatatcggtatcaatgatatcgacatattgcatcagtactcatgcatcaattcatcaactagtagttcgagctaacactatacagaagtatatgctgattgtctactatattgccgatttccagtcaggggttgatgcatctgtgatttgaatagtggagggacatcctgcaaccacttgcccctcatgactactgatgggtccatgatcaactgcgcaaccctttcaaatctgttggtcaggagatcgcagtgtggagctattgagcaaggactcaatctgatgttaaaggtacgtcctgtgatgtcttggtctaaatgctgagagcaaataattttatctaccctatagaaatatatcctatgctccttttctccctgtgtaccagtat

SEQ ID NO: 558347 - DNA, 639 bp, Homo sapiens
  misc_feature (416)..(416): n is a, c, g, or t
gggagatcttcaaagggattcatgaggcctgttcctgtgagaggggtccacttcactccacccccgtcccctttggaggggcctgtttcttgtgccttgtgttcagaactgtggacggtgcaggatggcggcctcgtgactctatcagacagccctagcctcctgtccagaatgataatctgcggggtgtttttccggtcgccattagcccacgtcacacacaccgtccgcgtctcatgtgcgtatggaccctgagtcaacggacagtggcagcaagttactgcaaatgcctcctggatctctggggtttgtggccaatgtagccagtacagagcctcaggagaacgtatgaccacgcgtcatttgctggagttatgacatggtccgagccagcctcgcaggttcattcggtgccntgtgttgcaactgcttcttgactgtccaggactgccagaacaggatagtacggggaagcacggaccgttggcccctttgagttgaccaagcacctttatagcctatatctaaccccatcgccgagtggtgactctcctgactctaacgggcacgtccacacccccaccttccttttcccccataggcgccgcgtgcccagtgggatgttggcccttttggttg

SEQ ID NO: 558348 - DNA, 187 bp, Homo sapiens
gtatacataggcatctcttttcttctcttctctgttactctctttctctttctctctttctttctttctcagagtctgactctgtcgcccacgctagagtgcagtcgcatgatctcagctcactgcaactgggttcaagcgattctcctgcctcagcctcctgagtagctgggattacagggatgca

SEQ ID NO: 558349 - DNA, 1265 bp, Homo sapiens
tccctgccggggctggttcctccctgtgtgttacctcgctgattgcttgtgttgcgcctgtggtgtgttgttatcccaactcgtgggttggtgtcgaatcgtgttggggtcgttttgttgtgcagtccctcgggtgcgtctcgttgttttgggttggtggtgatgtttttcccctctgtatattctggggtcttctcgttgaaggtttggctgtgtgtggttgtctctacaaagtggtgtgctccatttctgatgtgtcgtcacccttattttggtgtggtctgagggcacccgctgtgtctttttttctcctctgtggctcctccacatagggggtgtgtctgtgcccactgtagttgttgtgttgtatggttagtagctgcgccaccctgtgtgtgtccctcctactgggggtgggtgtgtgttgtctagtgcaggcagtggctctgtctgttgttccctggtatgtgcacttgtctgctcgttcagtaggttgtatcggcattgacagagcagtctgctttctcgtttggatgtaggggctgttcttctgtctctcttgctggtaggtgtgtattcctcctctctcttcttcggtgtgtggtggtcggcacctcggcacgttcatgatggttgtggtgggcggcacatcagatgtgggtgggttgtgtagtcttcttataatatggagtcctggccttatcacttcagtgggagtcacgagactgttcgtgattgaatatttgcctcgctgagccgcccaacaaactgtgtgttgaccgacacagatagcactccctgggtggggatagatacacccactcttgtagagaggggagtacccacggtgctgtgtcgcaaataatagattttgtctccgcgcgcatgagtcgcgcactcctcacgagtgtatcgcaccctttgtctacaaagtggggtgatctcctctggatgaacaatcttcttctagaagagagtaaatatccctcgctgcggttggtcgtgtccgccgaggtatctatagaagtttgggagaactggtttcgataagcccctcgtctcttgccctctatgtaaaagtgaatgtatatgtcggcaccacccgctattgtggtcctcatatacaccaccctctgctggtaattaatgctgttttagatttgggggtgagaaacaaggatttgttttattcccccttttttcccctttgggagccaaagacaccccacattttttttaaaaaaagggtgattttggtacaccca

SEQ ID NO: 558350 - DNA, 1295 bp, Homo sapiens
agcgggcgggtccgcgcgcggcttctcaaacatggcggcggctggtgtgaagctcggtgccggctcgcgcgatcgggtgggacagaattcctcgctctgtcttgtcaccgacgagactgtgaggaaacaatcaccacacagtagggactaccattgggacaaacagtgaaactgactgattccattggcagtgtcaacgcacacgagcaaactcaaccagaaaactccttacgctcaacgctacactctctctgctaccacaatgcggactgacttctccatcgtgcgcgagggatgctactttcgaacacgggagcactgcgtgtctagtacacggctgactcctctcacgcagtgcttatccgctcacgctctcacggattcgcaccatgttgcaactgactttcaacacgctctgcgttactggcacaaccttgcgcaattgcgccgatgacccctcgtccacattgcgcgacttcacctcactgttgattggcctacgcgtctactctggcaactctaccctgtggcggccaggggttctaccgcgctctacggacgtggaactggctagctgacacacaggcacacactgactctcctgcggagggcgtcgctccgaattcccgcagcaacataccaaccctgcgccgcgcccaccatgcttgcacaccacagcgcaacgcgcatgcaccttaacttttcaaactccttcccaactaaccgccctcaccaagcactgccacattaccacttcctcccctgccccgcacttctttccctcctctcaacagcaccccttaaattgccgctcctgccactcctgtgccaactcctgttgcaaccgaatctactcttcaccgacccgtgcaaccctcctccaatgaggtccccctcgatcttaacacgtcacattttcctacaacgctgcgcgcgcactgcacaccccctgggcaaaggcctactttgcaccaatcaccagcaagcgcccgttgatcgtcaattcctggtccccctgccgtaaccccacttctgcggacgcgacctgtcttccacacccggcgcgcctggacacgccttcccttactcccgctcgttcttgcactcgggccctgctgcagcttgggagccgccgctgccttcgtcctcttcccctggtcgctgcgcctctcggttactgagcatttccccgcaggacagttatttcttcctccagccgcgtggggtttggctggtctcgcccctggacccagcgcgcgattgtctctattacaagcccccccagggacctacgc

SEQ ID NO: 558351 - DNA, 136 bp, Homo sapiens
cgcttcgcggcgcgacatgaggcagacggtggccgtatgcggtcatcaagaacgtggagaagaagagcgcgcggcgccggtctaggtcaccatgtcggcgcaggaacgcgcggaacgcgggcgcattctgtgaggc

SEQ ID NO: 558352 - DNA, 325 bp, Homo sapiens
acatgtggctatttaaatgcaagtgaactaaaattataaaattagaaattgagagctgggcacagtgctcatgcctgttatctcagcactttgggaaccaaggcaggaggagcactttgagcccgggagtgtgaaaccagcctgggaaacacagtgaggcctggtatctaccaaaaaaaaaaaaaaaaaaaaaaaaaaaaaaaaaagaattagctgggtgtgatggtgcatgcctgtaatcccagctacttggatggctgaggcacaagaattgcttgaacctggaaggtagaggttgcagtgagcaaagatcatgccactgaac

SEQ ID NO: 558353 - DNA, 312 bp, Homo sapiens
gtatggtggtactggcgcagcaacttctctcgtccctggagagaggccacaatgtggcgtgacagattgtcgtaacggactggtgagggctctcgtgtgtgtatgggccatgttggcaccaaagcgtgggtgcctctcatgcttccctgttgctgggccagccttggttgacatggaagggagaggtatagcctaaaggtgggtctggctcaggccctgcttgcagtgactcaaaatcagggctgtctgaaggtgtgagcaagctgtcataagataggctcccattgcgtgtctcgagtcgtgggcacgaca

SEQ ID NO: 558354 - DNA, 759 bp, Homo sapiens
gttggttgtaagttgaagatttagcgttatgactttgaggtctggggttgtgtatttgtaaacttgctagtggctatatttgcaagggcaaatgtatttctttattaaagtaaagtacaataattggtgaagtgtacgcaataatggacagtcatcttaactcgtagtgagtagatctgcattatggaatctagtagtttaataggttttaatatttattgagatattcatatgttgatcatagatcaaacttgttgctagtttatacagatagagtgtagaagtgctgcatggaatatctttgagggtaggtgggaatacttctgtagtgaaatcggggaaccttgtttcagctgggttcttagatattgatggccagttcggagagtatgatttccgacaggtatcagtaggtgcacttagcacagtacttagcttactgacaatgtcagttctaatagtgactgattcgcattctgaacagcaagtgattttaggcatcatttcttaacatatatcaagcgaagtcctgttcacacgatctaacatgaggacatggacgacctcgagtgattaccagcatatatgttctgaccttgagcggatcgcttagctgttctcatagactataacgcaatatgtaccagagaattgaagatggtgatgaggacaggtgagatatatgtatatatatgtataaatgtgctagcatatactctgtgatagggtagaaatatccttagtcattgggaaaaagta

SEQ ID NO: 558355 - DNA, 230 bp, Homo sapiens
cagtcagtcatagcgaacagagttgtagatatggcagtgcagtgccgtgtgatctgtgtgccccagcagctcccaccaccatactgatctggccgtcctggtcgacgatgatcgtcgggcacatgacgagagcggctgctccctggctggatgagacttgcaggtgaggggggtaccccaaactcgattggtgatgctgagagagctgaagtcgtccatctcattattga

SEQ ID NO: 558356 - DNA, 618 bp, Homo sapiens
  misc_feature (536)..(536): n is a, c, g, or t
ggaaatttagaccagctgtttgttaatcttaactttagccaagacaaacaccaattcagttacttacctagggatgggtctcaggctgaggactgctctctaccaacctagaagcaggaaaaagtaaactgatcttccctgttggatgcgcgctcaaattccataaaggagttatttgtcttacatcgtcatggaggcaggaaaaacttgccttccttgtgttggaagcaagtaaaactccaaaaaaaaaagatcagggactttctggagggcgtgctctcagacctcagcaaattgtcctattggtttgagacataaagttagctcatgctggtaccaggcaccgataggagatttgtcaaaggcaggggcatctctactcagaatccctttgtggttaccaaaatgtgaacgctgtttgagacaggtctcagttaatttagaccatttattttgccaaggttaaggatgcatgcctgtgacacagcctcaggaagtcctgacaacatgttcccaaggtggtcagggcacagctngggtttatacattttagggagacatgagacatcaatcaatatatgtaagatggacaatggttccatccagggcagggcctct

SEQ ID NO: 558357 - DNA, 3291 bp, Homo sapiens
cgcccgggcaggttgagaagccaggggccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccagtccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctccctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggagagcgaggtgcgattcagaaaatcctaaccagctggcctgctgctctgcacagcaccggctgctgtgaagactctggccatggtgactggccatgtgtggcatcatctgggctaatggccaccgggcaccatcagactcccacctccactgtctgctgcctctgtgtgtgtgtgtgtgtgtgtgtgtgtgcatatgtgtgcattgccactctcccaagtttttcagaaaccagcagagctgtcaactcttctcaaaatcccaggctggaaattacctggagacaagagttgagtaccgtggatgttcctacaggagtgtccatagatggatggaggaggtggagcccagagcccaaggaagagctgggaattcttgcttctctgaccctcacttacagactagcccagtgtgggcagatgccagcggcccaggtggcgccattgctgtcctgggatggatcgtgggttttggtggatgcagcttcccagggcctggaccgtcttcggtgaaaagctgctcccgttggctttatgagcatcaagtcctcacccagaccccctgctggtgccgtggatgtcaccagtcggactgtgctgtggctaaccaggctgacaactgagatgaggattcactgtactcatttggtcacaagctgctggggcgggttttattttattttatttttatatttaagaaatgaaaatacgggtatttttaaagattctccaaaaagtccagaagccttgagagctggcatcaatcagcccaagacccccaggggattcatgggaaatgtcgtattttagagtcctacagaatatttctggcctcaaggaactggatgaagagactggacaaagtccccaggatgggcatcccccaagtcactacagcatctggagcccctaggagatactcagggaagcaaatccttgtttgggctggcaagcaaatccgacacgacgaggtccacaaactgtttctgcatcccagggctctgacgaaggcgttaagaaacagatgctgttcccgcgtaggctcccaggggccccagggaggtccaggtggactgcctctctcattcccaggagctgtcctgggactttgggatttcttctcagctttctccacctttcagtttctcagttgtttcagaaacatagcaatgacataaaaactgctatggagagaaagctaacatggtcccatgccttccaggcagccctgctgaaggatctaagttggccctgttcctgcaaatcatcaacgtgcctggactcgccagctaaaagcctgggccttccccagccttttttctggggcacctattcctctgccagtcctgctcccctcaccttccttgggcccgtcagagtcttttgtggtgctgtgcttctcagaggcaggatccaagcagatcagcccagcctagcccagctcaggcaggccatggccgctcaagggaaagactgccccagaagagcaagctggagaggctgggcaggggctgatggggctgggtacactggggaatgttagcaagactgggaaggaggccacattcctgtctgcagcagcccccagcgatggtcttcagcaataaaagttgtgtgacct

SEQ ID NO: 558358 - DNA, 182 bp, Homo sapiens
  misc_feature (97)..(97): n is a, c, g, or t
gaattctcccaaggatgagaaattgcggagaaaagataaatgttctataaatagggtgggacaaggggtagcagttggaaaaaaaagatgggagctnattattccattctcacactgctataaagatactacctgaaatggggtaatgtataaacaaaagaggtttaattgacttacagttc

SEQ ID NO: 558359 - DNA, 906 bp, Homo sapiens
ggcagtacggcggtcccgagtgtctgtctcttgcttcaacagtgtctgcgacggaacagatccggggcactcgctgtaccagactcacagagctgtccatccgcatatctcgtacgtccgcgttgtaaacatccgggtgcaccatcttcgtcggcgatgctcctggctttcttgggacctcgcgagcaccaggactgtatggataggctcctttcttgctaaaaacccaaaccccatgaaggctacccctgagataacggtcagaaatttaatgtccagccgcaacgttgaatggtcacgcccggtcacatcaacgcctgggggcgaattgcagttacactaggcatgaggaattcacgtacacactaacatacttctctggggactctctgatttgcgaaacggcgattggaatgtgggagctgctgggaaagaggcaggtggagggagagtttcgtttacccgggagcaaagttgagcccgatgggaagaaaggtgggtaaggggttttaagaaggagattcaccttgaaagtaatgggttaaaattaggagttagagtggatcagagtggaatacgttatatagtgagcatcatagaaaagggcatgagtagaaagaactgcagttggcggttcaaatatgagcctcaataacgcccgatggtacaggtgggctcaataggcgcgcttgggacgaaacaaaggcttgaaaggtcagtgcaccccataagtgagacgttctgtaaggggaacctagggcgattactgggacctgcaatgtgaagctcgacactgcctacttgcagaacattactctgtaagtatgctgaggttacggaaaactaaatcgcacagtagaaagcttacattcatgaaaaaaatgcgggtgtaaaaaccaatggtga

SEQ ID NO: 558360 - DNA, 646 bp, Homo sapiens
ccccgggctgcaggattcggcacgagcaccaatgtaagtctgccttatgttcctacagccaattgcaaaggttctcaaaagtctatggtcctgtgttcaccgtgtattttggcatgaattccatagaggtgtttcatggatatgaggcagtgaacgaagccctgattgatgatggagagtaggtctttggaagaggcatttacccaatatctcaaagaattactaatggacttggtaggtgcacatatatctgtgtcagctttggtaactggagtgagggcgatggaaaacagagccctaaaaagctagtcatcagatcttatcctatctgcatggatgccgagtgttgcatcactttctaccttggctgtgaatatctcccagattctgcccctgaattttattaggaatgatttccagcaatggacagagatggaaggagatccggcgtttctccctcacaaccttgcggaattttgggatggggaagaggagcattgaggaccgttttcaagaggaagctcactgccttgtgcgggagttgcgaaaaaccaaggtaacgatctgattattaagatcagaattttctcaccctgatggattcaatgtactcattgattgatatccaggaacttaccgtgcttat

SEQ ID NO: 558361 - DNA, 559 bp, Homo sapiens
cacgagggggatgtcatccctaaacattacgacagcgctcgaaatctttcgttggagaatagcccagaaggcctcatcgcgcattgggtggcggtctcttagcacctcaagaatggtgaagtctttggtggtcagttggcagctatcggtagtggacatgaaatgtctccagccggaccagtgaaaggcgatccggcaacaagaattgatcgggtggtatggaaagatcccctgcgccggaccggcccggcccaggggtcagactcccgcgatcagactgcctgcgtgattgaggagacggacggagacgcccatgtctagaggctcgccgcgaccgctggagtggcaggcgccaggcggccggagctattgtcttgcggggcgggatggctcacgccaagcaccaacagttcgtgcctgcgcccgtctcgggcggtccacatgatcgactgtccagccgagaggccgatcagggcggtgccgatcggggtcaggattgaaaccttgcctgcagaaatgtcggcttcacctggataaaccagcgtgaccgttttgcgat

SEQ ID NO: 558362 - DNA, 220 bp, Homo sapiens
agactcttaccgcaggtcttattatgggcgtcttagtgacgcattctctgacagacacgggaaagtgtcattattttgctgttttaactgatcattttttagacaagcggtaaatggtcaatttaatgaccattgctcgataaatgcatgcgaacgctcagcgctcggcataacgcactcacatcctgggagccgccgctgttcaacgcagagtctcacg

SEQ ID NO: 558363 - DNA, 350 bp, Homo sapiens
acgccgctggaggtacgatcctggtcggcactgtcgaaggcaaggcgcacgacctgttggggcgctgccaggcgtttccggaggaggcggccggcgcgttcaagcgagaggtggaggacagcatcaggagcctgtgccgcccaccgccgcgcgtggacgtgatcccgctcgtcgtcgacgcaggcttcgtcgtcgccatcaacgtccatccgtacccggggcaactcgtcggcctgcaggtgaaggccgcagcgaccagcagccaggggtacgcgggagacgctttcgtgtttcctcgccgtctcggcagccagtgcgagtacattccagctgacatcgtccccctgttc

SEQ ID NO: 558364 - DNA, 397 bp, Homo sapiens
  misc_feature (303)..(303): n is a, c, g, or t
cactctggaccctggctgccaccactatgaaaactcattactttctcctggtgatgatatgttttcttttctcccagatggagccaggtgttggcattctcacaagtcttggacgaagaacagatcaatacaaatgccttcaacatggaggattctgtctccgctccagctgcccatctaataccaaactacagggaacctgtaaaccagataagcccaactgttgtaagagctgacagtagtttgaagaatgagcataaaggacgagcgatggattgtaaaattagtgttttaataaatgangtgtttttgaagtttatttacatcatatcagaataaattttatttctctgtttagaagagcaatttttttttaaaaaagtattgggcttaggaa

SEQ ID NO: 558365 - DNA, 175 bp, Homo sapiens
  misc_feature (131)..(131): n is a, c, g, or t
  misc_feature (168)..(168): n is a, c, g, or t
  misc_feature (175)..(175): n is a, c, g, or t
catcttgtactatccatgtgacactgagcaggttacttagcctctctgtgcttcagtttcctcctctgtaaaattgagataatggtaccatcatcacagggttattgtgaggaagaaatgtattaatacanggaacacaatacggggctggataaatagttagctcanagttcan

SEQ ID NO: 558366 - DNA, 160 bp, Homo sapiens
atccttccctctctacgatccttcctccggtgtaacaaaattccctgctggggattcaaaaggacagccgatcactaaatgtcagtgtggcatcatcaagaagacttgaagcagatgtaattttaactgaaccttgattagcaaatacgtgctgtttcac

SEQ ID NO: 558367 - DNA, 1031 bp, Homo sapiens
aaggcatagtggccgggttaatcggcgagggaggcagtcagtacttgagccggtggtcctccctcgctgcagtggtggctctgcggcgtggagtaaacactgcctttgttccctagcgcctcgtctttcgtcgccccgtgccctcacgccgccgggctctggccggccgccctcggtccttgaaccccatttcggctcgtgccgtgcggatgcagctgccgggcctgggtttgggcattgagcgggaggaggaggaggagcggctggctgcctgggctggcatgcgatggggaactgctgctggacgcagttgcttcggactgttcgcaaggaagcggggctggtgcagcgagtaggcggcggggaggatccaagtattttagaacatgctcaagaggtgagcacttaacaatagagttttgagaatctagtagaaagtgatgaagggtgagagcccaggaagcagtcataggcctcttactgaggaagaaattgttgacctaaagagaaaggcataatgattccatatgcgaaaaaaaaaaagatcttgataagaaaagttcaaaaagagcacgaaaggagagaattgtgcagaatatcatccttccaacaaggagaatatcaaagttcaggacagaagatgacttcgaatcttgttgagaaatatgaagtcaagatgaagtaacgaagaaatagactctcatcagatgctacagttttgacaacaatacagaaagcagttgggattaaatgaccaaaataaatcatagtggaatgacgaagggacatcttagatctagagtggaagatgaaaaggattgatagatgttccatggaaagttccaaagagaagaattagggagggttagatagaaagagaatggagaaactaatagatggagcaagtgcgatggaagattgaggcaaggaaaggaaggattgagtagaagaaaaggagtgaaaaaacaaaaagagatggagacaaaaaacacaaagaggagggaagaaataaacggaaaacaacagtaata

SEQ ID NO: 558368 - DNA, 86 bp, Homo sapiens
agcttctaacgatgtacggggacatgtttggtctttttttgttttggtttgtcaccctcgataaattaagtatattcatccaaaaa

SEQ ID NO: 558369 - DNA, 763 bp, Homo sapiens
ggacgcgtgggtggacgatatcgctgggaattccggaggggaccagctgcgtgtttgtaaacggttgtattgtatgtgtagctacatgtggggacccgggttgtagcgatgttcgagaaccgcgcatataggagttttcctatagaaaatcgtccttgaggagatcatggtgtccaggttgtggttcttccgttttgttcatttaacacttgtctcccctcatacaccaaaagtacgatatgaagccttcagtttaatctctgcagttcatctcatttcaaatgtttatggaagaagcacttcattgaaagtagtgctgtaaatattctgccataggaatacgtgtcgtacatgctttctcgattcaagaattcgtcatcacgcagtcacaggccgcgtctttgacggtgggtgtcccatatttaatccgctactctttattatcatggagtcgtatcaacgctatgaacgcaaggctgtgatatggaaccagaagggctgtctgaacttttgaaaccttgtgtgggatatgatggtggtgccgagcgcatgaaaggctagtatgaggcgagaaaaggctgagagcgctgtgcagagacttggtggtgcatagtggatattagtaaacttgcggagatgtgtctctcaatactgtggctttggtgagagagtgtgctgagagcatgatagcaaataatgtagaatgttttgcattcaaagacatccgattgtaggagacttaagtgaggttagttctaatacc

SEQ ID NO: 558370 - DNA, 189 bp, Homo sapiens
  misc_feature (8)..(8): n is a, c, g, or t
aggagtantcacagacaactgcagaatgtggaacactgagcaggacagctgacctgtctccttcacatagtccatgtcaccacaaatcacacaacagaaaggagaggagatattttgggttcaaaaaaagtaacaaagataatgtacgctgcatttacttttggttcattttgcagccccacactatta

SEQ ID NO: 558371 - DNA, 1402 bp, Homo sapiens
  misc_feature (37)..(37): n is a, c, g, or t
  misc_feature (1067)..(1067): n is a, c, g, or t
gctgagtctacaccatgatgtgtaggctagacatatntaaggctccgtacccattgggcatggtgtcatggtcgaccggcaggtagatgaacgtggttgatccattattcctaagaagatgattggtatgatgtgaaacgcacctgctatgttcaatataagaaatattgtgacatacgacgtctgcgtcaccaggagccctaaggaaccgaaaattgcatacatgaatggatctacaacggcgctccgtgtggtttcgacaagctgaggtcttgactagagtctatgccacgacagtgaccttgacactgttcgcactattacgacccaaactctcaacgctcgaatctaacatcgaacgaactgtgtcaagaggataaacaatacctggtccattgatcgtacaccattacgcacttgagcccatgtgcacctcgtactagcgcctgagtgtaccagacacacgagttggtgttcgcactgagctccaaaaaagaaaattggccaagaccacacattgcactcatagacaggctaccaaccgtaggagttgttcagaccgtaccggttaaggccgaaagtgggcttatcaacgtgtgcagctaatacgcatacttgggtgtgcctagaatgcttagacgatctatctaaccttctaactcagacacgcagacaaaagccaaattccaagtaattcactgagcgcacaggcaccccttctttgttactaggagcttccaagatcaacccataagcaagagattgcccgaacccgaaaccactacccccggcgcacaatccgccactgcactcggactagtgacacacatttcacattcaggaaccgcccccggacagacaccgcgttcgccacctgaacgcatcacttgtggaaccgtttttgcgacaacgacggcacagcgctcggcagttaccctaatttacaatacaactctcttggactttcacgccatcggtaaacaacggcccctgtattggggcgatataataggcacgcttaattgaaagacaactgcgggcattagaccccaacattccctcactgnctaatttccccttgcctaacccgagtgcgacttgagtagctaagacagcatgtgccgtaaggccaacgttcacaactagcaattcggcttcgctacatcgaatacggcacccgcgaaacgagttcttagcgcaacttctgggaggagacaagagcgcctttccccttcggcgacagccactatagcaaataggacctatggcagacgagcgcaagtgacaatgctagtcctcccgagacacaaacacggtgccacacgtcggttcagaaccgcaacgacatcgggtgcgtcctcaccccgctgtggactacgacacgctcggcatagacgcaata

SEQ ID NO: 558372 - DNA, 495 bp, Homo sapiens
gtgcaatgtagctctaggcctccaactccattctgatggacaggtgtccccatggcaacgctgttaaatatttcgaataatatcttagatgtaactgccacttgttttaacctctctcttgatatataacagatgcttgttataggtctagcactgtgctaagtcgtgtatgatacattagcatacatttcaaagtcaagctaactaagttctaagtgggtctgacaaatacagtactcggtaggctgtaattagcatgaacgagaagcatgaactgactgaggtttacgatgactaaagtttagttgggaggcgagaaagcatagcgacacacccactgtgatagggagctgtcccaagagggctatggtgagccaaccctatgactgctgtctactggtaagagagtagctggcatgaagtgtcttatcgaggctcttggtacccatcattgcctgtacttcgcagccatatgtgcatatgcccgactgtcat

SEQ ID NO: 558373 - DNA, 781 bp, Homo sapiens
ggttgctctacatggccgttcctgatgctggtggaccctctgatccgaaagccggatgcatacactgagcaagctgcacaatgaggaggagaatgaggatgctcgcgtctatggcagcagctgctgcatccctcggtgggaccccgatgcaaacacagtcctggagcgtgtggaaggtgcccatgcagcggtggaagctgcaggtgcaggagcagtcggaagacatgtcttcgatcggcacaagatgctctagctagatgggctggtgtggttgggtcaacggccccaacaccatgtgctgccagcttccaggtctgtgacatcatgctagggggctagcttctcccttccctcggttccagtcttccctttaaggagcctgtggcagtttttcctccgttctcccgtaatgtttagaaaatgttgtagcttgggtactggttgattagggaagagggatgtggtctctgatcgtccgattgatcgtatcttgaggtactacgggagttgaaagggagggggaaaggcgaggccagaatgggaatgggagaccattgcgacggcggccttctggagtgtgatgcgagctcgtctctcctggttccaagtcttgccgccttccatgctctgagtctttgggacatgtagtaaagcctatgggacgtagtaaacgctggggtcttcagcgaactcatgtgttctggggcagggaaaggccatggcccagacattcagcgatgtgtacctttcctgcagtggtactttatcaccagctccctca

SEQ ID NO: 558374 - DNA, 1229 bp, Homo sapiens
aaaataagtaaatgaagagagtaagattcttaagaacggctcagaaagatggatttttgcatgagacgcttctggtacaggccgaagctggactgtactgactgccatctcgggctcactgcaacctccctgcctgattctcctgcctcagcctgccgagtgcctgccattgcaggcacactggccaccacgcctgactggtcttcgtatttttttggtggcgacggggtttctgctgtgttggccgggctggtctccagctcctaaccgcgagtgatctgccagcctcggcctccggaggtgccgggattgcagacggtgtctggttcactcagtgctcaatggtgcccaggctggagtgcagtggcgtgatctcggctcgctacaacctccacctcccagccacctgccttggctcccaaagtgctgagagtgcagcctctgcccggacggcaacccgtctgggacgtgaggagcgtctctgactggctgcccatcgcctgggacgtgacggagtaccctctgcctggatgcccagtctggcaagtgaggaccgtatctgaccggacggcaatcccatctaggaagtgaggagcgaacaacaggccggacgcccagtcaaatgagatgagacgcacagccaagagcccaaagaacacgctgggaacgcgaggaaacgacacaagaacaaaacgagaacaagaaaggcacaggtcaaggacaacgccactggccaagaataccagaaccgacagagactagagagaaccacataggagagaacagaccgaacagacaggagagaaacacaaaaacaccccagcaacagagaccacaaacgagaacgaaacgagaagaacacacctcccacgcacgaaacaccaacagaaacaacgaagcaaaaacaagagagaccgcccgccaacgaacccatcccgttacgaaagaagaggcagacgacacacaagaggctcgagcgggcgacgccaaagtgcaagagaggggacgaagttcccacagaaactgctgagacgcaccgcagccaagtgtgaacgtcagaaaacacagcaagtacaaaaacactacaggccgagaaccaagaggcacagcacaagcagatccgggatgacagcgacgtaagacaagcagagcatctagcgcaaaaggagaggaaggagcacacaagcaaaacagcaatgatagagattaggacacagtaacagagtaac

SEQ ID NO: 558375 - DNA, 294 bp, Homo sapiens
aatgctttgatcgcgtagtccgttatcacacaggacaacagttattactaggaacatctcattaacgcgcaggaaatgaactccgtctgaacaatcctgcacgccatcatcctattcctcatcgccctcccatccctacgtatcctttacatcacagacgaggtcaatgatccctcccttaccatcaaatcaatggagcaccaatggtacgtggaacctacgagtacaccgaaaacggtggactaatctacaactcctacatacttcccccattattacctagaaccaggagga

SEQ ID NO: 558376 - DNA, 325 bp, Homo sapiens
gtcaggcagcactgcatctcttcatcactcagtcatccttccatccatttttcattgccacaatcaactcctcggcatcctcgctccatccatttcacaccaacccacccaactcatctcataacactcagcccatggcccatcccccttcatgcagcgggcgccagtgcattcatcaggctttccgctctcacagcattccccacatgcctcagccccacttcttcaccaccacaggccacacctcacaaccccttcataccccatcactcagttcattcatccgacaacccatccagagctcactccattccaacccaatcag

SEQ ID NO: 558377 - DNA, 489 bp, Homo sapiens
  misc_feature (123)..(123): n is a, c, g, or t
  misc_feature (134)..(134): n is a, c, g, or t
  misc_feature (201)..(201): n is a, c, g, or t
  misc_feature (204)..(204): n is a, c, g, or t
  misc_feature (282)..(282): n is a, c, g, or t
  misc_feature (390)..(390): n is a, c, g, or t
  misc_feature (400)..(400): n is a, c, g, or t
  misc_feature (408)..(408): n is a, c, g, or t
  misc_feature (437)..(437): n is a, c, g, or t
cctttttgtccagccctgggcttccccaaaacttgggttagggtgagattccgcctacacacgattctggccctccacctgcctccaggccccgaaatgggaattccagcattaagccaggcnccgggcaaaanttgggccttccccctcccttggatggggtcaaaaggccaggcctggcacattttgaagtgttttggntanaagttttcacctacacccacgcacccccccacccattatgttttttcaaaaatgtaatttattggggcccccccaagntgttttcctcacctgcccctgccctaccttacacccccagcttgatttttttccagtccacgtgtgtatataataatatttatatttttgcccaggtttgggtattgntcctgcccanaccctganatccctttcccctgtgtgtgtgaccatgntgggggagggggactttgcttggaattaaaaggttgcattgggtccctaaca

SEQ ID NO: 558378 - DNA, 391 bp, Homo sapiens
  misc_feature (53)..(53): n is a, c, g, or t
  misc_feature (93)..(93): n is a, c, g, or t
tgcattccattccattcctttccattccattacaattccattccgtaacattnccattccattacattcggattgattctattcaactccccntactctccattacattccattgcactcgggttgattccattccattccattccattccattccggatgattccaatccattgcgttccgttccattacattcccctgcactcgcgttgattccattccattccattccattccattccattccattacattacaattcgttccattccattctattccgtaccattccattccattccataccattccattccattccattccattccgttccattccgttccattgtcgacgcggccgcgaatttagtagtagtagtaggcggccgc

SEQ ID NO: 558379 - DNA, 316 bp, Homo sapiens
atgcagttaatcagacctcagacgataagggtgacgattaggacagaagtaaatgagactagaagtgagcatacatggcaataggattggcatggaggtaggactgtcatgagatcgatgagtgatgcaatgggcttgaggaaggggcctggcaaaatgatgagtgatggaataggactgaggaagaggcacgggcaaaatgatgagtgtaggtgatggaaatgtgaggactcatcacaatattccctataccctcatacatgttttgcaaatccccctgatcgagtgtgtgagtctgtattaactgcttggggtc

SEQ ID NO: 558380 - DNA, 101 bp, Homo sapiens
atcgagctcggtaccagatctgagttgtgaaagtctgtttatgctgctataataccaaaactgggaaatttataaacaatagaaatttatttctcacagtt

SEQ ID NO: 558381 - DNA, 1071 bp, Homo sapiens
atcattgatcctacttccttctaactctatgcagaagaactgctgaagactcgcagatggtagttcgacccagaccacaaggtgcgcagccacagacatcaacgagggaagattgcgcttgggtgccttgaacccatgtgttaacagttcgaccaagtgcgatgcgtgcatatgtgataatgggtcaaaagttccggcacattattggtgattgtcgtcgggctatgctgggacaagaaggcgtgtgtgcatctgccgagccgtcgcactgttccccgtcgtgaaatagtaaggtacaaaggtttgtgctccaatatgtctatacctctaaactcatcacaatcttcagagcatgagtctcgagtgctctgctatacagagtgtgttattagtgctctctgttttaggatgcgtatgtcctggtggactgcttcttgtaggcatgtgcctattgcttggatcttgaagaaaagtctaccagttgcctgtaattgtcctgaacgacaaataaagtgggtggctcgctttttctgatctctcctaatgtacatgaatacacatctatgtggtagtcatgttcgtgtcttactcatttactattgggggtaggtgtagataatcgttcaggtgatataagagacataactgaagttggttggtacacgggggctttaagaaatgcgtttgaattatgtgttgtcatggtactagcctctgttagattcgccttggatgtctgtgtcgagttgaaaacgcttggccaggctatgatcgtgaagttggactcgtgtcacttggctctggcctgcgtacttattgtgcgctgtggcttgcgttttgttcccaaaggcaaggctaggggaaaggacgacttggaggaggcggcctggaggatcatttgtgggttccaaacctctgagccaaaacttgcttgggggcccgcggcgggaccccattttagattcccggtccccgggtgggggcgcctggggccagcccccgtgttcaggccattccacgtgcctctctgggcctcggccaccccggggtttgttttccctcagcgggggg

SEQ ID NO: 558382 - DNA, 149 bp, Homo sapiens
agaacaggatgtcttccctgttggtgatcacacaacacgaccgaggttggctccaccaatcaccatacacaaattgcctgtatcaaatttgataaagttgattatcttgccagtccactatctcacctgtgcagaatctctgcacctcg

SEQ ID NO: 558383 - DNA, 367 bp, Homo sapiens
ctccaggtcggcatcttcatgagccatggccttgtctccagctcggccctgcaacctacagctgttccctgtggccccagagcaactgttctcgtggggtctcagggctctttcccagtcttagagatcattcagttcatatgtgggagctggaaaacagtggaacttatggagatggagactagaatgatggagatattcccagaggctgggaagggcggtggggagtaggggggtgctgaggggatggttaataggtacaaacataattacatggaaggaataagatcagatattcggtagcacaatagggtgactattgttaacaagaatttattgcatattttaaaataactgaaaagtggac

SEQ ID NO: 558384 - DNA, 200 bp, Homo sapiens
gtaccctcctccaccagctcgagtcaatgttcacagatgaacacgtgtcttgtcctccatgttgatggtggggatgctgtgcttcggaggaactagggtagcccagccatttagccggactcggtcaaagtctctgtaatcctcgatgaaggtgctgtaccacactcgtgccttcacagtcacgttggtgacaacggggg

SEQ ID NO: 558385 - DNA, 305 bp, Homo sapiens
gccagccttaacgacttagcccgaggagaggcttaggaggaatcaaaacagagtagcagttcagatgcccagagatcgaaagaaggctcgaatgagtcagctggaacagcaagtggtagatttagaggaggagacccaaaacttttgctagaaaatagcttttcgagagcaactaatgccttatgttgagaccaggagtaagcaccgatgggattgattccttggtgctgaatgggggagcgctagtgggttatgttcgcagtccgtgtttgtggtcaacgttatatctggaacattcgagaggt

SEQ ID NO: 558386 - DNA, 192 bp, Homo sapiens
tctctatcgactcgctggctccatcggtgggctcagtgtccaccttccagcgcatatggcttagcaagcggagtacgacgcgtcgggcccctccatcgtccgccgcaatgcttctaaacggcctctgcagctgcgtagcatctgctgcatgggttcattgagaatagaagatttgcccctagaaaatgctga

SEQ ID NO: 558387 - DNA, 142 bp, Homo sapiens
cttcgtataacctgcaggaaaacatgcctaaaaattttgagggcccatctaaaactttaatcagtaaaggcttctgaatacatcgtaaaagaaaacaaagcatttctgaggcgtcctttcaataaccgcggaagtatgtagt

SEQ ID NO: 558388 - DNA, 163 bp, Homo sapiens
tttgacggtcccccagctctccttgcctcacaagtttcggctccattaattcgccgtcagctctcacatgaccacgaatcttgttgtgccctcctagcctgtgatgctcagcccaactcagagactcgacagatcatcatcatataatgatgggtctggactg

SEQ ID NO: 558389 - DNA, 1345 bp, Homo sapiens
  misc_feature (1168)..(1168): n is a, c, g, or t
  misc_feature (1345)..(1345): n is a, c, g, or t
gcgattagtactcatactatcataaggtcgtcccgcaatctccgcgaggcgcacacggaaccgaaggactatataagcgatgagagagtaatgcgaagagcggtcgagcgagatcgaacagcgaaggacttcactcgttgctactactatcaatcatagcttccaacaatcactttgtgccttgcgctcgtacaatatgacgcgacccaccctgcgttttgttctcacgatgcatacaatggcaagaggacggatacgcacccgatatgggtagcaaactctggggctgtaatccgtagcgggcaatcctcagggtgcttggccgcagagcttccatgtcatgggagatatatgcctgcaccatttgccgttgcggttgacaattctcgtgcagcgttgtatacatgttcagttcggtacgaactccccatgttacatacgagaaacccaattcgtccaagatattggccaaagggacacagacacaaccacggtcagtcaaaggagaggaccgtacctcgtaagccttgaattttcccaaaccactataaattggggataggaacggcattgggtcctttaaaatttcaattattgaccgaatttgcacttcattgtctctggaaactatatttcgcatgataccttaaaactataaacattcagcaactatactcatcacaacgacgatcgcaacaacaataaacatcattttactcgcaacacaaagaatgctctttctcggttacaactttccccatttacccgcccgagcacgataatcctataaccggccaccccaccttttttgaaaagccaccaacaccgaattttccttggaattagcctgtgcacacacaacacatcaaggacgcttccactttcttgccacccaagttcaggaacaaacaacctttcgaagatttcccccgcaatttgagaggtttggccccgacaacagagtacaaccgatgggttactcagcggagacaacactttcggacactctgggccgatctaaacattcaatttgctatggaaaccaagcatgcagaagcttattatagtacgaaacgagcattaggtatcatgacatactttcggacgcgcgcatcaacaacacgcggcccagattaaccagcgacttatataagcgcgccacctcccncggtggagccaacttgtcgaagatatggcttgattacgcctcagctcacagcacacacctctgtgtgtaaaaagtgttatcccccacaaggcaatcaacccgttctatgagaggacggatacgcacgcctataggaaaggtgtggccgaacactggagggaaaatacattaccgacn

SEQ ID NO: 558390 - DNA, 523 bp, Homo sapiens
acagagcaagacaagtgtgtacttaggcttctttacttcagtcttctaggctctcctagtagctgtccatttagaattcttatatttctccttgagagctctttgaacttccatggaattagagagcaactttagtgagttgcacatttgcatggcatagtttaggagtctcagcactgcatgcacttacaaccaaagccctgttctgatcaaataatccatagttgaccagatttctggcatgtggctggaagataatggggccagctggcagtcttcttgtggtttaagtgccatattggaccacacagtacctttcatcccaggctattaatcttagaaattcaacttctaatcttagacgtcggaaatttctttggtggagcagaaagtggaaaattgattcttgtagatgctgggcaaagattgccaggaataactagagaactggtcattcactttgcctgctcttctggttggtcaactgggtggtcgtgagcccctatttaggcatctatcctat

SEQ ID NO: 558391 - DNA, 123 bp, Homo sapiens
tcacgggtactaggctaggagagcagcgggtaggggagcataccgggccagccgaggggctaagtagccacaaagcccacaggtagcacgcgtataccctagaagcagcaggtagcggttaag

SEQ ID NO: 558392 - DNA, 271 bp, Homo sapiens
gatcccactctgcaaggcgcctacccaccagattatctttaaaaactctgatcccacccagcatggtggctcacgcctgtaatcccagcactctggaggctgaggcgggtggatcacaaggtcaggagatcaagaccatccccactaacacagtgaaaccccatctctaccaaaaatacaaaaaataagccaggcgtggtgtcgaacacctgtagtaccagctactcgggaggctaaggcaggagaatcacttgaatctgggaggcagaga

SEQ ID NO: 558393 - DNA, 354 bp, Homo sapiens
  misc_feature (158)..(158): n is a, c, g, or t
gtttggaaaaggataaggagtgggctccacaccccttggatctccctttgtggaaaaaaccccggggtcctcctgccccccccaggggaggcccaggatttttattttaaggatgtaaatgtgattccagcccccccctggccctccccccttccggntggtaaaaaggaatgtagtcaggcccctttcattctgtgagaccccctggaaccctggcattttttagccccccaaaggggttttgggcctagttgtcccccctctggagccccgtcctgtggtttgccccagtttccccccctaaaaaaaaagggtgttttccccccccataaaataacccgggtttgggcccca

SEQ ID NO: 558394 - DNA, 183 bp, Homo sapiens
gtggcactgcatgtgtatttagattctccttctatattattattattattaattatcattattattgagacaggttctcactctgtcacacaggctggagtgcagctggtatgatcacagtctcactgctagtcctcaaccatccctgggattcaggttgatccttctcacccggatcgggga

SEQ ID NO: 558395 - DNA, 129 bp, Homo sapiens
agtaggggagagaggcgaatctacttaagcgttgcaaacgtagtaagtgctctacttgctgtaggaacaaagtgctgtagtgagggaatcactcccaagtaagtcggcgtgattaagtctatctagggg

SEQ ID NO: 558396 - DNA, 193 bp, Homo sapiens
ttgtggtgtgcaattcgggtggatttgatggaggaaaaagcattgcgcactggtttaacaatgtggggttgatgtgagacaaaaaaatggttgaccagatgaattgtatgtgcatcagtgttgaatcctgtgattgttcatacattcacagcaaaatgcttctggaacttcattaatataatggaaatgtgta

SEQ ID NO: 558397 - DNA, 112 bp, Homo sapiens
tcgaagctccagcctacttatgtcatcgtcctcgtccagcaagacggccttctcccgggcctcgtgcatgccgatggtggcccgcatcgctgtgctccgtcggggtgtcggc

SEQ ID NO: 558398 - DNA, 129 bp, Homo sapiens
gtatatttctatatacatatactaggtaaaaccattacagatcaagatatagaccattcccatatactctaggatcccattccacctcttctagttaatatccctcctatcaataaagtagccacagtt

SEQ ID NO: 558399 - DNA, 249 bp, Homo sapiens
tggtcgagagaattaggcgtacccgtcgcagatactgatcattctatttccccctcattttgatccccacactccaatatgtctcatcatgcatccgacgtaatcagccagtccaatcaagtgtctatacttaaactatcctctagatataaatgataaccatacacaacactaaaggacgaacctgatctcttatactagtatccttaatcatttttattgccacaactaatttctctcggaccaatg

SEQ ID NO: 558400 - DNA, 963 bp, Homo sapiens
tacccttctgcgtccttgtgcatcatgcactggaaagtccgtggaggcttggcaaagtcagggacaagctgagcgacatatcatattccgcttgtcgcaagtaaagccgtgatgatcccagagtgacctctgttgatgtactgccctgggcctcctcagcattcgcgcgacggtgcacgctagcggtgtgcccaagtgtgatcacggctggtaactcagaaatggagggctagttgcgcgggagagacgctgatggtgccgcctagggcacgttgctcgtcgcgcatcctcgcgaagcgctcgcgcaggcattggtaggtcccgttggcaaggtgcgcgaagttcccgttcagagtgctgtatctatctctgtgtcgttacactttctctgtttggacagagtctagtatgtgggatagcgttgggaaagcacacatgtgtccgctaaatgggtcctggtaccaacaaagacaggcgcggctgtgagactttgtgttaggcacgtcaacgtagctagggaagtgatctgttgatgagatatgtgcagcgtcttgttgagttcagaacattccttcttttactggatcacagaccacagtgctcgattccatttctttcctttttttgtaaggacttttgggccccaccgtgtttttcctgggccattgataccatatataaaatatactacgatatacaactactattatgcagtacgtattgctccgagggtctcgtacacccatggagcgggttcggatggccttgtaaccaccccggcgctttactggacatactgtcctcgcgaggactcctctgcagtgccaaacagcttccccgacatcagcgtaggcactaacggcctccggaccgcccgtacatggagcccgcctcacatagagagtacggccgcatcccacacaactgagaacttgacctcgaggcgcaatccgcctgaatgcc

SEQ ID NO: 558401 - DNA, 104 bp, Homo sapiens
tgcaggaccatttcaaaggcacaaagcaaagatggcacgatgctcagataggacatccagggtggctgctccagcaggtgcaagcgcgatggtcactgagtatg

SEQ ID NO: 558402 - DNA, 889 bp, Homo sapiens
  misc_feature (3)..(3): n is a, c, g, or t
  misc_feature (180)..(180): n is a, c, g, or t
  misc_feature (182)..(182): n is a, c, g, or t
  misc_feature (184)..(184): n is a, c, g, or t
  misc_feature (187)..(187): n is a, c, g, or t
  misc_feature (193)..(193): n is a, c, g, or t
  misc_feature (205)..(206): n is a, c, g, or t
  misc_feature (208)..(212): n is a, c, g, or t
  misc_feature (233)..(233): n is a, c, g, or t
  misc_feature (248)..(248): n is a, c, g, or t
  misc_feature (256)..(256): n is a, c, g, or t
  misc_feature (263)..(263): n is a, c, g, or t
  misc_feature (265)..(266): n is a, c, g, or t
  misc_feature (270)..(271): n is a, c, g, or t
  misc_feature (273)..(273): n is a, c, g, or t
  misc_feature (275)..(275): n is a, c, g, or t
  misc_feature (284)..(284): n is a, c, g, or t
  misc_feature (288)..(288): n is a, c, g, or t
  misc_feature (297)..(297): n is a, c, g, or t
  misc_feature (305)..(305): n is a, c, g, or t
  misc_feature (309)..(309): n is a, c, g, or t
  misc_feature (311)..(311): n is a, c, g, or t
  misc_feature (315)..(315): n is a, c, g, or t
  misc_feature (321)..(321): n is a, c, g, or t
  misc_feature (332)..(332): n is a, c, g, or t
  misc_feature (335)..(335): n is a, c, g, or t
  misc_feature (354)..(354): n is a, c, g, or t
  misc_feature (363)..(363): n is a, c, g, or t
  misc_feature (382)..(382): n is a, c, g, or t
  misc_feature (389)..(390): n is a, c, g, or t
  misc_feature (393)..(394): n is a, c, g, or t
  misc_feature (411)..(411): n is a, c, g, or t
  misc_feature (433)..(434): n is a, c, g, or t
  misc_feature (439)..(439): n is a, c, g, or t
  misc_feature (447)..(447): n is a, c, g, or t
  misc_feature (465)..(465): n is a, c, g, or t
  misc_feature (501)..(501): n is a, c, g, or t
  misc_feature (508)..(509): n is a, c, g, or t
  misc_feature (541)..(541): n is a, c, g, or t
  misc_feature (543)..(543): n is a, c, g, or t
  misc_feature (651)..(651): n is a, c, g, or t
tcnagaacaaaggctaagggaagcaagtttctttcattttattttaagaaggacaaaaattgttattaaaacatctacattattatcaagatactagaaccttatgaatatttaatattaaagtgtggtattcttaaatttttaatacacagacattttaaaggaccattaaattgattncngnccngcgtgngaaatgcagcanncnnnnncgcccaccccgaccccatgantgaaatgaaatctanaacctgcntgcaggncnncccnngngngccgggttnggtnctctgggcntcccggcntggngntctngggggntctctgctggnttngttgccctcgtctttgggngggtcttcntgtccctcctccccatctngctctgnntcnngctctctcttcctttcnctgtggggggtccggctctggnnagggnagggggcnccaggtcccgggggtccntgggcaggtgacggggtgggggtgggggctctgggnttgggtnntgttcttttcggcgggggggcggattcgggtngncttctttccctgggcgctcccgctctgtccgcactcggtgggggtggtctgggaggctagcggagttgggcctggggagggtggctcctgtccctggctgcgcgggtnacctctgagccatggctccagtccctgtcaccttgcaaatagtccagtggcccctgaaaccctcctaatcacacaaggatggctgcattttctggccaaattctttatctttagccctcataaaagtgattccttggataccacacacatatataatattatatagagcgatatatttaatacctgtgtatatatgcatcacgggggcgacatatatacacactagaaacaaggctgg

SEQ ID NO: 558403 - DNA, 448 bp, Homo sapiens
cacacacatatatgtatgtatataacattttttatccactcattgattgatgggcatttgggcaattgtactgctatatacatgcatgtaacaagtgtcttttttgtataatgacttctttacttctgagcagatacatagcagtggggttgctaggtcaaatggtaggtctacttttagttctttaaggagtctccatactgttttctatagtggttgtgctagtttacattcccaccaacccagtaaaagtgttcccttttcaccatatccatgccaacatctatttatttattattattttttgattatgaccattattgcagaagttacatggtatcgcactgtggttttgatttgtatttccctgataattagtgatgttgaacatttttccatatgccctcgctggccattgagacaaataaacttaaatagtttataaaaa

SEQ ID NO: 558404 - DNA, 95 bp, Homo sapiens
tctggccttatagttttctttaataccaaatgggccccttatagttttctttaataccaaatgggcccctttttataaagaaatttggcctttga

SEQ ID NO: 558405 - DNA, 285 bp, Homo sapiens
  misc_feature (46)..(46): n is a, c, g, or t
  misc_feature (77)..(77): n is a, c, g, or t
gttaggagtagaatattgattactattcataattcagcacttaaantatgagcaggcatcataactaaaccttccanctacatattcacttagtcctttatcatccttaaaacaattctggtgacataccaattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaa

SEQ ID NO: 558406 - DNA, 648 bp, Homo sapiens
catacaccagcgggacaagacatatcggaggtctgcaatgcgactgatggctcgcttccccctcacctccacaacctccccctttccaatctggcaatcccaggctcacatgattcattcagctactgggtggatgaaaagtccccagtggggcctgaccaaacccaagctatcaaacgcctcgccaggatctccttggtgaagaagctaatgaagaagtggtctgtgactcagaacctgacatttcgagaacagctggaagctgggatccgctactttgacctgcgtgtgtcttccaaaccaggggatgccgaccaggagatctacttcatccatgggctttttggcatcaaggtctgggatgggctgatggaaatggactcgtttcttacacagcacccccaggagattatcttcctggatttcaaccacttctatgccatggatgagacccatcacaaatgcctggttctgcggatccaggaggcctttgtaaacaagctgtgcccagcctgcagtgtggaaaggtttgacgctgcgaactctgtgggagaagaactgccaggttcttattttctaccactgtcccttctacaagcagtaccccttcctgtggccaggaaggaagatccagcgcctgggcaacac

SEQ ID NO: 558407 - DNA, 337 bp, Homo sapiens
gcgaaagcatcagagatacacagaagacttggtttctcgctcctttatctctgtacggtacagtacgttttggtttacaaccagtgagtacatactattaacaaaatccctcatgcaacttgtagagaaaattttctttccttgaagctggcagtgaaaaatgaagattcatgtcattttctttgtgcacacccctatgcgcttcttcctgtcagattcttccctaagtattaagagaaataggggaaagccacagagcacgctggatttcaacaagtggtcttgtctttttaaagtacaacacttcttgaacaattagctcctggctgtagagacc

SEQ ID NO: 558408 - DNA, 385 bp, Homo sapiens
attgatgttctgtagcaagcatgatggctcactcatggtcagtatacacatatggttttcactcatgtacccttgtaaccaaatttctaacacttgtttccttaaaaactagtggtggtaccattaaaccataacctaatcagggtgttcactatgcttccacactagccagtcttctcacacttcttctggttccaagtctcaaggcctgcacagacagcaagggctgggcacgattttctctcttacacaattcagccttcagcaacttgcagcagcttccttcaggtggtcaagcaccagagctgtatctgcaggtccgtacgcctcgagcagattggaatatctccccgtgatctcggatctacctgtcaaagatgggtca

SEQ ID NO: 558409 - DNA, 112 bp, Homo sapiens
ccgtggtcgtggcttgtggttgaccggtggttgggttgacgtgcttgtgggttgacgtggttgtgggttgacgtggcttgtgggttgacgtggcttgtgggttgacgtggtt

SEQ ID NO: 558410 - DNA, 858 bp, Homo sapiens
gagattctctgtgggaaaatgactgtcaataagaatgcgggtttctgggccaagaaaaaaaaaaaaaaacaaaaaaaaaaaaaaaagaagaaaaaacaaaagaaaaacaaaaaaaaaaaaacaaaagaaaaaagaaaaaaaaaaaaaaaaaaaacaaaataggagggggacgcaggcggcgcggcagagacaatgaaggatatatgaattccgaggagggcagggagacagcgacatacacatatgaagggtaagggaaggaggtagagccaacagggatacctcgaacatacaaggcaaatagggggaggtccaagagaacaaaagagaggtgaggagctgccgaacaccacatgacataaacatcagatgcgcggcgggcgcgaggaaagcacaacaagtgatagaatccgaaagacaacaagaaacaatacaccgtgacaagaccccaaggaagagagagaatgaaaagtgcgacggtagggaaaaacataaaaaagaaagcacgagatggaacaacaggctcaaaaaacaacaaaacaccacaaagtcatgagaaaagaccatcgaacacctgcacgcactgtgacgacgcagtgaaaggtcacaagaaaacgacaatactaggcaaaaaagagaatacacaaccgcagcaaccacaagaggccaaactaaagttgagagcacagaaacaaactttaaacccacggagaagaagaaaagccccagccaaaaagtagaagacaccaataagcaaaatacttactcacatacacagaaaaacaatcggacacaaaatagagcaatacaaggaagccagagtacaacgaacgaacaataacaaaaggagtagacgga

SEQ ID NO: 558411 - DNA, 135 bp, Homo sapiens
  misc_feature (6)..(6): n is a, c, g, or t
  misc_feature (14)..(14): n is a, c, g, or t
ttgcgntccatagntggtggacatggtgaatgacggcgtggagacctccgctgcaaatacatctccctcatctacaccaactatgaggcgggccaggatgactacttgaaggcactgcccgggcaactgaagcct

SEQ ID NO: 558412 - DNA, 119 bp, Homo sapiens
tcagtatttcgtcagtacatttaaaaacttacagtacagtgaattcgggtgatcagcattgtgccaacttaactaccacttgtgtagaaactggcagtcaatttctgtgcccatttcaa

SEQ ID NO: 558413 - DNA, 416 bp, Homo sapiens
aaaagttcaagtgctcatataacacaccacactgttccccctttcctacagcaatatgttcactatgttaccttaaagcaacttgtgcttcaatagtggaatctactttcattgttaacactgagctaaagaaagaaaaaaagccgtgtgttttatgaatgaccttatctgtttcctggataatacctttaagaataatgtcctgagtcaggcgtggtggtgcgtgcactctagtccaactatttggaggctgaggcaggaggatcgcttgagtttaggagtttaaagctgacgtgccctgtggttgcactgtgaataactgcactccagctggcaacatagcagactcatctcaaaaagaaacaaaacaaaaaggaattgatgtctgtagagattggcctttaccttaggatcca

SEQ ID NO: 558414 - DNA, 667 bp, Homo sapiens
  misc_feature (667)..(667): n is a, c, g, or t
gatatctatgaggaccggcacgatggtgtcccgagccacagctcgcggctctcccagctgggctcggtgtcccaaggaccctactcgagcgccccgccgctgtcccacaccccgtcgtcggacttccagcgctgcccttatcgttcccacgcccccgtagccaggccgctcccctactcgaccagagtcaaggacctctatctctcagggtcaatgatccctagtccctgatcccactgtggcaggcccagtctaagcatcccatgggggcgaactggcatcgtggcctcgaatgttggcgcttcgggaacgccggggcctctcgtcctgcaccctgttcccttctgtggctcgccctttggccccgccagtgctcctcgggggccctttggattccaccctgtgaatgctttgagcgtgaactcacctgcggggttcaccgtctcgggccgcagcgaaccgcgttggccttggccttggccgacttctcccgcggcccgccgaaccctaccgtgggagccctttgttgtcatcgcgaccagccgcgggcgacttggggcggttgagaacacgtgggcccttccgtaccgtcgctaggccctcggcggcccttttcccgcgggcccaatttccccctggggtatgcattgggtaataggggcacccn

SEQ ID NO: 558415 - DNA, 130 bp, Homo sapiens
gattagaagagaatggaaaactcaacgtagtggtcttaggtcaagaaacaaatgtagtgggaataaataaataaataaataaataaataaaagaaatacagcctgggcaataagagtgaaatccatctca

SEQ ID NO: 558416 - DNA, 363 bp, Homo sapiens
  misc_feature (1)..(1): n is a, c, g, or t
  misc_feature (4)..(4): n is a, c, g, or t
  misc_feature (10)..(10): n is a, c, g, or t
  misc_feature (67)..(67): n is a, c, g, or t
  misc_feature (81)..(81): n is a, c, g, or t
  misc_feature (91)..(91): n is a, c, g, or t
  misc_feature (101)..(101): n is a, c, g, or t
  misc_feature (114)..(114): n is a, c, g, or t
  misc_feature (117)..(117): n is a, c, g, or t
  misc_feature (119)..(119): n is a, c, g, or t
  misc_feature (145)..(145): n is a, c, g, or t
  misc_feature (156)..(156): n is a, c, g, or t
  misc_feature (201)..(201): n is a, c, g, or t
  misc_feature (229)..(229): n is a, c, g, or t
  misc_feature (232)..(232): n is a, c, g, or t
  misc_feature (237)..(238): n is a, c, g, or t
  misc_feature (254)..(254): n is a, c, g, or t
  misc_feature (287)..(287): n is a, c, g, or t
  misc_feature (293)..(293): n is a, c, g, or t
  misc_feature (321)..(321): n is a, c, g, or t
  misc_feature (348)..(348): n is a, c, g, or t
  misc_feature (361)..(361): n is a, c, g, or t
  misc_feature (363)..(363): n is a, c, g, or t
naantcactntcccgtgtgtcaagacatttctctaactcctgccattcttctggtgctactccgtgncaggggtccgtgcngcagaggacngtctggaganggtattagcaaancgnanggctgagaaggaacagggaacattgnagctgactgtncttggtaactgattacctgctaattgctaccgagaaggttgaagntggggaagcctttgtataatcccacccnccncacgnnaacgatgaagttatgntgtcatggtccgttctggaagtttctggtgccntttctnaactgttacaacttgtatttccaaaccnggttcatatttatactttgcaatccgnataaagataaccngn

SEQ ID NO: 558417 - DNA, 256 bp, Homo sapiens
tataacactatcatgatcattatccaccagcccccaacctttttggccatcaagggctggtttcgtggaagacaatttttccatgggcatggttgggggtagtttcatcaggcattagattctcataaggagcataaaacctagatccctggcatgcgcagttcacaatacacttgactcttctatgatactagtgccaccactgatctgacagaaggcagagctcaagcagtaatgctgtcttgcccgccactca

SEQ ID NO: 558418 - DNA, 456 bp, Homo sapiens
agaccatgaactcaccaacctgctgggagggatgaacaactccggacgcgccacgtttatgaactgtaacaccacgaaggtctgcagcttcgctcctgaggccagcacgaccatgaacccattagaaggaatgaacaactccagacgcgctgcccttaggagccgtaacactcactgtgaagctttcacaggatcactctggctgctgtgttgatcctggactgtcagagtacaaaggtagaggagacattgcggtgatcccagggccctggagagaggagtggcagtggaactgatgagaggtgctcagatgctggagagaactagagtgacttgcccaaggtcacgcagctagtcagcaggagagccagggaaaaccccagctgacatcttttcttctggagacagtagaagatgacgtctttggagggctcttcaaataaagtatgatgcaaa

SEQ ID NO: 558419 - DNA, 162 bp, Homo sapiens
tctttacaaattttttttattggaaatgtgccaaataaaatataaaaaaagaacgggtgactcactttatacccaaactgtatactttacaaattattaaaaattatacccaaaacttgtggtttctttatatacattgtggccaataaagcttaatatacc

SEQ ID NO: 558420 - DNA, 363 bp, Homo sapiens
  misc_feature (84)..(84): n is a, c, g, or t
  misc_feature (209)..(209): n is a, c, g, or t
  misc_feature (239)..(239): n is a, c, g, or t
  misc_feature (286)..(286): n is a, c, g, or t
  misc_feature (302)..(302): n is a, c, g, or t
  misc_feature (318)..(318): n is a, c, g, or t
  misc_feature (332)..(332): n is a, c, g, or t
  misc_feature (355)..(355): n is a, c, g, or t
  misc_feature (362)..(362): n is a, c, g, or t
tttttatatttttagtagagattgggttttaccatattggccaggctggtctcaaactcctgaccgcagtgaatccacctgccntcagcttccccaagggctgggattacaggtgtgagccaccatgcccagcctatttgtcacattatttgtcacatttattttacttttatttattttttgagatgaaatttcgctcttgttgcccngggtgggagtgcaatgggtgcagccttggnttcacttgcaacctccgcctcccagggggtcaaggcaattcttcctngccttcaggcctcctngaggtaggctgggggnattaacagggcatngcaaccacccacaaccccagttnaattttng

SEQ ID NO: 558421 - DNA, 1732 bp, Homo sapiens
  misc_feature (1588)..(1588): n is a, c, g, or t
tgtttctgcgggggagagagagagaaaaaaacctctctttttccacgcggggggggggcgggcgcgcgcgcggcccgccccccccaaaaccggcgggagacgcaggcttcgcgggggggcgcgcgcgcgaccctggggcgacctcgggcggcgcgagggtgagagacagcccgcgggtggctggggagcgagagagggcgcgcggccgctcccgccgcgcggggagagagagagagtgtatcgccacagagcagcgggcggcgcgtcccgcgcgcgaagcagccgagggggaagaaggggtgtccaacacacaagtgtgtgacgcgagagcgagcgcgtctctctctcgcgagagagagcgcggagtgacacgcgcagcgcgcgagcagagagagcgagagagagaaccacaatatgatcactcgcgcgcgagcgacgagcccaaaaaagagagagggcgcccgcgcgagcgactctctctcctcgcgcgcgggtcggccccaccgcgcgcgcgacgagagaagagagagacgacgaccacgcgcccccgcagagagagagagcagaagcaactatcaccgcaccgccgagcggcgagagcgcgctgcgctatcctgctggtgccgagagagagagagagcgcgcgcgcgcctgcagaaaacaccactcgcgcgtgagggcgcgcgtctctgctgagcgccgacccccgccgaccagaagagacggggagaagatgctcaagtgtggagagggagcagcactcccgccgcggaggaggagaggaagcagcacctacccacacgtcgtgatggaggacgaaaacgaggaaggctactccaccacaacaagaagaagaagagcagcaccactcctcctcgtactctagggtggaggatgaagtgaggacgacaaaaaaaagagaggagcgcgcgaagcaacgaagaagatcacaagcggggacgagacacgacaacccaacacgatcacaccgaccctgagagagagagaagacgacgccgcacaccacagaagaacaacacgagctgcgtataacacgacggccgcaaaccaaacgagataagagaccccccacccaaacaaaaaccacactgcgcacctacgaggccgacgcagcaaacaagacatacaaaaaggaagaaaaaaacaccgggcgggcacgacaacgaaaagacaaacatcacatgagcgaaccaccgcccgagagagaaatggaaataacaagatcatcgacacaaaacacactacaaacacgcacacagcggcgaaccactcacatcaggcagcagcgagcggcgaacaccacacgcccagcagaaagaacgaaccctacgagtggaaacgcactaagggaagcagtacgtccacaaacaaagaacaccaacagcagctggcggacgaggaggcagagacaagacaacataagtaaaaaaacaacaccgcgcgaatgggtaggaggcaagagctgtcgccaaacacaacagaccaaacagagctatagtaggacaaaccacccacgagtgtataagttgcgatatctcgcgtggctggctcgcctagctctctctancgacgggaggccgagacaacacagatacacgcaccaggcatggactagctagagcaggcgactaacacacacaacaagatctgtgacctaaatctagtcagggtgatcggcggcaagtacagcacagccagagctgagtaacgc

SEQ ID NO: 558422 - DNA, 1185 bp, Homo sapiens
taaagggaaggtagagctagccaacatatcacattctggaatggaataaataactatggccacaattatggtttcttatagctatggtgtgggtttctggggtcgactggaaaacctaccattggcgttttctattcatctttataatgggactttcagaagtggctattagacaaggcccctaaccacttggggatcctttctggtgttggcgtggcaaccataattccttaaaaaaaaaaaaaaaaaaaaaaaaaaaaaaaaatcccccacggggcctctgggagacacaacgaaacaaacaagaggggagcaaataaaaaaaatccacaaaggtcgcggcgcccatgttgggcgaaagagaaaacaacacgagggggcgaccgggggggcaaaaagggagaggacacaaaaaggtgttacaacacaacaccggggagaaccacacacaccagtggggggccacctggggtgggggggagcaccacccccctccaaagcgggaagagcctctcgggggcaccaaaaaagagggaggggcaaggggaagagaacacaaggggggtgcaggaggggagagagggggggggacaaaggggaggggccttgtgacaaaaaaaagggtcgaagggcctcaaaaaaaaaccggggggcaccaaatgagaacacccacaagggcaaaggcgctaaaaaaaacccagacagaggcgacccaaaaaagctacctctttcaacaaacggggggcgcccaaaaagggtcaaagtagagaaacacacaaaaacttgcgagcaacccccggggagagaaccccattttcccaaagcgagaaacatatgtgagacacacccaaaacggggggcatacaccgagtgggccacacgacggtcggcgtaaacccgataaaaacaagtgacccaccaggggggtatgttcaagagacgaaaaaatgtaaacaacggctaactaacaacacagtcagaaaaagggagacagaaacacgagcagggggcaccaaaaaaaacaaccgtcttatacaaccaaaacggggggccaaacggagacccccgttacaaagagcaattgccacgagacacaacgaaaaaacaaagtgccgtggggaggacacaaaccagaagaaaacagcagctacaagcacgataagaagatacacaacaacaggagat

SEQ ID NO: 558423 - DNA, 136 bp, Homo sapiens
ataatatagacttagagtatagtaatcaacgagtggcaaatatttcttgtctctgacattattatttgtagacaagacaaatccatgagaacaggatactacactaaacttagatgaacaattgtgtaaactataa

SEQ ID NO: 558424 - DNA, 957 bp, Homo sapiens
gaggaggtggtggctgcgttgggctccgggaagccgttcgggctggggctgtcggcgcggggcggaggcactcgcgcggggggatggccactgcgatgaccttggttcagctgtccatttcctgtgaccatctcattgacaaggacatcggctccaagtctgacccactctgcgtccctttaacgaacgatgtgggagggggcagctggcgctgagcttggccggactgaacggggtgcaggaactgctcaagaccctgagttcatccaagactctacatgcttgaggtacctgctttgagaacgagtccagaagctacgcttttggaatctatgacatagacgaacaagacgccagagctgaggggatgatgacattcctagcggggtgctgagtgttccctagcgtacagaattgtgtccaagcccaggtactgactctccccttgcatgctgataggcctggatgaacactgctggcgctggggggaccatctacggtctcagctcacggaattaacggacaactcgtgtagttaaccatggaggtagaagggcacgaagacctagatataggaattggccttcctgggaaaactctggagtccactttcatgggagcttctccccggaacacggatgatgggaccaatgggcaccgtggtgtaccatgaatctggaggtcatcaagaacaagctgaaacccattcatggaaggcgttctcaagtccccgggcacggatttatgtggtgggaacccccaggacatcagtacagtgtgacaagcgcccgagattacagtgcgcggtacaaatgacatatcggtacgttcaaacagggtggcaacgcttgcgtgtggaccggcgggagttgaatgattcacatgaacttgcggacggcacacacagtacccagcgttgcaccacggccagatgtgggtacagaaggctctttgaca

SEQ ID NO: 558425 - DNA, 117 bp, Homo sapiens
cgagctcggcccttgtaattgggcacagaaattgtgagtcagactggtagtgtgataattaataataagaaggcaatcataaatttataattttatcattgcccttctcactagggt

SEQ ID NO: 558426 - DNA, 644 bp, Homo sapiens
cggcacgagcatagaatggctaccagttgacgccatgattgagaactctcgtcctccctctcattgccatccgtcctggtactgcagtcaaccatagatggcaatgacttacctgcaccgattaggaagcataggacttagagagatggctcagttatatggtacaactaacgctacacctacgggtgatgtatacagatgactatgatgcatgtatagaagctacttgtactagatgatgacatacatcagtgtcaatgtactgaattcaagaatgagttctagcaaggcattcatgatgcacatattagcgggcaggtgaccataaacttgcatgcacgcatagctgctatagtacggagaatttgtgggtcgacttcgatggtgacatagtaccacgcctagataaagaggaattattgagccattgctcacctctaatggaatcaatcatgtgctgtagttaaacgtagaaagatcctgtagagaatgatagtagtgagtacttagacattcttaaattaggacacgtacgatgcatatgtactagctggagatatgagttatgtaccatgctgatgctgtgaacaggatgcagcccgtatgaatcagatgtcaggtggaagcacagtatcgatgatcag

SEQ ID NO: 558427 - DNA, 366 bp, Homo sapiens
agagtgtctatattggataccgaggcgtattggtatccagcctctagcagatggtcgacgacgccggatccaagcagagcagtgtagatgtcttcgtgacccggaggacaccactcgagggaggagtccttcggccactcaaccggggcgagggtctcagcgtcgagcttaggctcctgatcctgcaggaagtcgagctctaggccgtcgacagccaactctggatatttctcgagggccttgagggtgtcctcgcgggtattgaaggaattcatgaacatcagcggcaatcgagcgccgaaagtcttgcgagccgagagcacctgtgtagcgatgatgtcgaggaaggacttgccgtcacgaact

SEQ ID NO: 558428 - DNA, 171 bp, Homo sapiens
ttggctcggccccctcgggggtacagttgtccttcggagaccgagtggtacacgtggcccgcttcacatcctcacaccctgccacctctagcggattcttctgggcgtccgactgccggtcatcactgctacctccttggactactgctcgaatcagctcgttaagagccg

SEQ ID NO: 558429 - DNA, 1964 bp, Homo sapiens
  misc_feature (1272)..(1272): n is a, c, g, or t
ctcgagctccagcgtcggctgaccagatgtcatcaacaccaagtgcatcggcggtgcgcactcgtcaggccctctgctgcaagatgtccgctggagtatgacaagattcacttgagctccgggcgcaacgtggctttctgccacgctggactgactgcacacaattactgctgaatcgacaagagagcactccatgacaccctagcctcatcacagactcatcatcaccctctagccaaggacccgtcttacgcctggagagccggtcacacaatgccatggtaatactagacacacattttgaagtgaccaaccggaagacgtggtgttcccaagcggactggagccaagaacaacctaggttgaacccaacacaccgtatcaaacacttccactggggatatactccgcacatacacccttgctcaattgtgatacagctccccaaggtgagagtcaaattaacatctgtggacacccatatcacatcgcttccacacaaatacagcacccactattgtgacacaacgaaatacacagatataacacactgtaaaggaaccaacacaatgtgatgacgatgcgccccacacagacacctatttagtcgcagaacaacacgtgacctgtatacacataatggaacatgaacagaaaccgcgtagttgtaaacgcagcaagcgagaattgtcaccagcacatactaaccaccacggaaaaaattgaaacacacaattaccaaaacacacataaataacaattagtaactgcatataacacttaactatatataacatccctgttaatcacaatacaatatacagaaccatataaccatattgacaccaaatcaaccaaaacctaaaacatacaaatgtagactaatcacataatacaaaacatgccaacatccacccacatatcacattatcacataacaccaatcattttcattaacacataaatcattcgcactctacaaccagccatcacaatcgtcgatacacaacgatacatagacatcatcaataaatacaccaccactatcacacactactataacactatcaaccacacttcgttcagataacatccttaaatctacgacataccacaatcattaatatacacccatccgtatagtcagcactacctcactaatcattacgtagaacagctaacacacccactctctactataacaaataccactacaccatcaagacataaatatcataaaaactaacttcctataggttacagatacaccanacacactatagtctgactcaatcatataaactacgagaactaacatacatacatcacacaaatatcacaaatttttatcaatactcataaacaccatctacaatacaaacaagagtgaactattataaataattaatacatattcattatcacaaacaacataattaacaatcctaaatctacttgcacctaaaccacaatcaatcaatctcatacatcataaatactactaagattgtgacgtcaccacaatcaacaatcactacataaaaaaaataagattataaatccacacaacacaagaatacagacaccatcaaaccatctagatacactcaatcacacattatatcatacacacacacacccaacaactaataaaacatcttatgaataaatcataatatacttaatactacaattgactactatcaatactagatctacactacaagaagctaaaatcatataaccaacagtaacctcgacaatacaatatcatgacgtactatcacaagtagtaggactgattgcacgcatagtacttactcatacttctcatactaataatatagactcaacaatcctactcaccattatcaatattttaagatactcaatgtccacctcactactcgaaatcactacataactactagttgactctctaatcaactaatcacaaccacaca

SEQ ID NO: 558430 - DNA, 428 bp, Homo sapiens
  misc_feature (260)..(260): n is a, c, g, or t
  misc_feature (331)..(331): n is a, c, g, or t
  misc_feature (338)..(338): n is a, c, g, or t
  misc_feature (359)..(359): n is a, c, g, or t
  misc_feature (374)..(374): n is a, c, g, or t
  misc_feature (385)..(385): n is a, c, g, or t
  misc_feature (401)..(401): n is a, c, g, or t
  misc_feature (414)..(414): n is a, c, g, or t
gcacctgttcccctgcccctctgctatccacagtgcctccctcagctcctgaccactgcaaagcctcttccccacttccctgtgcctgaaaaccttctttccccagctccccaacccacgttttgcctggctaatccatttgttaaacctcaactcagcttatatctcctgtcctcagggggcccttcctgggatgctcccccgcccccttacatttcaatgtggccggttgctgcttttttagtgttctggcactcttntaccaggggacccctgggcagggcaggggaccgttttttccgggtggttattcccaggaggcatggggggnattccanttcatttcatttcaagggtanttcaaaggtttccantgttgtttttnggggggaattgggggncagggggggaaancagggggaatgggg

SEQ ID NO: 558431 - DNA, 103 bp, Homo sapiens
tataaccatcttggccgtcgtttacactaacagctataccactcactgggccgtcgttgtccactaacagttataaccatgcactgggccgtcgtttaacatt

SEQ ID NO: 558432 - DNA, 938 bp, Homo sapiens
  misc_feature (52)..(52): n is a, c, g, or t
  misc_feature (119)..(119): n is a, c, g, or t
  misc_feature (219)..(219): n is a, c, g, or t
  misc_feature (248)..(248): n is a, c, g, or t
  misc_feature (254)..(254): n is a, c, g, or t
  misc_feature (279)..(279): n is a, c, g, or t
  misc_feature (282)..(282): n is a, c, g, or t
  misc_feature (299)..(299): n is a, c, g, or t
  misc_feature (307)..(307): n is a, c, g, or t
  misc_feature (315)..(315): n is a, c, g, or t
  misc_feature (324)..(324): n is a, c, g, or t
  misc_feature (336)..(336): n is a, c, g, or t
  misc_feature (352)..(354): n is a, c, g, or t
  misc_feature (363)..(363): n is a, c, g, or t
  misc_feature (369)..(369): n is a, c, g, or t
  misc_feature (386)..(386): n is a, c, g, or t
  misc_feature (418)..(418): n is a, c, g, or t
  misc_feature (421)..(421): n is a, c, g, or t
  misc_feature (441)..(441): n is a, c, g, or t
  misc_feature (631)..(631): n is a, c, g, or t
  misc_feature (824)..(824): n is a, c, g, or t
  misc_feature (858)..(858): n is a, c, g, or t
  misc_feature (862)..(862): n is a, c, g, or t
  misc_feature (899)..(899): n is a, c, g, or t
gcattgaactcgcctgcagcctcttgggttattgtggctctccttcgttatntggagccaggcctacacccagcaaccatgtccaagggactgcagttggtattgatcttggcaccacnctactcttgtgtgggtgttttccagcacggaaaagtcgagataattgccaatgatcagggaaaccgaaccactccaagctatgtcgcctttacggacacngaacggttgatcggtgatgccgcaaagantcaagntgcaatgaaccccaccaacacagtnttngatgccaaacgtctgantggacgcngatttgangatgctgtngtccagtctganatgaaacattggcccnnnatggggggnaatgangcgggcaggcccaaggnccaagtagaatacaagggagagaccaaaagcntcnacccagaggaggtgtctccnatggttccgacaaagatgaaggaaattgcagaagcctaccccgggaagactgtgaccaatgccgtggtcacagtgccagcctacctcaatgactcccagcgtcaggcgaccaaagatgccggaaccattgccggtctcaatgtacccagaatcatcaacgagccaacggccgcggccatggcctacggcntagacaaaaaggttggagcagaaagaaacgtgctcatctttgacctgggaggtggcacttttgatgtgtcaatcctcactattgaggatggaatctttgaggtcaagtctacagctaggagacacccacttgggtggagaagattttgacaaccgaatggtcaaccattttattgctgagtttaagcgcaacntaagaaggacatcagtgagaacaagagagctgtnagangcctccgtactgcttgtgaacgtgctaagcgtacccnctcttccagcacccaggccagttttgagatcgattctct

SEQ ID NO: 558433 - DNA, 360 bp, Homo sapiens
ttgtactaaggctactactgtaaaatgtttttgttactgctagcagaagctagaataacaagtttaaaagccattgctattatgtttacagcaaaattccacttgaaacttcttgcgactactaaactggtacatctattttgcgcccattagcacaaatggaatgttatttcagttaagaagagttaagacattctcatcataacccacaatatacatacaccttactatgtgactcacaataatttaaaataaataaaaaacaaacgggggcagggaagaaggcaagatttatgacatccttcactactgactggcaaaaaggagtagccatccccaacgtttttgacgggtaccgag

SEQ ID NO: 558434 - DNA, 171 bp, Homo sapiens
acttctgggttcaagtgattctcatgtctccagcctcccgagtcagatgggattgcaagcacctgcaaacaggacatggacataaaaaaaagtattcacatagtagagatgggattccaacatcttggacaggctagtcttgaactcctgacctcatgatccacctgcctc

SEQ ID NO: 558435 - DNA, 661 bp, Homo sapiens
tggatgatagtgtatgcgaagcatggcacttgtgtgtttcacgcaagaagtaagaaagtgctcaggcctgagacttgtggagagccaaatatatctaatcaggtataggagcttggatctaaagttaggttgcgtatgtcatagatgtacatgctagaggggaaatgtatagcactgatgtgagtggttataatgatagctggtagtttcacatgaaattccccagtggctatgattaaatgaggagaaagatgattgaagtcgaataatgaaataattatgaacgtaaggttaggagcaacagtgtgtcacagagtgataactcaccagccacttagtgaaatggttgaggatgggcaaatcagttgagggtcaggagtggagatgaacagacctgtgacctcagaatgggtggaaaccgcctgctctaccaatacatgtacaaaacattggcctgagagtaggtggctcatgcctgtaatctgcagactgctcaggaagggctgaaggccccgggtggaatcacttggaacactggagcagatggtaagattgtttgcgagctgacatgtacggcactgcatttccagtcctaagacaacgataggaagaatcagtctccaaatcaagagtcaaacaccgtaacagcctcttttagcta

SEQ ID NO: 558436 - DNA, 1767 bp, Homo sapiens
agcggcagcgcgatcatcacgaggtacagcgcgccatgggccgcatgcgcgccgatgcgttcgagccggccgtagctgccgggcatggccggcggccggtgggtggcgcgccacaggatgcgcaggatcaccagccccagcacggtgatgccgatcgacttgtgggtgtcgatggccgggcgcacccagtcgtcgggaaagcggtcgaccgagaggatcagcgcgatgttgacgatcatcagcagtgcgatgatccagtgcagcgcgatggcggtgcgtgtgtagcgatggtgagggggcatgcgggaattttcggcgggagtccgactcagcctgtcaggcgcgcgattgtccggtcttcggcctcggacattcgaaaccgccggcccgttccgtgcgtacaccttcccatcgccctggcgcccctgtcttgaacgacctgctccgctccgccttcgtcgccgcatcgccgcgactctcgccccccgccacgccgctgcgaagctggctcatccatggcggcgtgctgctgctgtggggcctgctgttcgccatggccttccgcctgggcaacgtgcaggcctggtcggtgggcgtggcctacgtgctctacgacaccgtgctgctgctgttcgtgggctggcagacgctcgcgatcctgcgcccgcgcggcatcgcgctggcctcggcgccgctgccgcatcccgccgtggccccgcaccgcgccacgctgggcgtgatcgtcgccgcgcacgacgaggccgcggtgctgcccgtgacgctggccgcgctgctgggccagaccgatgcgcccgaccgcatcgtgatcgccgacgacggctcgaccgacggcacggccgagctgctgaccacgcgctacgggctcgaggcgcccgagccggggcagctcagcgccgccagcaccctgcatcccaacctgcactggctgcggctgccgcacggcggcaaggcggtggcgctgaacgccgcggtgctgtgcatagacaccgagaccgtgctcaccgtcgacggcgacaccctgctcgacgcgcgcgccatcgccgcggtgcgccgcgccttctcggacgagcccgcgctggtggcggccaccggcgtcatcacgccggtgtgcagccgcacgctgggcggtcggctgctgcagtggttccagacttacgagtacatccgcaacttcctctcgcgctatgcctggatgcgcgtcgacggcttgctgctgatctcgggcgccttcgcgggcttccggcgcgacgcggtgcgcgccgtgggcggcttcgacaccgactgcctggtcgaggactacgagctcatccaccggctgcaccgccatgcccaggcgcacggcctcgactggcgcgtgcgcgtgctcggcgacgcgcaggcgcgcaccgacgcgcccagcagcgtgggcgccttcctgcgccagcgccggcgctggttcggcggcttcctgcagacccagtactggtaccgcgcgatggtgggcgaccgccgctacggctggctcggcaccgcgatgctgccggtcaaggccatcgataccctgcaaccgctgtacggcctcgcggccttcggcctgctcgtgatgtacctggtgcgcggcgacttcggcgtactgttgcccgcggccggcgtgatcgccgccaagatcgtgctcgacctcgtcttccacctgtggtcggtgcacctgtaccggcgctgggtcggccacggcggcgaggccggcatgctgcaggccttcgcggccgc

SEQ ID NO: 558437 - DNA, 187 bp, Homo sapiens
aatacactaaggagcccttcttggagttgtgttgctcctcattaaatacttgttcagctggctgctacgtgtcagcttcgatcaaaggcctaaatgctaggatgtgagtcagtgtgctgcaggccagttgctgggatgacgagagtattagctgctgtgtcacaagggcctgacagacgctacgcta

SEQ ID NO: 558438 - DNA, 507 bp, Homo sapiens
cttgccaaacctcagtggtggtagacacctggctataggcctggatctgccctgtcgtgtctgaggagaacctgatgtagtagaggctgcagggtttgggaaaccaccatttgttattctgtgcttcccctcctggcctggaagctggcccacttcatggggtgactcacggccctgcctctgtgccccaaggcagcctccgccctcctgtaaacaggcccacagggctccaaggggaggacatttgtgggtaaatcaccctcacacccccccaccacccacagctcatctggaaatcagctttccgaagcttccacatgtgtgccctccccctctctccactgcagacacctgcacaggctgagctgccctggccacacactactcagccagggctgggggcccttcccccatcaacacctccaaacccagcttccagcaaagctcatcctcccaggcagtctctcatctgagaaccgtgcccctgtcatgtgccatgtgctggaa

SEQ ID NO: 558439 - DNA, 204 bp, Homo sapiens
  misc_feature (82)..(82): n is a, c, g, or t
  misc_feature (97)..(97): n is a, c, g, or t
  misc_feature (118)..(118): n is a, c, g, or t
  misc_feature (185)..(185): n is a, c, g, or t
ggatgaagaaattattcatctgcataagcttgacagttgagtaaagaagcagcaaagatgatatatatgtgagacaattgtnagctagatgatacanagtgaaaaatagcaaatggtncttcccttacattgtccattatacactagagatgcaattaaagcctgtcaaatggtatgaactgatntagggttcccagcacttat

SEQ ID NO: 558440 - DNA, 155 bp, Homo sapiens
atcacagaacattgtcctccttcctgtaaaagcccaccccctttcttgtttgagcttctttttctgtgacactattatacctctaatcataattgttctacttttgtcacctataattatcactagacttacaggggatccttctgcattctcac

SEQ ID NO: 558441 - DNA, 336 bp, Homo sapiens
tcttctcctgtctacactgggtccaggtggaggtggggcagggtctcctcctgtctacactcggtccaggtggatgtggactagggacacctctttgtctacactgggtccaggtggagatggggcagggtctcctcccatctacactgggtccaggtagatatggagtagaaacacctctttgtctacgctgggtccaggtggaggtggggcagggtctcctcctgtctacactgggtccaggtaaatgtggagtagggacacctctttgtctactctgtgtagggaaaagaaagagagatcagggggctgggcgcggtggctcacgcctgtaat

SEQ ID NO: 558442 - DNA, 193 bp, Homo sapiens
cctactgcaagtacagtaatgccgatgtcaaccggctccgggtgcatgccatgacgcagcactcggctgcaacccatgcttcgtgccccctgtgtcaggcacatgctcaacaaccaggattccacctccagcctgcacctacccaccatccacagcgtggccaccttactgggtggagaagttattatgacgg

SEQ ID NO: 558443 - DNA, 595 bp, Homo sapiens
tatgttttttcatttttttttttaaatacaaaattagtgattttttttcgctcgctgcagatgcgctaacgagaattttcaccacggaggggggaaaaataaccactagggccttgaaaaacaggccatatggtggggatagaagactgtccatatggaaactggggggactccctacctataaaatttcacagtccacggaaagccactagatttactaacatgaaaaggagggggattttctgagggatccaacaggcatggacacatttctacgcctgaggaatgttgaatatggggggatgttaaaaagatccatcaatcactacgtgtcatttttaaacaaaagggccacacctaaacaccttaaaaaaaaagaattgcctgggcatccatttgctgatactcttaaagagaggactggtggacccgttatatcttaagacctcaccttgcctatttagacccttgacgactcagtagtccttgcccttaacggacgaatttacgttgcccccttacagtcaagggctaccatcaagccaatcctcttaggccttagacttgaaagccttataccaggaaagagcccggg

SEQ ID NO: 558444 - DNA, 477 bp, Homo sapiens
tacggcctgcaaaactgaaaccattgactgtcaaccacttctctacaacatactcaactgttgcagattacagggactcaggaaccgaattagacaattttcatggcgaggagaagcccagttagctttcctaaacgggcaggaagtgtgaaggagggaatctcctgatgccctgctccaggggtggcacacacctgcaagaggctgtcggctgtctgctgctgctgaggtttctgacctgcaatcgtagatcctgtcaccacagactaatcacttagtccactggctccttcctgtgggataaaggtttaaattcatgcaaaagaatctttctgggcttctgcccacactagagtccctatacaatggagttccaggaaaccaccttcaaaaatctcctgggttttcttgcctccaaattttcttcagctaaaaaacaataaagatgagctggaaagaaaaggtctgctaaaggga

SEQ ID NO: 558445 - DNA, 1121 bp, Homo sapiens
agcgggggctagctgtgtgtttttttttttcccccgggcggcccggtggtgcgtactggctgtgggatgggaagtgaagccccagagagcggctgcagcgggacccgtgatgtagcagccagcgggagtgcggaggcgagatcggtgagcagctgggaagaccagaaccggggcggaagacaccttgcaaaggcgcgggttggggccccaaacacatggcgaatcgcatgaaaatgtccccaagaagctccccaagttgcttgtgcccgagcgaattgcgatctgtgcaggaaatcagcgcggaaaattccgtctcccatgtgttgggcggatggatcatatcccttgactgggggactcaatgtggggacgaataactggcaaacagcgttctaatcaattttgggtaaactcctttccagttacaaattgttcaccctttcgccagagtaaaacagaaaagatcacggaacgggctaactgtgatttcaggtgtgtcccctttttatttaaactttatggggcatttcaaagaagaatttgggggctcaacgtgtattatatattatcatagacggtggcataaggtggggcgcaatataatttacttccacatgccgggttaatttccacaggagataatatggttggggattgaacaagtatttaaaccagggtcggatgattgacaattttgttcccaaagaagagatagaaaaccacaggcgagaggtttatcaattgtgagattagtgggattgaagacgtttgaggaaggcggtttccataacaagttgattgtgggcctgtgggatgttattgaggggggccaaccaattgaagatttgtcgtcaattctgtttgttgagagagattaacaatttctcgaggaacccgaaactaaatcattagatggggagggggcattaaattgcccgagataagagactgggatggaaaatttttcagacagagtgtgaagagtatttgtcgactaggagttttatcaagaaggtgtggagtttaaatggggagattacagtgtccattatttccgcttgaaagagttcatagcattgtgcgatcgtagaagaggcaaagagagagaggagaacgaaata

SEQ ID NO: 558446 - DNA, 934 bp, Homo sapiens
  misc_feature (385)..(385): n is a, c, g, or t
gttcgacagtcagccgcatcttcttttgcgttgccagccggagccacatcgctcagtacaccatgggtgaacgtgaatcgtcggagttcaatcggatttcggatcgtattcgggcatcctgtgtctacctatgggtctgtcttattaatcgtcttgagtacaatgtggaatcattgttagtccatcatatgaaccgcctatcacttgaccatcgaaactactgtgtgtttatcattgttaccaaataatgtattcacacaccaattggaccaatattcccactggctacacagtctaacggactgacgatagcgggagaagcttaggtcatcagagtgtgaatattcctcactcagcacactcgtatccgagtgcatgcgaggantcaccgtcgcagagacattcatagctggcggtccgactcgctgagctgcctgatggtacgctcggtaggagctccagcgtgggcggtcgtgtcgaactcaactccatgggaagcaaagggctaggcgtggctcaatttgtagcatgggtgcgtgacgtctcagaagaagggattcactcagtactactgtacccccacttcgtgactagaattgcaccactcatcgttccgttcattggcgttgttgaaagcccagtggagcaaggttatcgatcgaatccaggcctgcatagtattcgagtacagcgaaattgccttcctgttgcatcgcgagcccaatctagtcttacgataccccgtgtgcccagatggctcattccaatgaccaacctttgcgtatctgtgtgaacggcactccattgaaccactatgtcgcatatgccagatcatcctgtcacaccattaacgagctgttgtgattggccctctcacggtagaactgtggcagtgactggccgctgtgggctctccagaactatcgatcccttg

SEQ ID NO: 558447 - DNA, 161 bp, Homo sapiens
ggtcgctctgacggatcccctccagctggcccccaggaggcaggcatgcattcagagtgcatgcaggcaccgcagttccttccagcagtgtcctcagcagcaactcccaggtgtggcatccccaaccacatgcacagcccattcggtggtcactgcagctc

SEQ ID NO: 558448 - DNA, 114 bp, Homo sapiens
gtctgagcaagcttgggaatccaggcggaccaatgaaggacgggatgttcaccacctgcttgcggaacctgatatggcgctgggggatcagcacagcgagcgtggtggatggac

SEQ ID NO: 558449 - DNA, 476 bp, Homo sapiens
ctccccaagtgagaaacctaccgcgccaagacaacactatttgtttatttttcttattaatataagaaggcaggaatgtcaggcctctgagcccaagccaaggcatcgcatcccctgtgacttgcacgtatacatccacgtggcctgaagtaactgaagatccacaaaagaagtaaacatagccttaactgatgacattccaccattgtgatttgttcccgccccaccctaactaatcaatgtactttgtaatctcccccacccttaagaaggttctttgtaattctccccacccttgagaatgtactttgtgagatccacccctgcccacaaaacattgctcttaacttcactgcctaacccaaaacctataagaactaataataatccaccactccttgctgactctctttttggactcagcccacctgcaccccggtgaaataaacagccatgttgctcactgtggggaaggg

SEQ ID NO: 558450 - DNA, 428 bp, Homo sapiens
gaattcccccccccccccccccccccgaaagaagattgtttagaacacccatttatggaccatttccaaacctgaagaatcgcattacatagagtggggccaattttaaaaagcgatccgtaagctcattaaagcttgagtgataatgcttaggtaagtggttataagatcaggctcctaattagattcacatggccaatttgaagaactctctttactggtgccctttacacagtttctgtcctgggtgaaggcgtctattggttttaattaagtgcctcatgtgactctcaggtgccagcatcaaatttgaggagtccacgatacatccattgagtaaagtcccacttcgggactaaagatgttctaggaatctgtcctgttggagttgggtaaggataggacagtgtggccaattttctttcctt

SEQ ID NO: 558451 - DNA, 545 bp, Homo sapiens
  misc_feature (4)..(4): n is a, c, g, or t
  misc_feature (106)..(106): n is a, c, g, or t
aganagttacgggacccggcagcagacgccgcggggcgcccggacgcggacgcccagcccgcaggggccaaggccgccgccctcgtggggctgcaggaggcagggnacgccctgtccccccatgggggtccaaggcgcctgcggtggccacagtctttggggaggtcagtgcgctccctggcgggtcgccgcacaggtgggggtgcatcacagcggccccggggatgatctgagatcccgagagggccccggcatcacgaaggattcacagccttccgggtatcccagtgcccctgggacagggccgacagccagagggcgggagaccatggggtcctccgggtgtgccatatcatctgcctctgtgcggggcgggctgtcgctgcgccggtcacatccccccagggccagacgggaggtaccgagggagctgccggcggggacggggcggcggcccaggtggcgacacgcgcgacgcgagcaaggactccttggcaggcgaaggcacagggtgaacgtgcgcctagatgtgggagcgcggccgc

SEQ ID NO: 558452 - DNA, 417 bp, Homo sapiens
gcacccagctgtttctaaaattctgctgaaagaatatgtacgcaaatactacaatgcttacagccaaaatggtaattccctactcagtccacctcttaggccagctttccagaagcaaccactttcaactcttgtgatatttacttatatttaaataatagacttaccactatttcttgtctctggcatttttttaaaaatgatgctgctaaatatcctatctggcaatattaatttttaggatcattaattttttgaggcggggtcttgccttgtcatcaggctaggtcagtggtgtatcatggctactgcagtctgccctcctgggctcgtctgatcctcaacctagcttcgagagctggctcaaggcgtgtctccagccagctggttttgaatttatgggcttggttgcacatg

SEQ ID NO: 558453 - DNA, 586 bp, Homo sapiens
ggcggggcgcggtggctcacgcctgtaatcccagctctcagggaggctaagaggcgggaggatagcttgagcccaggagttcgagacctgcctgggcaatatagcgagaccccgtctccagaaaacgggacacaccaaaaaaaaaaccaaagggcaaaaacaaaaaaaaacaaaaaacaaaaaaaaatgtgtgtggggcgggcaccgggcccgtggagaacgtttaataagacacaattgggtgtgggggcgcggtgtgcccatatgtgtgtttaatgtgagagaccgtggtgtcaataagggtggttccacagagagggaaaacctggtggagacaagagaaataggggggggtggtgttcttcctcacagatatataaaaacacgcggcggggggggggcaacaccccggacggcgtggcatttgaagaaacaaaagaacccacaaagaggcggcagccactccaggaggcgccaaaaaacagggggggagagcatatcacaccggggggggctctcaccaaagagccacgagccgcgcgaatttcacaaaagaaaacagccccgacggccgggtcgggggggc

SEQ ID NO: 558454 - DNA, 179 bp, Homo sapiens
tcatggcccggaagatcaggccctcgtacggagagaaggtcatcaagctgcgtacgatgcggggcttggtaaagaagaagtgaggcctacggtgtcgcaggctgaagggcaggtcgtgataggtatcctgcagctcccgagtgaagaacctgtcctggaagagctcgtctatgatgctg

SEQ ID NO: 558455 - DNA, 1861 bp, Homo sapiens
tattttttatttttcacggcattgcgaactcttggttggagtcagatgctcgtcaagtgtctgacttgtatgatgcttgctcgagggtccgttcatttataccgaggtctctctgtctcgcttcttgcttttcttgcgccgtatgccatagtctttgttctcactgactctttggtgtgctctcgtgctcgttcgccgctggtgtttgttcaacatctccctgtttcgtgttgctcgacttggcagatacaatttggttcgtcccggagggtgacgccggcggcctactcttctctgcgcccggtgggattgctggcgccctccacgaggtgacctgttgtcgtcgtgtctggcgtgggagatccgcaccttcggtggttttgttttgtttgtcggtcttgtcgggtggtgcactgttctgttcgtccgacatgtttctgcggcgggtctcgtgagtggttgttgcttctcgggcgcgctacgtcgggttttctgagtcctcacgctgtttagctccggtggcccggcgctgtcgtgtaacttctttgtgtcgtcttcgacccattactagtctctacgctgactcagcttcttttcttcctcgtggacgtagtcgttttgttgtactacagtcgcctagtagagtaagttgttgtaggatagtaaggtagtagtagtgcctagctcgtgggctcgatttctagtgactcttcttcggtggttggtggtctctcctccgctccccttctcaccgagtgtgttgcttcgatctatctgttgacggctctcctatgtcaccccgttgttactgtgtccgtttgattctgcttgacctgtttgtgggtgcgccctccgctgggtgggtggttatctcgctttagtttatggtgtagtgtatgtggcgcgccgctgttttctctccggcggtggtgttctgcaccacctctacgcttttgtgaggttttgttgtcgttgttgggtgtcgtccattctcttcctcatcgtagtattgtgctgcgggggttaccctctgcttcatttatggttccctgctcttctcatctgatcactgggtggtgatgttatatgttttatcgcccccccaacagtatattgtccgcctaggctttatcgccggggtgcttggagatgatatgaaggggaggtgattatttagtacaccacacgtcttgttataagatggttctagctactacgcacgtctgtggtggccaccacacagtggatacaactctgggcgacagcaagatgagtttgtgtatatatattgttgtctccccagaacattgtgtacagtccgcgctgtctgtcgctggtttgcccgcggttgtgtttaactctcgcccgcgcccccctcgcgggtggtaattgttgacgcgcctcgctctctccacgcacaccgtcgcgccccctcgtggacctcggggagtactctctctctctggcgcgctgttagcacactctatgctcttgtatgtataggccgccgcggtcacgcgcgggtgtacacagtcctcttcctctcgcgaggaggagctcttataagcgccgctgagtgggttttccgcgcagagtgtgttttctccccccgcccctggggcgcatttttctcccgcgatctctcttttttttatcacctctgaggcaccttgcgcctcgttgggacttctataggcaccgaggtggtgtttctggtcctccccccttttctcacgccctcacttctgtttttgggctcttttcttgtttttccctctttttctccccctctcctcccctccccctttgcccctccctcttttgggggagattaaaaacttgatatttgttcccgacaaca

SEQ ID NO: 558456 - DNA, 613 bp, Homo sapiens
cacggtgggtggaagcctagcaatcccaggactttgagatggccaaggacggcagagctttaagccctggagatttgtgacccatggctggggcaacccatgatggaaactctatctctacaaaaaatacaaaaattagctggggcacatgttgtgtgcacaccctgtagtcgcagctagttagggaggcctgacgtggttgggaggcatcacctacagcccagaagggtcgaggctgtaagtgacgccataattatgccacataatgcatctaagcctggggtgaccagagtgcggaccctgttctcaaacaacaaacacacacagaaaatttcacaaccaatcacaaaaaaaacctctaaaattgcggctccttggcacttgttgtacccccttgttggaaaagaacacacaacgctcgcaacaccataaaacacacaacgttaaccatcacttacttctagatcagctacaactagatcactagccttccccccagcgcgaaggatcgccactaactactcatttagccggttagaaacagcttcaccaagggggataataccaccaaggtgaggggcacacaactttttaaaaaaacaagcagccccca

SEQ ID NO: 558457 - DNA, 180 bp, Homo sapiens
  misc_feature (92)..(92): n is a, c, g, or t
  misc_feature (105)..(105): n is a, c, g, or t
  misc_feature (114)..(114): n is a, c, g, or t
  misc_feature (133)..(133): n is a, c, g, or t
gcggccgcctactactactactactgctcgaattcaagcttctaacgatgtacggggacatggaatgaggacaaggtgatactctgagctgnggactgaactggnagtcacaanctgtacagattgaaatctnactttgtcaggaggaagtgaatgaaataaaggattgttttaaggatt

SEQ ID NO: 558458 - DNA, 468 bp, Homo sapiens
tcttttttttttttgtcccattcctcaagtgatttatacaagaacatttgcgtaatggaaggtaattttaatgtatgctaatttccatgaggcctgcactttcagattgttctttttgctggaggaatgactgaagtgtcccaagcattggacttttcgacatccagtgtgaacttaccgttggaaagtcagatagaaatagccacgcttcaaatgttctgtggccattagaagagacctgttgtatgcatagcatcattctgctttccaagtaatttctatgcagatggtatccagcaaaattagtatgccatgcataacaatatgcatcatccaataagaatgatttgctcctgagcagacacaaatgaaggattattgtgtgggaggagaagtacaagtacaaagtggatcaggacagcaggtgggaccaaaggaggatacaggtccttttaaaattcttaatta

SEQ ID NO: 558459 - DNA, 605 bp, Homo sapiens
gcctgcacttactcaggccaccttccaagagccagaaaagactctgctgaaaacctaattccgttgcacctgaagcatgaatacctgcattattttaactgctatacccttagcacttccccaacacagcctccctttcatcctcacgactgcccggtgaggtagatacagcaggtaacagctacagtggtttgcatttatcaagcacttacaatgtaccacgttctatgttaagcattttcatatgtgatcccatttaaactcatgaaaactctatgaagatgatgtctgccacaatcatcaatcagtgccaccactttacagaagagaaaaatggagtggttcgtaacttgcctcaaatcaaagaggtggtaagtaatggagccaggattcaaacctcagactgactacagagccacactcttaaccctcctacaatattgcctcaaaaagcaagcattgactccccacacattattctatccattaaattgaagctcagagagggaaagtgacttgcccaaggccttgccaccaggaacctgcagagctaggatccatacttggattctttggctctgaggccccctgaaaccaaaaaggca

SEQ ID NO: 558460 - DNA, 978 bp, Homo sapiens
  misc_feature (181)..(181): n is a, c, g, or t
  misc_feature (289)..(289): n is a, c, g, or t
tagtcgaagtggactcggctgcggatgatgacagggacgctctagggatgcgacgtgagtgtcgctcggatgcgatgcggtagcctatcgctcagcatgcggctctagtattcctctcgagcgcgtgggtgccgctgaaggcaccgatggccgcctctctgacgcgagcggggccctgctngagcgaatgcgaggcaagccgggggccgatcgggctgcgcgcagaggctagtacggtgtggaaagaccagcgcggcaggtgtgtatgtagtccttttgggtggctgcncaagatgtgcgtcgaatcgtgcggtgcgcctgggttccgagccatgtcgtccgcagtatactggtccatgcgtgatagtggctctcgcaagaggagtgcgcggatgatgtgttggcatcgcttggcatcctctgggctcagcaagtctcctcgtcgccgcggaccagtctaggagtgtgaccgtcaattcgttctgctgagttctccgactacgagagagcgtgctctgctaacgaaggccgtggagctctgctttcagggcccacggagtgacggtggatcttggctgatgggctcaaggagggttctgtggacagcagtcctggaaaagctggtcgttgcaggcgtctacagtctccaggactagggcaggcacaggtcacattcactttcagccgtttcaggtccctcgtcgtctgctgccatgtgggaatctggagcacaattttgggaggcctccgcaagggcgtgtgggatcgtgcgttgctgctggcagcctgctagggttcgctgtgcatggcctgccctggtgagcagaggggcggccacggcgggcggtggctctagagacccaggacctgggagcctgggaaaatggaatgcaacccacattgtaaagccactggcatctgattatctccatttgaacacacagcacagaattaccactgtaaatgttattttgggaa

SEQ ID NO: 558461 - DNA, 340 bp, Homo sapiens
cgaatataggcgatgtacagaactgaatcgatgggaggatggcagaaaagctggcattctatgtactgcagaaccaattgggttgtcatcagaatcagagtataatgggtgagccaagttcgaaagggtgcagcttcttcgccttcgtcaaatcttcatggaactttgtgaagctcaacaaggcttcgattaacatgctgagggattgtagagccatatattgcatgggggtaccccaatctgaagtcagtaaattgaactaatctacaagcgtggttatggcaaaatcaataagaagcgaattgcttttgacaagataacagctttgattgctcgatct

SEQ ID NO: 558462 - DNA, 244 bp, Homo sapiens
  misc_feature (27)..(27): n is a, c, g, or t
  misc_feature (53)..(53): n is a, c, g, or t
  misc_feature (89)..(89): n is a, c, g, or t
  misc_feature (203)..(203): n is a, c, g, or t
ggcaaatatcacgtttaagcctgattntcttatgttgcagttaaataaaaganctatgtaagatgattttaaaaattcaagcaaatggnccgggtgcggtggctcatacctgtaatcccagcactttgggaggccaaggcaggcggatcacctgaggtcaggagttcgagaccagcctgaccaacatagagaaaccccatctntactaaaattacaaaattagccgggtgtggtggcgggcgcc

SEQ ID NO: 558463 - DNA, 162 bp, Homo sapiens
gccttaatgtataaatttaaaagcaccatgacatctcttaagagcacaatcagaagttttataaaatttagcaacaggaaagtgcaggaccatgcctaacttaaacagtaaaacacacccagttatttcaccaccaggtggcgactggactgggctggattt

SEQ ID NO: 558464 - DNA, 179 bp, Homo sapiens
  misc_feature (164)..(164): n is a, c, g, or t
atcagacaaagccagtggtgaggactgaataaaacaaacatctggtacaaaaaacaaatgcaaagatggaggtaaaaagggagccaacatgaaggaatatatcgctatctttaacctatattcaacacagagaaaacgtactggacagagaagaatgttctgantaagcagagagtgaa

SEQ ID NO: 558465 - DNA, 797 bp, Homo sapiens
tagaacggattgcaggttcagccatgtcatctgagcctgcccgcaccaccacagagcaccccagccatcaagcttcagtcgggctgctggaaacccctcgtgatgccgtgagcggctcaccatccgcctctgcggggcaacgtggtcccaagcccattgcccactcgccggacgaggaccttctcgggcgacgtgtgcgggcttcacagggaccccgttctacaaaggagttctgcacatatgcgtaacgtgcgcggttccaagggcgcattggcatatcaagatacacccagcatgatggcagggcctcgacatctgtcgcctgcaacatcgcatgactggtggacaggggagatagtgtcccagtgggaaggcgatgaggatcaccataataaaactgatgcatcctagtcccaacccgaagaatgagaagctgcaggccggtggaggatcgtacatctacctcagactggtcgaccatggctaccaatggcatgagagctggtctggacatgtcatcagatcctaggagatggtggagagcaccccttgtcgctgtgcattgtgggagactaatgcgtgggaggaggcagcacgacaaactggagcaatgacaattctatcacaacaacgaacgaagcggcggccattcacgcccgggacataggcacgcctctacaacggtatctacctggaaggacagggggatacagggagggcaagatgagcaggaggtaaaaggagtacccggaccatcaggacagcctatggaccagttgcgacaaccaacacaacca

SEQ ID NO: 558466 - DNA, 894 bp, Homo sapiens
ccaaaagttaatatttttattatgtgtgcagaactggtttaccaaaaaaaaaaaaaaaaaattttttaaataatcggtttttccccaataacctaggaggtgggaaacacttataaatatccctattgcacaggggggatactggagtgtacacacgcagcacatcactggccaacacacctaataaatggatataagcgggaggctaaaacccagctctggtaagagtaatggcagacaatctctctggaatgggatacctaaagacacgggaactcgcggaagagattcgccggatgatccatcaatatctcccagaaaacctccttcaaaattggatccctaggctggaaggggataaccaaggtagggacgtggaaccccggtacctcttagccaaccacattataggggtggggtcaccaacccgtgactgggaatacagcaccaacttaggggctactactcgcgggtggagaacgtctattataaaaggaacaacacccccacttaccatggttcccctgttggccatggcatctgtggcggaattcacacccagggttttggggaaattttttttccttctacctatgtgggtttccaaagtaactaaattgattagaaaaaggagccgggtgtatcaagggcattaacggccaatttgtgatacattgccaaaggcgaagaaagggacccaggggttgcgggtggcgaccacgaatgctcccaatgggacttggaaactcatgtgggtccccggcgtacccaaacacaccaggtgctagaagcaaaaagctggcgaaatcagaggaggaggcaccagatgaccggggtcgccagtgcggccaagcgggtgagaaccacaggcctgacacaggggcaacgcagaga

SEQ ID NO: 558467 - DNA, 696 bp, Homo sapiens
  misc_feature (564)..(564): n is a, c, g, or t
cctcttcttcgcttcttttttccctctttctcttttctcccttttgcgtttgcggtcttctttttcttcctcctcccccccccctccccttcgcggccgcccccctcctcttatccaccctccccccccctcctcccttctccgcgcgccgggcgcccctctcccttttctcctcccccctccccccctctccccctctcctgccttcccccctctcccccctcctccctccctccccccctccccccccttccgtctcctcctacccctcccctctcgccccttccccccccccctcttccctctccccccccccccccctccgcctgccccttcctccctccctccccctccctccctccctctccccccctccccccccttccctccctctccctccctcccccctctctcctgctctctccctctcccccccttctctccccttctcccctccctcccccctctccctccttctcctcccctcgcccccctccctcctctccctctctccctcgttctctccccctctctcctcctttcccccctcgttcctcccttttntgcccctcccctcccttccctctctcctccttcctcccctccttcccgtgtccccctcttcctcctctctccccccttgtcctccgtcccacaccccctctccccccttcccctcctcttctccctcccccg

SEQ ID NO: 558468 - DNA, 1607 bp, Homo sapiens
  misc_feature (672)..(672): n is a, c, g, or t
  misc_feature (802)..(802): n is a, c, g, or t
  misc_feature (1045)..(1045): n is a, c, g, or t
  misc_feature (1294)..(1294): n is a, c, g, or t
ggctttcttgtttgttgtttttttgttgtttgtttcgtcttggttgcttggttgtgtcgtgtgttgttgtttgtgcttgttcgttttgtttgttattgatgtctatggtattattgtgtgttgttgatctgtttgatggctattgatagtacatagataatagtaaagcagctgctatataaaaacagtgtggacatagatcgagggctcaattttgacaaagcgcgggttagcccgccccttgtatttgtccgctttaagggtaacggcagctctggtgggtctatgttcaacacccagactagggcggggggaacaaaaccgaccgccgcttttgtaatgccgcgcccataatgggggccacacagaaagaagaggaggggcagcgaccacgcttgtgcgaaaagacagatggggggtgatgatggagtgaggcaacgaccacccccctggttggtggtgccccaatataataagaacgaatagattgtggggagaagaccagcgtcgtgtgttcccccccgtgggccccacggtggaccacccaccaacggtggccatattcgacgaaaggggtttctcacacaagaggtctcccggtgttttattgaaagaacgaggagtgtccttgtcctcgtagatgtgtagcacgagaaattgtatgtggagaantctgccacgtttttgagcagaagattgttcttcacatccttgtgttttttcccctgtgaagaaagtatgatttctacaggggggtgattaagatagtcgtcgtcctgctcgtctgctgtaagactttctnccatcatgagcacacatcgggagttgttttatcccgccgcgcgggcgacaccccaagaaaggggggggtccccaccaggggtgctcccaagacaaattgggccaccgcagccacaacagggagttttggtaagcttctcacctcgcttgttgagatgtgtcacacagaagaccttaagccgccgactggggtgttagcatctcggctcgtgtccgtgtctgcgtgtgtctcatgtgctgtgtngggtggtttgtgataacttctgaagagaggatccgcgcacccgacaagcacgagttatcgcgggaggaacctcttctgtaaagaggtgtcacagccacccccacacacgcgtgtctcccccacaatttccgcgagaagagaagagtgagtggagaattcacatgggacccgcagagagaggtggcacagagccacagacgagactctgagaaagagaagtgggtgcacacaaaaaatggagagttcccngagcacgcacttgggaaagagcacttggaaaaggcttgcccacttctaagttattcctcctccactgagagtttttcggtatgagaaaagttaaaatgctcgagaagaagccccacgtttgaaattggggaaagctccactggaggctttcactggtgagaaggcacctaagtttctgggaaagacccctcggggacgagaaccgggggcttaaattggacgagactgatggatatggacccccccgcccagagatttgttttaagattccagacttccaattagtggcccaattaaaagggctatttgtgga

SEQ ID NO: 558469 - DNA, 1483 bp, Homo sapiens
  misc_feature (671)..(671): n is a, c, g, or t
  misc_feature (947)..(947): n is a, c, g, or t
  misc_feature (1011)..(1011): n is a, c, g, or t
  misc_feature (1093)..(1093): n is a, c, g, or t
ggaccggtgaggaactagagaatcatggcggtctgcgctgttcgttgctgcctgggattctgcgctgctgggcacccacgtgagcctccgtggggcatgcctggacaacaagctctttcatccatagcgcagttagaacgaccattggcctcgcaacgactatctccatcactcttgctgtcctttgaacatgagcatgcgcctaacagtacggtctacgatggcggcacaccgcttggactgagagcggcggaagtcccgatgagcgtgccatgacacagaggcagagcgacagccgtccgtgtcccccagagtccctcgagtgaaacacaccgtgggagttctcaaaaagcgactgtgaaacttccactgtgacctggtgaacttctgaagtgtgccgggcgacagctaaagtgtgaccgttcctccagtttgagatcttgtgtttcattattatccgcccatacccttcccacgtgaaaaggaggtcccccacccaacttatgtggaagacccaacccctggtgggccactccaatgaaaacacagtttgtcctcccaattgggtctgtttgcccccaaaagcaaaggggctggaaccccccatttttcaccacaccagaaaatggaaaagagcttttgggcaaacaactgtggtgcggccctttttngggtgtttgagaacgaaaccgaacggggtttctcccggggagtttcacacgtcaatgatttaaaaagacactcgcatcacacaatttttcctaggaaagaaacccctgcgatcagaggcacgggcagcgagctgtccggatctataaacggaacaaacactctggaatatgacccgccccaacaaaagtgtttggtggcccccctttctggggtgggcttttaccacctattttcgggcgcgactaaagacgccgttggaattgttcacacctatntgaggaacaaccgctggagtttcttccccaaccacggggagttatgtgttcgcgcgcgcaaatnaacaacccccgatggtttatggcttttttcgacaaaaaccgctgtattggttatgagaaatatccgcccttgtttcaggagngagaatcgggtacccccaccccaatatttgtcggcggccgcgcgagtatatgagtcgcgccaatattatagagactgggtggtgcatgaacaaaacgtttctcatcccaaaagaacgcagcgtgtgtgtaggggagtagcaccgactcgctgttttttccccccatttttgtgtgcaacaacggaggttggggtgataaagccccccttatagaagacagtaggtgcggtgcgtggcctcaccaacatcacctagtgtgtttttattctccaccgaaaaactgtttttctgcttgcgggcgagcaaactactcactcaccctacgactagggagaggtgggtggagtgcacacccctcgtttttttttttctctcacaaaccatcactat

SEQ ID NO: 558470 - DNA, 108 bp, Homo sapiens
gagaagacctcactgctggggagtccctgccacactaagtcccccaacacactgaatctcccctcctcacaagtttccaatgtatacccctctaagaggggaggggct

SEQ ID NO: 558471 - DNA, 126 bp, Homo sapiens
acgataccccacacttcgatcgcggagaaggaaggagaaggtgaagaagtcagagtctgacctgtggtgatcgcggatagcctacttgtcattccacgttttcaagctactagccaaatgctgcca

SEQ ID NO: 558472 - DNA, 296 bp, Homo sapiens
ggaagagctgatttttaaaatatgattaaagtaaatatatccctatgaatatcaaaagtcgtctccctgagcctgtagttggaagtgccgcctgtaatggaatgatgtcttgtataaaaatgcccttttttgaaataaaaagaactcctgggctttttaaaaaggttgcgggaagccatcctcccctccccctgtgtgtaaaaacagtgtttttgatcctgctgtccccccgacctttggcaggagccggcgccagtaggaaagccctccttcctaaataaaaaaagtgtttccca

SEQ ID NO: 558473 - DNA, 181 bp, Homo sapiens
agtctgccagggacctttctacttcatctcccgcgttgatactgtgggacaggcagacagaagcgctagcataggcgtgtgtgccgccaaacaggatggctctgcctctctgcagcgggctcaagctgtgtgcattagtacaaatggtaagagataacataactgtcattctcttggaaat

SEQ ID NO: 558474 - DNA, 195 bp, Homo sapiens
cgggagcgggagaaagttgattacgccgatacatatatagctgaaatggacttttggctgtaagtttggtctagggtgtagcctgatagtatgggaaatcagtgaatgaagcctcctatgatggctaatacagctccttatttgatagtgacactagtggaacgtgggctacaacgtatgtacgtgtcgtgtagt

SEQ ID NO: 558475 - DNA, 362 bp, Homo sapiens
gtcttgtttttcttattagggccccctttccctgaatgcccattgcaatgaggcataggaaaaaaaagggaaatgaaattgcttgctgaagtcctcctatgttttgggccctatgctgtttgcctaaaacataattgccctgtgctggggcccctggagcagggccctacatagtgaatatatccatagttgttcccaaaaaaagccatatcccccttagaagctcccaaacttaaaaatggccccttataccccctagaagatatagtaaataataaaaaaaaaaaatgaaatggctaaaacccttttgttttccaatggggctgtttttccatgttaattaaaattttatgttttaccca

SEQ ID NO: 558476 - DNA, 1019 bp, Homo sapiens
  misc_feature (204)..(204): n is a, c, g, or t
  misc_feature (1019)..(1019): n is a, c, g, or t
tcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaantagaggtgagacctgtctcaaaaaaaaaaaaaaaaaaaaaaccgtgccaattttctcaaacattaccggataaagatttatttccagggtcccaatttaaattagtttaataagccagcagggcttttaacttcgtggtgttttgcccagaattccagctcgggggccattgggttgggtgggtccgggaactttctcaagtgggccatcaatcagtatttgcttatggattttgatgacgggcatagcctggggcttatcacctcattgggtaaaaggcgctaaagcctttctttttaatgggcacttcttttttggagataggggtcttactctggtcacccgggtagagtacccgggtcccaatcacggtcaatgtaggcttaacctccgtggggctcaggtgtatgtcactatgcccgggtaacttggtatttggtagagacgggcttcgccacgttgcccaggctgaagcggaaatttgcctaagggcaagcgatttgctccaccttcaattccggaattgcgagatacgggtttagcccttgccccagctttgttttatatctcattttgaaggaagaaccttccaagaattcgcccaggcgaccataaatacgaggcgcgtggcactatacaatctcgggttactcaccgtacccatgataaaatttccaataaaggggggataacacaagggggctaaaattctaggcgatgatccttgtaaggccacaaggtgtaaaacgcgcgctactgagcaaggctggaccgcgctgaccaccgcaatttatggtgattatagacgcccgcgn

SEQ ID NO: 558477 - DNA, 470 bp, Homo sapiens
  misc_feature (410)..(410): n is a, c, g, or t
  misc_feature (417)..(417): n is a, c, g, or t
  misc_feature (420)..(420): n is a, c, g, or t
acccacgcgtcgcgaccacgcgtcgcccacgcgttcgctgtccggccaggtggttggtggtaaggattcaggctccgtcctaacgaggccgtggcctgaggctcagtggccccccgccctccctcccagaaccaacagcgtcacctcccaggcccagactggaccgcacaccttgggacacggttttcccacttcctaaggacgagccccagactggaggagaggtccgaggaggtgggcgatggactctttgcgaggaccccggcggctggcccgggggaggcggcgaggcggcggcgggcggcggccgggggcgacatggcggaggagcaggacctatcggaggtggagctgagccccgtggactcagaggagccccgctgactgtccccgggggagcgcgccctcgngtagggnccngacggacggccggctggcaggatcagggccctgcggagcacagcccgggg

SEQ ID NO: 558478 - DNA, 254 bp, Homo sapiens
gcacgagtattaactttttcttattattctttaggtaagactgattgatgttggctgatattggagcgctcattcacatgaagtggatagatacttctcaagacatcacacagcgtgagtcaatcaaggagggaagccacaagcagactgacaacgtttctaggatcaggtgagctgtgcccagaaaaccaacgagaaggagtggaaggaggaatgaacgtctcattctcgttaataaaggcattatcctaatt

SEQ ID NO: 558479 - DNA, 239 bp, Homo sapiens
aacagttggactgcagtgacgcaatcatacctcactgagactatgccttacttgggctgcaatgatcctcccacctcagcctacctgagttcctgggtctacaggcaccagccatcacacccagttcattttattagtattattattagtatactcactaatgttgcccagtttttgtttagctttttacgctgtgtcaaccctggatcgaccagtgtcaatcctgcgtcgaccagtat

SEQ ID NO: 558480 - DNA, 95 bp, Homo sapiens
  misc_feature (7)..(7): n is a, c, g, or t
  misc_feature (13)..(13): n is a, c, g, or t
  misc_feature (20)..(20): n is a, c, g, or t
  misc_feature (22)..(22): n is a, c, g, or t
  misc_feature (40)..(40): n is a, c, g, or t
  misc_feature (61)..(61): n is a, c, g, or t
  misc_feature (69)..(69): n is a, c, g, or t
ggtagangaggantctttgntnagaaacgatcttcgtccngctaacaaacttgctaaaggnaactaggntattccatgacgatttgctactaaca

SEQ ID NO: 558481 - DNA, 979 bp, Homo sapiens
cgaaggcggaggaggctccgagcccccctccccgtgctacccccttcccccgttgggtgctggctccatgtctgtgtgtacggcctcaggggtagagtccaagcccgacgcggggcgaggccaagcagcggtggtgcagcgtgaggtgaagagcacggcgagtcgagtcagagtcagcgaggtcacctcagtgacgccaccagctggggaggcatgaagcgcgtgggtatacgccgtacatgctagttaagcctctcggcgagccctcttaatagcgaggaaccggaatcaccgacgggcatttaccaggcaggtacagtttttatagcccttgaaacttcctttgagttgcgtagttggagcaccttgtccctccgtagcacgacttttgggtccgtgagaaagtctcaagaacttctcgaagtaaccttgatagggcacaaattttcgtaggggccttttttacaattccacgaacacggccggtcggtaattggaatttccccgtttccagggaatttaagcacaaagagggtaaccgtggggccccgtttcagtccacgcgtactttctgcacaagggaataagcgagataggtagggcaatttccacgcaggttcaacgagaattactttagacatacattggcccctttggcccgttggatttccagttacgccccacaatttaacccaccgatggccgccattttgtacaccatcgtgtggacatgggccatatacgtccgagccgacgtctaagttggcatacgttgggggagtttcgccgatgattacaccgcttaattaggggcccaaacaacaagcgaaaccacgcagcgacacaaggcttggatagcttatagagggccccagataaccagaggatctggctccatacgtaccttgggcgaacattcccttgcccctgaggaggatccactaactaacttttaggaaaacaccgccaacgggcccat

SEQ ID NO: 558482 - DNA, 410 bp, Homo sapiens
aaaaacccagggtctttctccaaagaagagagggtgtggtaaggtcccacgcaggcaaaccacagatgaccccaggcccgacgcagctgaggctgaggctgcggcctttggtggctcacccccttctcagatccacactttctgggccaggcctgagctgagccacgtgggggtgagagaaccaggagcagggggaagatgtgggggaagggcaggcggagtgctgaccccgaggacctgtttcactggaaaggcagcagtttttacctatcttatcgccaactcggatgaattcttgtaccagctgcatagctgtgctcccaggatccagtttctctctagcttcgggcatccacgttttcctgccatggactcttgtaacaaacctctttcctaatagtaaataggta

SEQ ID NO: 558483 - DNA, 176 bp, Homo sapiens
atgctgaggtcatctaaggatccgtgacgggatacaggtgtgcggcacgcacccagcggtacaaggttttatttcttcacttgctagctaacacgttattttcttgcttttggtttttgtcttttaaaattaccaagcccatccttagtaaactgtgaaagtagtaattctcaact

SEQ ID NO: 558484 - DNA, 201 bp, Homo sapiens
ccggtccgaacgtggcacgtcctcctcgctggaagtgtcagtgctttgcctcacaggcaggttcacaatcgtgggggcaagttggccactttcagcggcgtctcgcctttcctgttgctctgcgtgcgggttccctcctgtaccgcagctagcagcttcaccacccttgtagtgccctgttgatggaagcgtcgcgcatgt

SEQ ID NO: 558485 - DNA, 556 bp, Homo sapiens
cactattactcataagcacacatcaaaagggaaacaagggttttctttgaacttacttttgttttgcagatcagggaaaccttgcctcattaaacagaaaaaggaaaacattttaaataaaaaacatcttattacctgtatctgtgacaagaggaggcatgacaacctaaaaaaaaatttgtgaccagaaaaatgtcctgagcagtgatactatctataccttggaaggagcacaggttagagaaatgtggggatgaaaattggggaaggtgagcaggcagtttaatcttgccttcaggatcaggctgtcagtgtgactttattactttgtatgaagtattatgaattgcccaaatgataaatacacccccatctaaatgttccagaatgcattccacagaggaatttgagtgactgaaatttttcctctttcttcattggtgtggttaaacaaaaattagctggggattaagggaaaattgtggctatgtctgatcattctaaataatcatgaccacaaataaattgccctgagtaggtctgaaacctggaaaaa

SEQ ID NO: 558486 - DNA, 224 bp, Homo sapiens
cggatctaaaaggcacacatagacaacagtcttgaaaacttgacggaccctgcccaccccgaccacgtccgactaggcgtctcccgattcctctcccggagcctcctcagctactccatccttgcacccctgggggcccagcccacccgcatgcacagagcaggggcaaggtgtctcctgagaggcatgacgggggccaggtccgtcctcctaggtgcctctgg

SEQ ID NO: 558487 - DNA, 813 bp, Homo sapiens
ggacttcagggctgcccgctcccagtgtcttcctgtgggggaagagcacagccctcccgccccttccccgatgggatgatgccacaccaagctgtgccacacctgtggctctgtgcgctgcacatctgtgcccatggagcactgctgggtggcccatcaaccacacctcaccaggggcaggcacagcacagggatccgacgttgaattttccacacatgcaacccctcctgctgcagaggggcaggccactgcactgtcctgctccacagtgttgagcgatgaggaggggcccgtagtactccctggacctcaaggcctccacagagtagacctcgggcatcctgtgcacacttattcaggaaaagcctcatgtgtcactggcatagcataccaactcacactataacctgacactgcaggggcattgggaccttgacgacagacgtggccatttgggcgagacaagtagtgcctggcataacgccgttcacttgctagtacacctccttgccccccaacacccacaggaaccccgaggaccttccaggggaaaccacgaggcaaagggcaacatgacagagactagagagccacaactacacatgggaccacacggcaccaaggagcccaattgacgggctcctccgccaagacgatagacaataggaacataggaccatgacagaaagcccccaaagaggtgggcccccacaaagaaccgatggacgaccagggacccaccgcagcaagggagagagagcaacagcgcaacagagaaagaacagcgaatagagccaggccggccctacaaa

SEQ ID NO: 558488 - DNA, 713 bp, Homo sapiens
attgaattagaaacataaataaaatgaccagtaattgtgaaaaaaaaaaaaagaaaaaaaaaaaaaaaaaaaaaaaaaaaaaaccaaaaaaaaaaaaaaaaaaaaaaaaaaaaaaaaaaaaaaaaaaataaaaaaaaaaaaaaaaaaaaaaaaaaaaaaaaaaaaaaaaaaaaaatataaaaaaaaaaataacaataaaattgaaaaaaaaataaaaaaaaaaaaaaaaaaataaaaaaaaaaacttttcccaacttaatcccccatgtatttttaacccctttaaacatttttctttattccccaaaatgccttatcttgtcaaactttccaataattgggcatttttaatattcaaggggaatttttaacaaaaatattttttaaaaaaccccgttgaaaccctcatttaataacgcttatgtttaaaccaatttttttcaacattggcaaaatcccttataaactccaataatataccttttaaaaaattttgcgacacttcaaattggaaacaaaaatttcgctttaaaaaattttgtactcaaaacctcataaaatttttaaccccaacatcacgtttttttccccaaattgttgaacattttacaattccctctttttaatattcagaaaactcccccctaaaatctcttaaattggtcccctaaatggaaaaaacgctctttttatttaacaaatggaacccccca

SEQ ID NO: 558489 - DNA, 642 bp, Homo sapiens
  misc_feature (642)..(642): n is a, c, g, or t
ccgatgacgcaggcctgatttaggcgagattggcgataattagtcaatcaccgtcagcgagatggaccgattgcacaaggacatgaagatcaagatactgttggacaactgtatctggtccgtgactatgaaggaattcgcgagcattgctagctttctagtagactctataaagcttgacgcgactgctgatcatgcgagagcagactcagacacgagtcgatgagtggaacaagatcatattattacgttgatatcagcgtcaacagtgtacacgtgattataggtgacaagggctgaacacaggtgggcgtcaacatgctgctagacagtaacctggccatgcgcgatatgatctgctcgcatagtctacatagtcacagatcggcgtcctgacactaggccttgaaggagacgagcccaccgatttgcgtgcacgattagcatgtataatagaacagaattgttcagcaatagcctacaatgctatatactgtctgtacagagtctgattactaagatgaagtactacatgaggcaagttgcatcgcactttgaatcttgctaaactactttacccctactattgaagagactgtgtacaattgttcgatactagtactgacactgcttagaggcccn

SEQ ID NO: 558490 - DNA, 306 bp, Homo sapiens
aattgcttgctttgtgtgtgaggagaaaccctcacacatctagtgtcagaagcattgtgttgaggagtgtgtgagagtagagagtaggagagacattctgagttctggatatggtgcagtgttttactgcatcctggacattttgattcttctgtgaggagactgtttggtgttttttgttgtgttagattttttgttttttgagatggagtcgtcactctgttgccaggctggagtgcagtggcgcgatcttggctcactgcaacctccgcctcccgggttcaagcgatcctcctgcctcagtct

SEQ ID NO: 558491 - DNA, 236 bp, Homo sapiens
  misc_feature (214)..(214): n is a, c, g, or t
  misc_feature (223)..(223): n is a, c, g, or t
tataaccctttttacgaagcttcaaaggtaattttacatttatctttgcatttatgacattggtggtcatgatgaccacttgatgcctagtccttataaatggaggcaactcctccatcctggtattgatgctatggaaaaatgagaaccattttacaacggcccacaggatgatacaatttgcaacattagaacaccggaacggctggcattnattaaagcncaagaatgcaagc

SEQ ID NO: 558492 - DNA, 118 bp, Homo sapiens
aggctgctgatgattatgggctgattagtagtagttactgggtggaacatggttggtgggggtatatatggtaatggagaagggcttagaagaaaaccccacaaaccccattactaaa

SEQ ID NO: 558493 - DNA, 455 bp, Homo sapiens
  misc_feature (21)..(21): n is a, c, g, or t
  misc_feature (166)..(167): n is a, c, g, or t
  misc_feature (169)..(169): n is a, c, g, or t
  misc_feature (172)..(172): n is a, c, g, or t
  misc_feature (181)..(182): n is a, c, g, or t
  misc_feature (189)..(189): n is a, c, g, or t
  misc_feature (191)..(191): n is a, c, g, or t
  misc_feature (195)..(195): n is a, c, g, or t
  misc_feature (197)..(197): n is a, c, g, or t
  misc_feature (202)..(203): n is a, c, g, or t
  misc_feature (206)..(206): n is a, c, g, or t
  misc_feature (208)..(208): n is a, c, g, or t
  misc_feature (212)..(212): n is a, c, g, or t
  misc_feature (376)..(376): n is a, c, g, or t
tgtaggttagggttatagggncccttgtcagaacattgatacgaaaggggctcccaaacgccgggcacaaatgtgtctgcaaacagatggaagtaaacagtgcactggcccaaatgcttcatgagtcagtttgattttgcaatgcaatttgcatccttgaaactgnnantcncccgggggnnggggtanancccngntttgnngtngnaagngcctcctattagctcaccctttcaacattaaacagagaccaagagagaaatggttccaacatttcaccacatatatttcttcttacgcagtctaagctgagaatgccatgtaaatgggtcactgcgaaatgcagcaatttaatttttctccaatcaaaataagnaacaaaccagtatgatctcacttctattaacttttgaaggtttacagcagttaaagtatttttgcttctatgtatgaag

SEQ ID NO: 558494 - DNA, 785 bp, Homo sapiens
cttgaactacaggtcagtgctacccaatcagaattccagtaggtttttttgtgtgtggaaattgacaaactgattctaaaattaatatggaaatgcaaaggaccaagagcagctgaaacaaccttgaacaaagaaaagtgaattgaggggacgtccaccatctgacttgaagggctgttgcaagtctattgtaatcaagacagcgaggtattgatattaacacagaaatatagatcaaccgagtccagaaatagacccatgcatctattgtcatttgattttaacgtacaaggtacagaagaacttcagtgaaaaaataatgatcttttcaccatctatatgcaaaaaattaatctcacaccatgtgcaaaaaattatcccaaaatggatcacaactggaatctaaaatgataaaccatctaaccggaccaatgtaagagaaaaatctttgtcatttttgagttatatttctgaacatataacactaaaattatgatctatagaagaacagagatcgataacattggacttcatcaaaattaggaacttatgccctttacaaatacactgttacgacaatacacaagacaagccacagactgggaataatacttgtaaatcacataactgataacggacttgtatccagaatatacaaagaacccccagcactcaataaacagaaattatccaatgtagaaaatagaccaaagatttcaacagacctttcaccagtgaagatatattggatgggcgaagcagcacctacaaagatgcaagaacac

SEQ ID NO: 558495 - DNA, 240 bp, Homo sapiens
gggggaacaagatggcggcgcgaaaggggagcctctcggtgaggaccaacttggggctccggccgctgctgctgctgaccatggccttggccggaggttcggggaccgttcgcttgaggcatttgactcggtcttgggtgatacggcgttttgccaccgggcctgtcagttgacctccctcttggacacacctaccctagggaagaggagttgtacgcatgtcagagaggttgcagtctg

SEQ ID NO: 558496 - DNA, 375 bp, Homo sapiens
cccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagaaggggaagagtaaagactgtccaagcaacagtagctgccaaagagaaaatacgaaatagacactttttttttttgagtcagagtctcactctgtcacccaggacagagtgcagtggtacgatctcaagctcactgcggccgc

SEQ ID NO: 558497 - DNA, 152 bp, Homo sapiens
ccactcaggcggggtagagggattggtgatcccagccacgaacacatgctatataatctatgatttttgtcctccatttttctgttatctcccacagccctcacagatggatgctggcataggcgtcatgaagatcattcaggcttagaatc

SEQ ID NO: 558498 - DNA, 387 bp, Homo sapiens
gccggtgagcatccatatgcagagacaagatattgcccggtggccttcctggctcagtctcacttccacattcagcccaggccattaccagtgtgggaagccccatgctccccctcactggaaattatcactgggtggtgtgcatccaatcctgaaagtgtaggggaggagggagggcaacagaaggaacagagcctggcctccccacccctgcccgcccagctgggcagcaggtccttctcagaacgacagcctcttctgctgctggatgcagtcacagcgaaccctctggcccttaatagcaactccacgtgcatcaggaacctcaactagacccctaacaaatactctctctctgaatagacaacctcccgtagcactgccaaa

SEQ ID NO: 558499 - DNA, 334 bp, Homo sapiens
ggggccatggagcggatcaaggaggaccggcccatcaccatcaggacgacaagggcaacctttaacccttttattcgagaacgtgggtttcgtttttcatacacggtccataggacaagcttgcgcctttgagattccgccgccataggatgagatccaggcccgacctcgcgagaactggatgggagaccatgcaccgcatggagccacctcccacccgactttgaggggcgccagacggtaagacaattgtgcagaccctgtaccgccatgtgggccttagaatgagctggacggctcaaagagcgtcaaaattctgtgtggggctcgagtc

SEQ ID NO: 558500 - DNA, 1350 bp, Homo sapiens
  misc_feature (844)..(844): n is a, c, g, or t
  misc_feature (913)..(913): n is a, c, g, or t
  misc_feature (919)..(919): n is a, c, g, or t
tggacagtgtttttttcaacaggtgtggcaaacaaattgggcccttaataactatgttgtcgggggaccctcctggggcataactcttttcccttgggcggtgtcttttcgcacttggggccggtttccgggacacaagcggccctgtcgcgtgaacaaaaacccacatgaagttgggattaaaacgctgtataggtagatttgggggttcacaaccaccacttgggctcttgggtagacctcgttagttgccggagagaggaaagtttccccgaaaccgggcctcttttatgatagcctcctcctctctcgggattttacccgtgggaaaacaaaaaaccaattgggagaatatatttggggcccccggagatttaaagaggtggagatagggagattttcaattaataagttctcgtgggcccccgcgtcccacactttttatgaaaagaaggatatttataagggaataccttttttggccccccaggaaaaaatagtaggggtcaacaaatactgtgggtccctcgtaatacgcgtataatttctcacactcccggtttgtgtccccacactggtgcccacgctcccgcgctttgtcctcgcgagaagaccactcggagtgtgtggggaaaaagaccaatggggggacctatgcgcgcccggccacacagagttgggatagccgctctctcataacactctcccccagagaagagaagagttacactttgtgcgcccagagaagacccccttggggacacactctctcacacagaggtgagactttgggcgacacactctcaacacacagatgttgtcgtttctttaatgatatatttgngggtgatataaacaccctatctccactctcgacatattacatcacaccacagatgtgcgcagagatatntgttanaagaatagcgccccttgcccacgagagatatatatatagggagatgtatataaccccaaaatacccagggccgcttctccacccaagacccagaggatggagaggaaaatcaccagagacaacatatggggtccagaataagaaacatgtgccctccacattaagccaagagcccacaccagactgccaaaaacatgccaccggagaccgggggagccacccgtctcccccagaccaggataatcttggctggccaaatggggcccccgagagaccggggtcttgagagatcttgttgtaagaatggccccaatctttttatctcccccacaccttaaaagacccagccattgatgccccagactttggaaataattctgttttaaaaagcccagagaaattccccaactgcgagccttttttaaaaacca

SEQ ID NO: 558501 - DNA, 332 bp, Homo sapiens
  misc_feature (197)..(197): n is a, c, g, or t
  misc_feature (291)..(291): n is a, c, g, or t
  misc_feature (313)..(313): n is a, c, g, or t
  misc_feature (325)..(325): n is a, c, g, or t
ggtcttactcttaccctgatgcccaggctggagtacagtggtgcaattatagctcattgcagccttgtactcctggggttcaagtgatcctcccacctcagcctcccaagtagctaggactacaagcacgcaccaccatgcccagctacatttgtttctttttttttgtagagataggggtcttgctatgttgcccnggtggtctcagactgcctaaagcagtccttcccacctagggccgcccaaagcactgggaattatagggcatgagccacttgcactggggcctgntttgcctttcttaaatgacctnaggtcaattgtnccaatta

SEQ ID NO: 558502 - DNA, 429 bp, Homo sapiens
tcctggagaacacgatgctcatgtaggctttcagaatacaggcaaaagccacttctctgcgaggaagacacgcctgaccgtgtataagatacttgagtttacttgtgggagctattgtcatctatagaagacctgaaagatcatctaacgataaataatacatagatctttgtggattatgggtggtctcatgataggaatttatgccatagaactgagagtggggagtggcaggtgcaggtttaataagattttccaggatgagttccaaaaatcagaattgccgagatctcagggtataatgagagaacatgatatttaagaggtggtttaaaagataataaggaggatccagttaaacaggataaaaataaggacagggttgttcatcagaaagaactggattattgtgcaaatgttattcgttac

SEQ ID NO: 558503 - DNA, 333 bp, Homo sapiens
taaaaacagacctttctcggtggtgcaggcgggagcgcaggggcacaatcatagctcatggggacctcaaattctggggttcaagcgatcttcccacctcagcctctgtgagtagcgggaactacgggtgtgccccaccacgccgggcgtgaataatggcattttgggtatgggtgtccgccaggtggccggtgcgggtctggaactcagcccaagtgatcggccggctggggcctcccgaagggcggggataataggcgtgagcaacagtgccgggtccggctgtattttttttaaaacagattggccctgggtgggtttgtgacttggggg

SEQ ID NO: 558504 - DNA, 108 bp, Homo sapiens
gcggccgcctactactactactactgctcgaattcaagcttctaacgatgtacggggacatgttcttgaacaatcaggtttctaaataaacaactggaccaccaaaaa

SEQ ID NO: 558505 - DNA, 115 bp, Homo sapiens
gtcgctagaggatcccctggcaaagatgtgtatgaacatgacggttagaagctctactccacttccaggctgcttcagaaatccattctcttgacatggccatcaacactaagcg

SEQ ID NO: 558506 - DNA, 750 bp, Homo sapiens
ttcatgttttaaaaagaaccgaagaagccacagggagggcctgagggagcccctgggctttcccctcagtcctcaggaaaggtggtcaggaaaactctggctggacaagggtcatgtcttcggggtcagcagcgagggattgctctgacggaggccaggtgagggagggtccccgcccaatgccggcgtggaatgaagaacctcgcatcttttggtgttgtatgcaccgttgtggcatgccatgtcatggaacatgcagctgaagagccctgcgcgccctctggccctcaacgggagcattttgcggatagaaaccagtaaggtagccttgcacgaagcccggtacgaaaaccggacgtgctacggctggattaggcggtgtaggggtacatcatttcccacaaccgtaataagcgaccgatggtcatttactccaagagcagagataggggagtccttgcagagctggacatagaggcgcccgcatgtcacttaggtctagcgctgacagaaatgaatgcgcaaggaagattttcagtccttgaacggtggattattagcaggtggacaccgtcgctcaataagtttcggccatcgtttataaatttccgtttgtctgcagcagaatgactacggaggaacgatctttcttacaataatctatttgtgtggataaaaaattaaaaaaggctttgtgtcctaaaagagttcatccggtgatcggggactcaatctgtgtgtctaccgaag

SEQ ID NO: 558507 - DNA, 243 bp, Homo sapiens
gttgaacttcttgtacagttttctaaggttgacactgctatagaagacactatgttatgttcctaaaatgtttatttattttaccctgaagatccttatcagcaattgtagaaagtcaagatttgttcatcagtacaatccaaagactccatttaccagatttttcttcttttctttaataaaatttgtctgtagggcttttaaaaatcatttataaacttagaaatgtattcagctgtcgac

SEQ ID NO: 558508 - DNA, 217 bp, Homo sapiens
ccttataacaggaaaacacgatggggatgcctgcaaaaagccatattagttaaagacttcatatagaagtcgtaagaattaagaaaattagaaggcccaggccaggcacagtggctcatgcctgtaatcctagcactttcggaggccgaagcaggcagatcacttgaggtcaggagttcgcagcctggtcaacacagctatctctactaaaaatacc

SEQ ID NO: 558509 - DNA, 184 bp, Homo sapiens
  misc_feature (66)..(66): n is a, c, g, or t
  misc_feature (114)..(114): n is a, c, g, or t
  misc_feature (125)..(125): n is a, c, g, or t
  misc_feature (149)..(149): n is a, c, g, or t
  misc_feature (164)..(164): n is a, c, g, or t
acacgccgctagaggtgcaacattcttggcaccggcgccaagcacggcacccagcagcgcaacagnatttgcccaagcaatgttttccattcaatccaagcaacgcaacagtcngcgcaggttcngcaagcacgcatccagcatcaccngctcgttcagttccngcacccatcaacacgcatcg

SEQ ID NO: 558510 - DNA, 363 bp, Homo sapiens
  misc_feature (47)..(47): n is a, c, g, or t
tgtccttacctaaattatatggaacaaaaaagaacctaaatagccanagataatctaagcaaaaagaacaacgacagaggtatgacattacctgacttcaaactatgctatcagactacaagaaccaaaagagcatggtacttgtacgaaaacagacacatagaccaatggaacagattagagagcccagaaataaagctgcacacctataaccatctgatctttgacaaagttgacaaaaataagcaatgggaaaaggactccctatgtaacaaatgatgttgggataactagctagccatatgcagatgaatgaaactgaaccccaacttttcaccatacataatacatttagggttgatg

SEQ ID NO: 558511 - DNA, 726 bp, Homo sapiens
  misc_feature (68)..(68): n is a, c, g, or t
  misc_feature (71)..(71): n is a, c, g, or t
  misc_feature (76)..(76): n is a, c, g, or t
  misc_feature (81)..(81): n is a, c, g, or t
  misc_feature (93)..(93): n is a, c, g, or t
  misc_feature (124)..(124): n is a, c, g, or t
  misc_feature (536)..(536): n is a, c, g, or t
  misc_feature (599)..(599): n is a, c, g, or t
  misc_feature (634)..(634): n is a, c, g, or t
gtcaagtgatataacctattgtaaactgactatcaaactcctgggaaaacaaatttggaaaatgcttnatnatatnaattngtcaacaatttntaagatatgacattaaaagctcaggcagtanaagcaaaaatatatcaaacctaaaaacttctgtaccacaaaggtcacaaccaacagggtaaaaggcaaactgtagaataaaagaaaataccagttgagtgtcccttatttgaaatgcttgggatgtgtttcagattttgtaatatttgcactattcttactggttgagcatctcgaattcaaacacctgagtctgcgatgctccaataagcatttcctttgagtgtcatgttggcactcaaaaagtttcagactttggagcatttgggatttcagatttttggatcagagacattcaacctatagttgcacatcatgtatctcataagaagtgaacattcagaatgcgtaaagaactcctacagagagactaccagaagcagagaggagcaaacacattttcacactagggnacctgctatctctcctggattccaattagggcagagtaagtgctagttctctgccaacccagnattaggccctgcagctgcagtgaaaataatcacanaagaaaactaagaaataaaaaatggagaaagtgagacatcaaactagaattactagaaacccccaggaagaaggaaaaaaaatccaaaaaaa

SEQ ID NO: 558512 - DNA, 710 bp, Homo sapiens
ctttctctttatgttcaccaaaacaatttgatatggacccacttcttttcatatacaatattgggtgggtaaaaaaaaaaccgcgcgcacccctctcataaagaaagaaccttccctttaatgagagtcctcgcagagcttctctttgcatgcgtggtagagaaacacacacccccctacagtaaggctgaggggaccttctcaaccaagaaaacccggttgttaaaaaggttgagtcaggcaaggactctgtaagtgaagcgttaattttcttagggactttgcttcgctgttcaaaaaaatatgcgcgtagaagccccagagcccgcgggtgatttttgtgaatagacctgttatgtgaagatgggcttcatccactgaactgcataaataaccgggccttctgtacatgcatgaagcagcccacttgtctgtgtagagtgttattctttggaatataaacagcgtagccgaacagtgctgtgtaggaagatatgcctcctatgcttctcacgggacttgttccaccagcaacagttagtaccctaacctcatggtgaggtaggataagataatcaacctttctcaataatttcttccgccaattattaatgaaattaagaattcttccgctggatctaacgatgacatttatgtacgatgttttctctggagtattctataagttaaatgttaagccaatcaagacc

SEQ ID NO: 558513 - DNA, 638 bp, Homo sapiens
atcaactttggcatggttccccaaggccctcaacagcaaatcagagactcaaggaatcccccacacagaactgataaaacaatataccacaatgaatcgacctgttaaataccacccctcgcttgccgtctgcctcaagaatactcccaagattactagaggcagggtagatctaactgtgggaagcaacccctatcacttcccgagggtagattgctggctcgtccaaagatgctccccctatgagggttccggagaaactagacgctggtacttattagtatcgacgacgtctgcgggcggcaattccacttcgaggagctgcatggttgattgcaggagtgtttcccactagttgccctatctccttcaattgtagcatcctgaccaaggcgtccagtcgttggtgcggtcaatccaaatgttccatccgtcatcatagtggcagtcctgaaggagctgtgttaccagctgccataggagcagggtgatggccctctgttttcacgccataggactccataacctctgacccatagaacttcctgtcctccatgaggaagtccctgaatctccggggggcgatattctctgggaagagattttaaagggaagggcacactgggaaacgtttttta

SEQ ID NO: 558514 - DNA, 996 bp, Homo sapiens
  misc_feature (201)..(201): n is a, c, g, or t
aggggtcatgtctgcgcatgtgtggcggatcttagccggacccctactcgctgcggggcgtcctgttgctagcagcgccgggctcgtggatcagctgttatggagaggcagaccgactcttctggcaactgatctacacatgtgaactacatattcgacatccgacattggtaggtggaggtcctacgcatgcgagtgtcnaggttgcgatacgcctgagcaatccaccagcataggtggtgacgttccctccatctctcataagtgtgtgcttggtcacagctcctcatgaccatgcgtctagaccaggcgttcacacgactgtgcccctgtgttaaccttgttgtctcacagaggaggcgcacagactctccgccaagctcacataaaagttgagacgcttgctacaaatcgagacaccaggtgtgactgaagcgcgtgtctcctcgctggatcatagaaggggatccctgtgggcgacgaggcccaggttgtccccattgggctcgtgtcttccctgtatcgttgtaggtcccgcaacagaagtcaagtgttgcctttcttttgcgtagtcctcgtttcatacgcacatagccttttctttgcccgtccgcttggcatcgagcctccctccccgtattgcactcttgggaaaccgtgttgcatgcgtagggcgtggtgtttgtggcctagcgagtcgtctcactgagtctttccttcttcccccgcaggcacgtcgccagggctgcgtgtgggcctggcacctgtttttgttctgggggccgtacggttgcgtcgtgtaccgggcatggggatgtggtggcgacgggaattgtgcaacacctatctctagtcgcccttgccgtccttatatctcccagagggaggagtagatttcccccttttcctccgtcggtgcattgctgggcttaatcctcttggatccccttaggctgcatttatcacgtgggccactggtatagccgggggctgacg

SEQ ID NO: 558515 - DNA, 368 bp, Homo sapiens
ctctatcaggaagtttttctattattagtttttgatttatttccttcaattattaatattctgtttttctggaaataataccaggactgatttcatagatgctgtattctcttgaatttgtctgaggatgttcttttgagttttttatttttattttttattttttttttattttttattttgaatgttttttttttttattatactctcaagtttaagggtcacatgtgcacttggtggcaggtaagttacttatgtttccttgtgccaggcgggtgcgctgcacccaattaaggtgtcatctagcataaggtatcatctcccaatggctctccctcccccttcccttgaagatggtgggtggggtc

SEQ ID NO: 558516 - DNA, 466 bp, Homo sapiens
  misc_feature (101)..(101): n is a, c, g, or t
  misc_feature (368)..(368): n is a, c, g, or t
ccggtgtggggatcgagtccacaactgtggcatcgttcagcatcatgcgctcaaccagttgagcttagctgactgccccgggacacttttcaatcaccccngaagagaaacccacgcccacccaggagtgccccctagctccgggaaccagtctcacggcatctctgtggagcggcctattcccaacacttcaatcactgcaatcacacatgaccctctacatttggcttttctccctgggcacaatgtcttcaagctccatccatggtgcagcctgcctcagagtctccttcttgtctttttagagccaggggtctcactctgtcaccaggctggagtgaagtgccacaatcatggctcactgctgnctccaactcctgggttcgagggatcctccgccccagcctctcgaggagctgggactacaggggtgtgccaccatgcccagatcatttttaagatactt

SEQ ID NO: 558517 - DNA, 307 bp, Homo sapiens
  misc_feature (1)..(1): n is a, c, g, or t
ncccatcacacctgctcaactacaaatgtcaatattgtatgaagcattaaaagacaaacataaagtatcttcagcttttatctatcacagcagaatgaatactaaaatcagtggcatataaacatacatcaaacatctatcaaaacaaaacatacaagcaaaaaatcccaccaatcttcatgggtaaactttcctgctcaggtatgttagcagactctagaccatcacgcggtttctgcggatagcacagctcatcgatcatactgaagatcatgccaaataccatgaccacggcaatgccgagcag

SEQ ID NO: 558518 - DNA, 590 bp, Homo sapiens
  misc_feature (2)..(2): n is a, c, g, or t
  misc_feature (74)..(77): n is a, c, g, or t
  misc_feature (111)..(111): n is a, c, g, or t
  misc_feature (116)..(117): n is a, c, g, or t
  misc_feature (135)..(135): n is a, c, g, or t
  misc_feature (156)..(156): n is a, c, g, or t
  misc_feature (175)..(175): n is a, c, g, or t
  misc_feature (178)..(178): n is a, c, g, or t
  misc_feature (181)..(181): n is a, c, g, or t
  misc_feature (193)..(193): n is a, c, g, or t
  misc_feature (206)..(206): n is a, c, g, or t
  misc_feature (214)..(214): n is a, c, g, or t
  misc_feature (224)..(226): n is a, c, g, or t
  misc_feature (232)..(232): n is a, c, g, or t
  misc_feature (250)..(250): n is a, c, g, or t
  misc_feature (259)..(259): n is a, c, g, or t
  misc_feature (345)..(345): n is a, c, g, or t
  misc_feature (350)..(350): n is a, c, g, or t
  misc_feature (379)..(380): n is a, c, g, or t
  misc_feature (382)..(382): n is a, c, g, or t
  misc_feature (387)..(387): n is a, c, g, or t
  misc_feature (395)..(395): n is a, c, g, or t
  misc_feature (399)..(400): n is a, c, g, or t
  misc_feature (403)..(404): n is a, c, g, or t
  misc_feature (406)..(406): n is a, c, g, or t
  misc_feature (411)..(411): n is a, c, g, or t
  misc_feature (416)..(416): n is a, c, g, or t
  misc_feature (435)..(435): n is a, c, g, or t
  misc_feature (444)..(446): n is a, c, g, or t
  misc_feature (450)..(452): n is a, c, g, or t
  misc_feature (458)..(458): n is a, c, g, or t
  misc_feature (487)..(487): n is a, c, g, or t
  misc_feature (490)..(492): n is a, c, g, or t
  misc_feature (499)..(499): n is a, c, g, or t
  misc_feature (514)..(514): n is a, c, g, or t
  misc_feature (549)..(549): n is a, c, g, or t
  misc_feature (557)..(557): n is a, c, g, or t
  misc_feature (571)..(571): n is a, c, g, or t
  misc_feature (577)..(577): n is a, c, g, or t
anaatcattatttattcaacacacttataccttatatcattttattaaaaaataatattcaattcattttaatnnnntaaaaacttataattcataactactccaaagatnttcannaaaccacaaaagacatgnaccttcttctactataaaaanaaaattaagcacttctctnggnttnctataccaactntttcagcccattntagttttncctctttcannnctttanccactatttcatttcatngaaaagcanatatctcctaacaaacagagtgacatttaccaaaataaagagggcttctcagttagaagcttaataaagaaaaatatttacctatnctttncacaattttcttttttttttttttatatnncntctcnctctttcnccannttnnanttcanttgcncgatctcttctcacttcancctccaccnnncccnnnttcacncaattttccttcctcaccctccttattanctnnnattacangcacgttccaccatntccagctaatttttgtatttttattagagacgggntttcaccnttttagccaggatngtcttnatctcttgacctc

SEQ ID NO: 558519 - DNA, 407 bp, Homo sapiens
  misc_feature (4)..(4): n is a, c, g, or t
ctgncccctcctaagtacggacactctgcaatcacttaagctctctgaccctcagttttcccctctttgcccacaggggtacccacaatctgtcccctgcccatcctacaggacagtgtcacactcaaccagagctctctgtacagaggcaagttgctggtacagtcatcccttggcatcagcaggggattggttccaagacaccctctccgcctcccaggataccaaaatctacaattgctcaagtccctgatataaaatagcatagtatttgcatataacctacgcacttcctccctatagactttaaaccatctctaggttacttatagtattgaatacaatgtaaatggtatgtaataatttttatactgtgtttttttatttgtattctttttaaccattat

SEQ ID NO: 558520 - DNA, 172 bp, Homo sapiens
ggtatcccacccaagcaagaacagcccctgaggttatgtgcccacggagaggtcaccacactctgttagagaaaaaggagctggaaaggtggtttatatattaaggagtgcatgcttggttcagcgccaaggtcagaaaacaatgtttccacaggtcacccaagaatggact

SEQ ID NO: 558521 - DNA, 195 bp, Homo sapiens
agcgcaacgattgacgttcttcgtctcggtacgggtgcctaatcgtctcgtctgccacgcggcatgatgggagacattggcgtcgcaacgtaggttgccgcgctccattctggcctcggaaaccccaagagcgatcatgatgtcccgtaactgagccatataggcacgcgcaacttgaggtgctttggctcccag

SEQ ID NO: 558522 - DNA, 799 bp, Homo sapiens
gtgcgcgtcgtggttgaacgcgtttctgtgccgcgtaatgcccggctatgggcagctgtgactcgatgagccggatataggcgcatggaaggttccctggaagtgggaaggcgccagtgggggcactggccgcgtgctaaagcagatgctcgtatgttggcgcgcgaaaagacaaccaggtccgggggctacagacttcaactcgcgtggtgtgaattaacgcgtcactgctggaggccttcgttcaccatccgggttccaagtaaccaaattcgggcgcgtctgtacagcaagtcaaatgccatgatcgagaagccaagctggaagtcacgtgtcacaggatgaatgctgcatcacgcggaactgacccatagacgccggccagtataccaggtgacagccatttttgctgggatatacatcacaacctcatcagatgcagtgaatccgtgagactcattcgctatcacttgtgcagcacaatatggttggacgtatggtgatcacagctggtcggcgtggaggaagacctcatcaagtgctggcgctcatgtacttggggcgagtttagcctcagtgtggaaggagctcctgggagaacgggatcaactaggatcggaaaccgtggcgtggtgccagtgatgaattacctggaaagtttgatggactggctgatgaccagttctggacagatggtgatggaggagaacacagagggtgttatgtggagcttttaagattgatcggctggctgggaagggatacagacggagtcgggtattagggccaaaagaaatac

SEQ ID NO: 558523 - DNA, 737 bp, Homo sapiens
  misc_feature (97)..(97): n is a, c, g, or t
  misc_feature (147)..(147): n is a, c, g, or t
tctattgtgtctgttgtctgtcgcattgtgttgtcatgatctgtgtcttggttggtgcttgggttgacaacaagcacccccatttctgtgatgaggngcccccacccccccgcctccacgatcgcggagagactctcgtccccaagnagcaatgcatgggtttattccaccgttctctcgttccgaccggccggtgtgttccaagcgccgcctgggtccacccacattgtttgtggcccagaccgcgcccctgctcacaccacctgggcgaaaccgagctgatcctctcatattttctgtctgggggcacaaccacatggagaatcttgggcgccccgagcaaaccccacaacgcaggctgcccacgggcctcggaaccgttctcctctggtgctgcaaccccgacggtaaataatgtgggagcccccctccccgggaaaagtttacccagccacacagtttcggtgtgggccttcccttagagggaggcaaagagattcacattcacgggggagattctggggagccctggtgttgccaaggcacgctcacaaggagatttgttcctcgggggacagctgtgacgccagacaaggacaacgcctgcggcgggtagcacgccacagcggtcgatacatagtcattgcaaacaggctgaagggagccaccaaggccccccccctaagccccccattatgttttggattcttaaacccaaaaaagaccccggaaataaa

SEQ ID NO: 558524 - DNA, 305 bp, Homo sapiens
  misc_feature (60)..(60): n is a, c, g, or t
  misc_feature (65)..(65): n is a, c, g, or t
  misc_feature (111)..(111): n is a, c, g, or t
  misc_feature (124)..(124): n is a, c, g, or t
  misc_feature (160)..(160): n is a, c, g, or t
  misc_feature (171)..(171): n is a, c, g, or t
  misc_feature (200)..(200): n is a, c, g, or t
ttgagcacgaatgtcaccgcccactcgcaggtgcgaaacaagcggtaagctgcgggtatngatcnggttgtcgctggatttggcttcactttcttggggtgaatgggctcnaggtttccacggntgggattcgttcgctcatggtcattcgctcatcagnctccatcaggncgacgaactatgggcgacagactgtttgnataacagactcaggtggggtgataaaaagcggatcagatcagcttgaagcgttcttgtgcgtcaatctggtgtgacacattcggtggtccagggtaccgagctcg

SEQ ID NO: 558525 - DNA, 654 bp, Homo sapiens
  misc_feature (611)..(611): n is a, c, g, or t
  misc_feature (654)..(654): n is a, c, g, or t
gatggcctggcccgggcctgtgctgccttaggagactggcaaaagtcagccacccatctacagaggagtctctgcgtggtggaggttcgccacgggccgtccagtgttgaaatgggccatgagctcttcaaattggcccagatctttttcaacgggtttgcagtacccgaagccctgagcacaatacagaaagctgaggaggttctgtcgctgcactgtggcccatgggacgatgaaatccaggagctccagaagatgaaatcctgtttgttggacttaccacacacccctgtagggcctgcattgtagggttccaggaggattttgacccacagaaaaggagcccatggaacacaagttaaagaggttttgctggccaggtatggtggctcacgcctgtaatcccagcactttgggaggctaaggtgggcggatcacctgatgtcaggagttcaagaccagcctggccagcatggtgaaaccccatctttactaaaaatacaaactagccaggcgtggtggtgggcacctgtaatcccagctacttgggaggctgaggcaggagaatctcttgcccaggaggcggaggttgcagtgagccgagatcgctncactgcacttcagcccaggtgacagtgtgagacttcatctcan

SEQ ID NO: 558526 - DNA, 156 bp, Homo sapiens
  misc_feature (138)..(138): n is a, c, g, or t
gttagtcacggtctggtcttcagctacccgcttcgtcttccagtttgcgactcgcggaccgcgttcccgcgcgcgaagagggctttgactctggatttcgtttgccctctagcaatggctgtccatacccggaagaanaactctgtatatgtttgg

SEQ ID NO: 558527 - DNA, 406 bp, Homo sapiens
  misc_feature (351)..(351): n is a, c, g, or t
gatggcctggcccgggcctgtgctgccttaggagactggcaaaagtcagccacccatctacagaggagtctctgcgtggtggaggttcgccacgggccgtccagtgttgaaatgggccatgagctcttcaaattggcccagatctttttcaacgggtgagtccctttcccacttcacagggcacacactgttcctttcctaggctcttctgggtattactttttttctatggtgtttttaaaagcatgttgaaacttctttatttcctctttaggagagatctttgccttctgttttgctaacaaacataacgctttagaatttcctcctgggaggcggagcttgcagtgngccaagatcgcgccactgcactgtagcctgggcgacagagcgagactccatctca

SEQ ID NO: 558528 - DNA, 600 bp, Homo sapiens
  misc_feature (557)..(557): n is a, c, g, or t
  misc_feature (600)..(600): n is a, c, g, or t
gatggcctggcccgggcctgtgctgccttaggagactggcaaaagtcagccacccatctacagaggagtctctgcgtggtggaggttcgccacgggccgtccagtgttgaaatgggccatgagctcttcaaattggcccagatctttttcaacgggtttgcagtacccgaagccctgagcacaatacagaaagctgaggaggttctgtcgctgcactgtggcccatgggacgatgaaatccaggagctccagaagatgaaatcctgtttgttggacttaccacacacccctgtagggcctgcattgtagggttccaggaggattttgacccacagctcacgcctgtaatcccagcactttgggaggctaaggtgggcggatcacctgatgtcaggagttcaagaccagcctggccagcatggtgaaaccccatctttactaaaaatacaaactagccaggcgtggtggtgggcacctgtaatcccagctacttgggaggctgaggcaggagaatctcttgcccaggaggcggaggttgcagtgagccgagatcgctncactgcacttcagcccaggtgacagtgtgagacttcatctcan

SEQ ID NO: 558529 - DNA, 110 bp, Homo sapiens
ctgggcgtatatactgagctggtggccactgaagcaccacagtgcagtgggaagaaacaatggagagacaagctgggtccccagcctaggaaacatgaggtgtggcagcc

SEQ ID NO: 558530 - DNA, 533 bp, Homo sapiens
agtgattctgctctatgaggtacgtgtactactgtataggggttagcaggagtaggcacccgatatatgttcttctaggcctttgtagattaacatggagttgttcctttggccactatatatgctgatatctataagaataggtgattattgtagacattaagggaatgggtactgttctaaaatggaatgcccctacaagtgttacctatggcttataactggaagagtctacaatgttacccagcatgctgttggcattgttgtaaacaatacaagttaagggcaacgattcttgccaagtagaattaatgtgcgtattgagcacattaagcactctaagagtccgtagatagcttcctgaaatcgtgtgataggaataatgtatctagtaaatatagatatagaagccataagagaataggtacctgggttctaactaatagcgccaagcctgcgtcctatcccagagaagcacactttgtgagtacctatgggaaggagcctgagctgctggaacctattccctatga

SEQ ID NO: 558531 - DNA, 205 bp, Homo sapiens
ggcgtactatgtatcgcccaacacacaatgattccatttatagcctggccatgaatcactgggaacaatcattgtatcaggatccactgaaaaggtgttggggagagggattttgcatgtcaacattaaggacacataaggattacgtaaaggccttagcatatgccaaggataaagaactagtagcatcagctgggttggggat

SEQ ID NO: 558532 - DNA, 155 bp, Homo sapiens
  misc_feature (12)..(12): n is a, c, g, or t
  misc_feature (96)..(96): n is a, c, g, or t
tcatataggttnctttctaaaaaaagtcttcttgctattcaaatgtacgtccgagatcatgagtgctgtcgttctgctgctgacttctggatgacnctctaagttggtttttgcattggctgggtagtaaggtagcaagggcttttggttttcat

SEQ ID NO: 558533 - DNA, 263 bp, Homo sapiens
gcggccgcctactactactactactgctcgaattcaagcttctaacgatgtacggggacatgcctgtaatcccagcactttgggaggccagggtggggagatcacttgaggccaggaatttgagaccagcctggccaatatggcaaaaccccgtctctactaaaaatacaaaattggctgggggtggtggtgcacgcctgtaatcccagctgctcgggcggctgaggcaggagaatcgcttgaactggggaggtggatgttgc

SEQ ID NO: 558534 - DNA, 100 bp, Homo sapiens
ccttgttgtatgttcccctacacacttataacctatggtaagagttctaatgcttgacaacagattttaaaggtcacagaacagttttaatttttctctt

SEQ ID NO: 558535 - DNA, 216 bp, Homo sapiens
ttacaaccccacgatcaccgggttggtgtacaataggcgttgattagtagtagttactggttgcacattgtttgtcggtgtctatcttgtcattcagattgctcggtgggactaggtcatgtgattaggagttgggttaggatgagtgggaagaagaaagagaggaagtcaagtttaattatgcctttctgggttgaggtgatcgtggggttgtga

SEQ ID NO: 558536 - DNA, 635 bp, Homo sapiens
  misc_feature (505)..(505): n is a, c, g, or t
gccgaatgtggatagcatgagtcatggtcctacgctaccttatggtcgtgtgccttaacatgggccacgaagtggccaaaaacgttagcaagcccaggcacagccgacgtcgtgtgcgtctgatcaaacacactaagttctagcgggacatgatttgataggtgtgtggctttgacctgtacgagcggcgcgccatggagctactgaaggtttttaaggacttacggggcctcaaatttgtcacgaaaagggtggatacgcacatttgagtcaagaggaaactttaggagcttagcaacgtactgatcggcatgaggaaagctgctgccaagaaagactgagccattgcgctggcctgtgactgtagtaatgaacagcttgaaaaaaaaaaaaaaaaaaaaaatgcggccgaaattagagctcattgggccaattcgccttataggggagtcgtttacaattaattggcgcgggttttacaacgtcgggactggaaaaaccttgnggttaccaaatttaatggcttggaagcaatatcccttttcgccagttggggtaataccaggccccgaaccgatggccttttcccagttgccaagcttgattggcgattggaatttggtacgcgttttttt

SEQ ID NO: 558537 - DNA, 469 bp, Homo sapiens
tctcgtgctcctgggttgcagtgattcacccggcttggcgttccaaagtgttgggtttacacatgcgaaccattgtgcctggccaccttgtattgttttaaatagcatacgttaaaaagagtgcagaacactgtttgagcattgtcatttaatgaatcagcagtgcatcagactttcataggcaacaaatttggtgattaaaaacatgtcactgtcagcatctctggactgcatttcaatagtggtatgtgtaccatgtgtcccaaccattcacacagttctctgtatcatctttcatcttgagcttctctccatgtgcatcatctgtacgttaggatcatgtttctggtgaacgtggtatagctataggtaattgtatattgcaaacatttagcaaagggccttctgcagctgaaggcttctgagggagccatgcagaaattgaagtatgcaacttctccttttccca

SEQ ID NO: 558538 - DNA, 517 bp, Homo sapiens
  misc_feature (13)..(14): n is a, c, g, or t
  misc_feature (18)..(18): n is a, c, g, or t
  misc_feature (24)..(24): n is a, c, g, or t
  misc_feature (333)..(333): n is a, c, g, or t
  misc_feature (337)..(337): n is a, c, g, or t
  misc_feature (356)..(356): n is a, c, g, or t
  misc_feature (412)..(412): n is a, c, g, or t
  misc_feature (447)..(447): n is a, c, g, or t
  misc_feature (473)..(473): n is a, c, g, or t
  misc_feature (479)..(479): n is a, c, g, or t
  misc_feature (498)..(498): n is a, c, g, or t
ccattcgaatcgnnctcngtaccntgcagattccttccactcgtatgggttggatacgcgggtgaatcataggaatcatttgcgtggttcgcgtaggacataaccaactccgcgcagggtgtgcaggtatttcacgtcaccagtgtcaatttttttccgcagatacgaaatgtaggactccactacattggcatcaccattaaagtcgtagtcccacacgttatccaggatgcgtgccttagacagcacaacccccgcgttcaccatgaaatatcgtaatagggcgaactcagttggggtcagctcaactaattcccctgccttccacacctngtgngtgtcgtcatctagctcantatcggcgaacgtgaggtgattactgggttgaccaaaagactgcgatcactacgcncgcaaaattggtccgtagcccggcaatacttcttncaagctaaaaggctttggtgacgtantcatcnggccccaaggtcaatccgnggacgcgggcttctatggg

SEQ ID NO: 558539 - DNA, 287 bp, Homo sapiens
gacccaagggcaggagcttgagaccagcctggcaaacccccaaaaccccatctctacaaaatacaaaaattagctgagcatggtggcaggtgcctgtagtcccagctactccggaggctgaggcaggagaattgcttgaacccaggaggtggaggttgcagtgagttgagattgtcccactgcactccagcctgggtgacagagtgagactgtctcatatacaatacaaaacaaatgaatgtaaaacatttagtgaagtgactggtagctagtgagggctcattaag

SEQ ID NO: 558540 - DNA, 311 bp, Homo sapiens
gagacaagatctcactctgttgcccaggctggagtgcagtggcacgatcctctagcctcgatctgctggactcaacgatcctcccacctcagcctctcaagtagctgggaccacaggcatgcgctactgtgctgggctgattttttaattttttagagatgttatcccactatgttgcttaagttggtcttgaattcctggactcaagtgttcctactgcctcagcctcccaaagtgttggaattacagatgtaagccaccgtgcccagctctgatttacgtgtatttctgtccccttctgtcgtcttctc

SEQ ID NO: 558541 - DNA, 1496 bp, Homo sapiens
  misc_feature (337)..(337): n is a, c, g, or t
  misc_feature (339)..(339): n is a, c, g, or t
  misc_feature (409)..(409): n is a, c, g, or t
  misc_feature (426)..(426): n is a, c, g, or t
  misc_feature (841)..(841): n is a, c, g, or t
  misc_feature (1101)..(1101): n is a, c, g, or t
tggtggtcccaaatttttggaaaattaattacagcacttacagaaaaaatttcaaacgggtctccccgaggcgttttggaaatttcatctcccaactgtgttaggcgtgagttgacctgtaagggttgtggacagacgtgccgaagtctccaaaagctttcagacatttctccttataggtgctcgggactcttactctcaataattctcctgtgatctcacagggggctgtgagaaccgctctcaggagacacatataattgtgtctctccctcccattttctctcttctctccctctccctctcctgtgacaggcttgtgatggagaaagattcncncttctattaaacggggggcggaccctctctctgtagaaattctcggctttctcatcctcagagatgtcgncgtttgaacaatataancgctgtgactataactcttggagagcgcggagacgcttttatgagcgcgtggggcgagaatacaagtgcgcgcgagattctctccctttcgggcaacacgcgcgcggcttttgtccccgtgtttgtcgagaagctgcttccgtgtttcggccacagagggcgccgcgttgttgataaagatcacttttttctcttagttagaattagcacccccggggcgcccgcgcctattctatctcaccggggtgttaggggggtgagcgagaaaccggcggcgcccctatgtgtggggcgcggggggtccctaaccgaggttgcggggagaacacctatggagaaagggcgagaagagatctgggcgagaatacacccgcggtgcccccccgagaaagggagaggagggctcttccccccncccaaagaggagaggagaattcctccgggtgtccccaaaagaaagcggctcattgaagaacccgggcctttaggcccctattaacacaaaagaggggagagggtgtcacccccggagaagaaagcccgccttggttgacacaagggcgagaattaacatatacccccgcgcgtttgtacgaaagcagaagcggcgggggagggcccacaattcccttttggggagagagaggaggcaccataaccattattgggggaccnctttataccagggtgtttccttacggagaagaattccgaggcgcagggggaagaatccccggggggggaaacaacgtggggggggcacctcattactggggagaccccgcggaaaaaagtagatatagttggcccacgaacaccatagtgttggccacgacaaaaagagcgggccgggacaacccacggggtgttctgttttggttagtcagagggggcccttcctcttgtgaagagagagggccgcacaaaataagcgatatataagggcggacaagcaccgcccgggtgagtttggtgtggccaacacaactgataacacagggggggggggggtccacccctgtggtggtgttgcccgagaaattgggagggaggattgtgggtgtcccaga

SEQ ID NO: 558542 - DNA, 400 bp, Homo sapiens
  misc_feature (90)..(90): n is a, c, g, or t
  misc_feature (103)..(103): n is a, c, g, or t
  misc_feature (114)..(114): n is a, c, g, or t
  misc_feature (247)..(248): n is a, c, g, or t
  misc_feature (295)..(295): n is a, c, g, or t
  misc_feature (311)..(311): n is a, c, g, or t
ttcatgtgtctttctgtagacatatctgaagagatggattaagaatgctttggattaaggattgtggagcacatttcaatcattttaggnattgtcaaaaggnaggattgaggnaggatcagatcaataaatggagcgcaatggagcaaagcgaggcacctggaagataaaccgctggagcaatcctccttggaagagattcaggcacgaggtagatcggtaaacattataaagggagaaagggggnnggttgtgttataaaaatagtaaactcacgtaatgtcacttcttaaantttaaagaaaaacaanaattggagttgaagaaataagtaggtttccaattgggctattgccgttttctttgaaaaaataaacattttttaaaaaacaaaaaaaaa

SEQ ID NO: 558543 - DNA, 903 bp, Homo sapiens
  misc_feature (513)..(513): n is a, c, g, or t
aactctggggctcaagcagttctcccaccagcctcctttttatttttttgtacagatggggtcttgctatgttgcccaagctggtcttaaactcctggcctcaagcaatccttctgccttggccccccaaagtgctgggattgtggtgctgagctgctgtgccagcctgccatgtttttatatttcactgtctttcattcttgaatttccacagtgttttagccccagagagagagagccctggatcggagaactacagagggcccctctcaaggggcgaacaagctgggggctactgagcgtttgtgcgccactctgtagaggacgatatggtgtagctcctgtatagacttatctggggtgccttcttcactgatattccccgtcgggatgattatacctgtgcaatggggggagggaaatccagtgaaacttgattctcgagggaagatgtggggtgcagtaacgtgggtgtgtactataatgctttattgagctcagagggcaagtatngtactcctcctccaggatctaaaaataggtgcctaaagtggctgcagtcaaaggacagagcggaagctatgacagagcgggacttgggtgatgtatcgctgagccgactgccatgacatccttggccgttgaagtctgggcctggcagatgtccgcggactagttgaagctgcttgagggagtggaattggacgggaggggggcgtagacctacatctctctgtcaagattctctggccacgggagtggaagggggagggttcgcccgcattcttgtgttgtttggtctcgcacagaaaccccgcacggcttgcggtgtgtcactacgaccgcacaaggacccccccaatgccgcggccgttttttgtttggattggttgtcctaaccgc

SEQ ID NO: 558544 - DNA, 247 bp, Homo sapiens
gtcccccccatcctatgagaccagacaaaatcttggatcagatcctcacctgctcacacactgggttctgcacattttttcaggctttgtcacacactttccaatttctaagtgtacaaatgttagcctctctgggcttcctatctctaagaaatcttgaatctctgaagtatctttctttctttattttttcccatgctgtacagcaagaggatcacgtaactcttacatgagaccgctcttacgg

SEQ ID NO: 558545 - DNA, 228 bp, Homo sapiens
ctacgtacgttgagtttggaccgatatcgcttgctaccagttagttctcatgcgactaatgttcttcttcgttctatgctactccgcgagatagcgcagggaccgctctgattgacagatgattattcgcacaacaacggcgatacttcgagtagggagagcattatgtatgtctctcttgtgaggactagttctttaggtggtggttagagaatagtatctgtttct

SEQ ID NO: 558546 - DNA, 604 bp, Homo sapiens
ccccccagttatttcccaagtgaaaaagtgttataatatgaccagatgttttttgattgtaaagccggtaaatcttttgagagtgtaaaagcccggctaggccattcgccacggtaaaacacaccggggttaatgaagggcttattaacttgtaggggaacccaactgggaaagaatcccgatccagatattttcctgcaccaaaaaaaaatgaccccgtagaccagcatccaaaatgtggtgttcttgttaagtaattgatcgtggtctttgctttaatcttagttccccccggcacggtggctcaccacctgtaatccccagcaactttgggaggccgaggcgggccagatcacctgaggtcaggagttcgagacccagcgtggcccacatggtgaaaccccgtctcttactaaagataaaaaaattagctgggtgtgttggtgggtgccctgtaatcccagctactcgggaggctgaggccggagaatcacttgaaccccggaggccgaggttcccgtgagctgagattgcgcccctgtactcccgcctgggccaccaagccagactctgtttccaaaaaatacaaataaaaaaaatctta

SEQ ID NO: 558547 - DNA, 178 bp, Homo sapiens
cgttgccccaaactgtgacatacgaaggacatgctttattacacaagcaaccataaaacctgtcccttaagcttttgaccgtgtttgtcacttaaatatatgtagcaggaagcgggctcctcttctcatccatgtcgttgcaggtggcagcgttagcaggctttgggtgggcctggag

SEQ ID NO: 558548 - DNA, 481 bp, Homo sapiens
cccagcggccgctgcggcgcgggcgctggcgcagcccgccagtgcgttctgacttcgaccgtcgagttccagaacgtcgcggctctcgaaccgcacgattgaacgctcccgctgcgggttggctccttttgccgttgctgccattcctacaatgccttatcgtcctgaagccttccatatcaaaagatgcatgcccagtgcaccatatgtacaggtgaataccatgataaagcagcatactgcagtataatgcctcacatgccgacataacttccatctggaatgtatagacgtatggtcacaaaaacaaactaattgcacaaatatgtcttatctcattgcaggaccaaaccatggatgcaaaatctacagcatcccctctccgtaccctcactcaaatatagggacctgaccgagagctctgtcaatagatcgcctacattggatacttccctatccaaacgtgaccatgtgggaggat

SEQ ID NO: 558549 - DNA, 1433 bp, Homo sapiens
  misc_feature (417)..(417): n is a, c, g, or t
  misc_feature (466)..(466): n is a, c, g, or t
  misc_feature (468)..(468): n is a, c, g, or t
  misc_feature (475)..(475): n is a, c, g, or t
  misc_feature (1433)..(1433): n is a, c, g, or t
taaaagtatttagcttttaatgaaactccctccttgttggtttcaaccccccaggacacaggcccccccaacactctctttaattctttcttcctctcagcttctttctgtgcttgaaaaatttgtggcctttcacaattagacaggctgtgctttgtggagagcttttccctttctcccagaaactttgtgtagttaccccagattcgcacccacatatctcatatgagtgtgtggagagcacacgccccgagtctctgtgtgtgtttttagacacagacatatctccacccgtgtgtgtctgtgttctccactgtgacaccacaagagtctccacacaaattgtgtctcccagaggtgtgtgacacacagtgtgtgtgtgcccagaacaagactctctgtgtgtgtctcctctcntttatagagtgtgtgtataatgtgtctctctctatatatcacaaatctntntctctcncaacaaatgtatatgcccgctgatggtgtgtgtataatttgtgtctgcgaaaagttgtgtatctcgcgcgtgtgtgtgtgtatgtgtagcacaaacacacacacacacgcacatcttatatccgcgcgctggcgcgcgcgcgccgggagtgtgttctatccgcggtgtgtgtctgtgcgctctatgtgtgcgcgcgcgcgcgtgtgcccccgtgtgggctctaccacgcgtgttgtgcgccctctatatgtgtatctccccagagagtcgtctatctcactctccaggctctcgtgagagtgttggccattttgttttgtggctcttcagagagaggccccgcgcacaaattctctctcacacacaatctcgtgcttcccccccccatttcttgttgtcaggggtttttcccccagaggggagcctcccctctcagagcgccccacacaaaagagaggaggggggccgcccctgttgtgtgccccctgtgagaataaaggggcggcgccaaagaatagcctcttgtggtttaagggggcctattgtagaaagcgcgacacaaacgagggcgcccccggagcgagagatatttcccgaggaaatttataaagcgccccccagggggcgccccccgggggccatcctttgtttgtaagccgcgggcggggcccccctccttgccggcgggagattccaaaggagggccaagccccggggagggtgtcccccccccaaaaacagcagacaaacccagaggccgccgggggaggatcaaccaaggaagagcgcccggataatcctcttctccaccacagaaaatggggttctcgcagcatagagcactcagacgaaaaagttgacatcccctgggtcctctttttcgacacccccaggataagagggccccgcgttttttcgcagccccaaaaaaccgttctaaaaaaaaggggtgggcccn

SEQ ID NO: 558550 - DNA, 729 bp, Homo sapiens
acaacaaaatatgactacgcgtccttcgtaaaacgtcacgaggacttctctaatttaggtatttggcactagtgcatggatccttagttcatatgagggacaaagtttctcagtcagccccactatccatatacttactaactcctaccttacccttgacagaggaggtagtagagattctggaattagtctatttttatgaattccattatttttgtccatggcatactctaatgaaaacagtgttctagaataaatgtgagtttgattatgtctgaacatgtactaattaactacaaaataaacgttagatgatcagcctacttcctctataaacaatgaccaattagacgtttccgtaattccatgtattatgtatatgtacactctataaatgtaaatgtaatgctatgtctaaaaagtgcaatttattgtacattgtacccaaccaaatgtttactttcataatcgttatgaacttgaatcggtcttagctctctatgtgtacatgtgtgacatgaagccttgttgcatactacaccatattgcaactgcgaacgtgtacaagggtgactagcatatatgtagagccagtgaatgtattcaacagcttttgtgatagccactttcggacccaataaagcaggtaataaataattgatctgaagttcacaaatatcgaacatacactcactcctcttcgattattcaactctcacatataactct

SEQ ID NO: 558551 - DNA, 165 bp, Homo sapiens
tgcaaggtgtcttccaggtagatgtggtgttcactcagagcctatgtagacatgcagccagcaccttctcggtaacatactgtcagcgcattcaagtcatggtccccatcaggaggatctcaggctcaacgatggcacaatgccatctgttgcagatactgccat

SEQ ID NO: 558552 - DNA, 180 bp, Homo sapiens
actgttcgaccaggttgacgtgaggcagaggctgggcctggaggggccaccaatgatgcaggagctgggcctggaagaggctgcaatagtaagcatgaggctgggcctaggtgaggtcaacttgagtaaagttcagtggcctggatgagaaggctgcggaggcgaggagctggtgtctaa

SEQ ID NO: 558553 - DNA, 188 bp, Homo sapiens
taaacccaccatcacaaaacacaaaattttgcagcgaagagaaatgaagaaaaactgaagaaaaaaaaaaaaccgggaaaaacaagacccatacaaaattttcccaccacccatacccgagggtggcatttgccccccccggtattgtgcaggacaattcaaaccaagaagcatttaaaacttacccg

SEQ ID NO: 558554 - DNA, 833 bp, Homo sapiens
caagggatggcactgtgacattaggcacagggctaatgtgtgtgtgtgtgtgtgtgtgtgtgtgtgtgtgtgtgtgttgtgtcgtgtgtgtgtgttttgtagggacagagtctcgcttttgtctcacaggctggatgtgcaagtggcgtgcatctcagctcagtgccactctccgctctccttgtgttcaaagggattctccctgcctcagcctcctaagacagtgctggagcatctactggacgacgacaccaacgacgcgctggtctaatttaatatgatgtggatcagcaggctgcggtatctcaccgatggttggcccagggctggtctcaaattcctgacctcgaagtgatccacccatctctgtctcccaagatgtgcttgggacttacaggggtaatgacgccactgctgcccggtctgtacactagtgtatttcatcaaatctgcaggatcgactgcagggtcatcatgaaaccatgaaagacgtgacacccggcactatcgcgcgggggaacatctatattcgcgacttgtcaatactaccatcacttcatagtcatacttactcgacctactctatactcatccacatttcactacaactaccatctatatatgtcaccagactcacttcactacctaaataaataatgtcgcacaataccgcatctggtctttctttacaagccctcgatcgccagacggctagctgaacccatttagtaggggtacgtatacaagggcccagcttcttaagctggtcatagtagaagtgaccgacgatgatcagtgctttaaaaaatgttttacaagtgaatcccagcagt

SEQ ID NO: 558555 - DNA, 461 bp, Homo sapiens
  misc_feature (312)..(312): n is a, c, g, or t
ctgtattttcagtagagacagggtttcttcatgttggcctggttggtctcaatgtcctgaccttaggcaagccacccgccttggcctcccaaagtgctgggattacaggcatgagccatcacgcctggtgaatggtgtcattttgatgtactgagccatctcagtttttccagcaaccttccctcacctttgtggtcagctagaaggtcagttaacacatgggatgggaattcttgccaatgtccttcgtaaaagaagaacttctccttcactcacatgtcctgatacttcctcagcatttcattctagccnttctgtctccatccaccatctatcaatcatctatcatctagctatctatcgatttctcttttttggctttaattttgtcactttttcttctgtctgctatagaaatagcaaattttctatgtaagaaaactccgaacgctagcccaaat

SEQ ID NO: 558556 - DNA, 307 bp, Homo sapiens
  misc_feature (94)..(94): n is a, c, g, or t
  misc_feature (148)..(148): n is a, c, g, or t
  misc_feature (160)..(160): n is a, c, g, or t
  misc_feature (229)..(229): n is a, c, g, or t
  misc_feature (248)..(248): n is a, c, g, or t
  misc_feature (285)..(285): n is a, c, g, or t
acatcagagccagcaacggtgccctgagaaggcggttagggcgtcacgactttccaaggggccatgccttctctccacccaaatgacacaagantctatctttaaaaggcacaggaaccacagacaaaggttaagtgacaagcaagtnttctcaaggggnctggagcgccacgcagaccctgccttttcgtttcaatgcactgtctttgctgaggccataagcaggagncccaccaggcggtcttctnttggtttctgacctcacttttcagagggaggggaganttagaaggcttggcaggaaaaa

SEQ ID NO: 558557 - DNA, 179 bp, Homo sapiens
  misc_feature (28)..(28): n is a, c, g, or t
  misc_feature (37)..(37): n is a, c, g, or t
gagcaggggggtggaggccacccagagntggtgttgncagagggaggaagaaacagcatcaagggaccgggcatggtggctcacacctgtaatcccagctgggaggccgaggcaggagaatcacttgagcccaggagttcaaggccaccctgggcaacatagcaagaccctatctatac

SEQ ID NO: 558558 - DNA, 886 bp, Homo sapiens
gagctcgctgttcgtccgggtttgtgacgttgtaaatttccaggacttgaactgcgcatgtcgctctgaagaaggaaagctcttcggtggagtagggctcaacttataagaccgacgagcaggcagggagaagagcacttcagcaggtttcggacctatctctgaggtggtcgtgtcaaggatcgggagactcagtggtccagggtgcggtttcatcaacttcagcatcccaggagcatgcttcagttgccatgagagccatgaagcgggagcagtctctggatggtcgtgcagatccgtgtggactcatggcagggcatagtctagctcggggaaccagaggaggtggcttgtggcccatgggcgtggtcgacatggatactctagtaggtggtggggaccatggttatgggagtggcaggtatttatgaccagtcgaatctggtagggtatggatatggatatggatcggttccagagactataatggaggtagaactcgagggtggtatatgaacggtgactcaggaggtaattaacatgagaacatgttatgaggttgaaattgtgagtgcgttaatgattagatacacaaggactcatttttgttccaggattgtccttccaacggcttactgataagggttcaggagcggaaggagcatttatcatagatgtataactgggttaaatgtgcgccgggtgtgtaactttataacggtcatccttttttaaacttggcgccatgggccacttgggggctgcacgtggtttgtagcaatcgtggcaggtttgggaaaaagctgtggggcacgcccatagtctgcgctcccacggtggtggcccatagagcaacacaaaaggcgcgccttaacggcgtcgcact

SEQ ID NO: 558559 - DNA, 263 bp, Homo sapiens
ttaggtattgatcaccttcttaagagatctgtatatcaggtagtgcataatctgcacttagcattggctatgcgcacggatgtttctccttcccacgccagtatgccacatgatgaactttcgatggttgtcattgatgtcagttgtgaactttctgtaataacaaaggcagtccgcattcttccctttcccccgaatttctagggtcaaaaactttagttatggcgcttgttaatcatgggatgtacacaaagccggccatg

SEQ ID NO: 558560 - DNA, 305 bp, Homo sapiens
  misc_feature (39)..(39): n is a, c, g, or t
tgaaaggtattggctcccctgttttggtgtggactcaantgcaagtggtgtttaagaggtcaggaggcctgctgatcttttcaaggacaccccatatgtctactcatagaaagggcaagtaacgtgttcattttggtcttgaatgtccaaactcaagggttggattttggccaattgaaatcagacatatgcgatcttgggtttttgcatggaaattaatgtaatgcttataaatgaaaaatgaaaacatttcaaccatctaagtcaaacacaaaaataataaaaaaagaaacatactggccttg

SEQ ID NO: 558561 - DNA, 136 bp, Homo sapiens
actccccccccgacctacgcccgacgacgtaccttcgacgttcccttacccatttccgaccggacgactcgtgactcctcaccggaccactcgtgactcctcaccggacactcgtgactcctctgggtaccgacgc

SEQ ID NO: 558562 - DNA, 795 bp, Homo sapiens
  misc_feature (152)..(152): n is a, c, g, or t
atagtgtgcacaggcggtcgcactgagcaggagttactgatcccagttgatagggtggaaaacaatggctgtcgcttgcctgcttatacagctatgcgtttcttctgcatgatccagtgtggagcagagactgtgaagaagcggtgccgtcnaggcccagtgctatagtgagttggattcatccagtaccttacgagtgcaacacacgaatcttgggtccagacatgccacccttgacgcgctccaaaagaccgataggatcatcctcgtgagggaaaatactagaagaattaaaaatgctggtgaaagtaggaggacgtctatacgttgccactatgagaaatgcttgagcgcctctttgagattgcacgtgtgattcgtacgcatagaacgtaggagactccgacgaagaaagaaccgtgctgcagggaaggggcaattatgaccagaggtacaaaccatacatttccgagtgaaaaacgttggccttgaaacggagaatggttgtccctcaggagaagatgagaaaggcctaatttaaatatgcagtgaatcctggaggaggtgcaagaaattgtgggttatgatctaatacctgacaattgtttttgcagaggacgaaggtggtgacaggtagattggtagggaagttgcggatacgaatgcactgaaattctgaaaggaggcttgattgacgagaacttgagagtcctgactaaatttgtgttcggggagaacctggatttttttttccaatttgtcatttttaagatatttcacggaggaattgtaact

SEQ ID NO: 558563 - DNA, 262 bp, Homo sapiens
aaacttaattttggaagttttactttcgagggtgaggaaagggtgaaatgtcggtatgtaaactttgtcgccaaaaagccccaggagaaatgaaaaaagaaacaaatcccttcagttaaaatgccaggggaaaaacacttttgaaaaacaaaccccgaaaagcccaatgtgtttttatggggttgagattttttaaaaacgagttttggaaaaaagttttttgatgtttacaaagttccccgtgaataaagggcaactggga

SEQ ID NO: 558564 - DNA, 146 bp, Homo sapiens
ccaacgaagatactcatctctctggtccagtgatctgtgagtgaagctggagaatcggacagatgcatcactgggtggatggcgttgtttaagaaaaagtgcaggaggatgagttccgctatctgaatgtaccagaactcaggtct

SEQ ID NO: 558565 - DNA, 275 bp, Homo sapiens
gtctgagaacaaatggcacagcatccctgccaggatcaggaacaaaaggtagaaatgacctccaagcagcagagaagcacatccatagaagagacaatgagaccacaggaaaaacaggtaaccatcactgaaaccctgtgggaccaggtgctgacagtttttaaggatatacaaaaggagctgcaggaagatgctcggattcgagggatgagcaactgctccatgacacccatgacatcagcacccaggactggaagcataaggcctccagattc

SEQ ID NO: 558566 - DNA, 277 bp, Homo sapiens
cctgctttctttctgttcccgggtggcatcgacccgtcggagagtaaatgccaagtaaggtacctgccgttggcagattttgagctttcttcttggacacctaatacccacagtcctccagtaaatcccaagcaaggtacctgccgtcagcagatttgagctttcttcttggacacctaatacccacagtcctccaggctccggtagattgcaaatgacctgctttctttctgttcccgggctgcgttcggacccctgtgggatagtaactcccaag

SEQ ID NO: 558567 - DNA, 196 bp, Homo sapiens
gaaagtttttccccctttaaaatatttgggttttgtttaaaaaaagttttgtccaaaacccaaaatttaaaaaaatggctgaaggttgttgcccggctttttaaaaaaaaatttttttaattgtttttgtttgtttgtttttcccttgtaaaccagggcccagggattgccgcaatttaaccccccttttgcccca

SEQ ID NO: 558568 - DNA, 420 bp, Homo sapiens
ccagcctaggtagcaaatcgagaccccccccaagtttataaattattacaaacgaaagacgaaaatagctgggtgtggtggctcacacctgtaatcctagcactttgggaggccaaggtgggtggattgcctgagctcaggagtttgagaccaacctgggcaacatggttgaaaccctgtctctactaaaacaaaaaaaatcagccaggtgtggtagcgtgcacctgtagtcccagttacttgggaggctgaggcacaagaattgcttgaacctgggaggtagaggttgcagagatcatgccactgcactcccagcctgggtgacagagcaagactgtctcaaaaacaacaacaacaacaacaacaaaacaaaacaaaaaaaacctctcaaaaaaatgaaaacaaatttaaatttaaatt

SEQ ID NO: 558569 - DNA, 238 bp, Homo sapiens
aataagagtagggggggtgtgggtgtgtaccagagaccgagagcatgagtggggtgtgctcgtgtgcgtggaattcgtgtgtgtgtgtgtgtcttgtatatatgttgcgcagagtgcatcattttcagactctactatttccaatcaagtttctgtttgatttggatcatctcaggatcggattctgttttagagtgtttctgggccaggatccgggcccctgtcctcctctgcacct

SEQ ID NO: 558570 - DNA, 362 bp, Homo sapiens
  misc_feature (206)..(206): n is a, c, g, or t
tactactactaaattcgcggccgcgtcgactccgcccacaccgtcggcctcggcgtgcagaagaacagcggcaacagcgacttcccgtacctggactccggcctgaacagcggtgccgaactccagggcccgggttcgggcgccgacagcccggcactgaccaatatgcaattgaacaaattccagcacgcgggtgagcgcagctngctggcgcagtacaaatatgacttcgcccagttgggtgtgaatggcctggtgttcgccaccacctacgtccatggcgaccagatccgtacaccggccgatccgaatgccaaggaatgggaacgcgatatctccctggcgtcgacgcggccgcgaat

SEQ ID NO: 558571 - DNA, 973 bp, Homo sapiens
cgttccgtcgaggcggtcagttgtttgcaacaggttcaccctcgctgtatcgggcgctggcggtccggttgtgtacgccctgtttgcgtgcagctgtcgcccgccgcgttcttgtggtgttgtggtgccgccccgagtgcccaatgtgggtccgccccgccctgtttttcgcgcgctgtagccccgggtgtgttctctcccccgggcatgctgggggttgtttgccgggaccgccaaaggtggcaccccgggggggttctattcgtggcatgcctttttaggtgccccctctttgggggcaaacttaggtcccacgacctcgggggccccaccgagtgggcacccacgatgggggaggctcgctgacggggccactccattttgtcccgggaggtgcttcacagcccccacctggtgcgggaactctccggttattcctccgcctgcggtctgacaggaccaaaacccacggttttgcccccgctattggacctggggcgtttttccgcccgttgatgcccgctccccctccgctgcgctgtagcggttggcagtctctagtattcaacctccccggcggcctccgcttcgctcgtactctccggtttcaggaggttgtgtacgccccccccatccccccggggggaacaaagaccacacaaccatgtctacgcctggctcataaataataaacatcacagcaccccccttccttatatagacccacacaaccacaatcatcaatcgtatgtcaatacaacgcaccaggtgacactcccctccctttttcaagccccctcacccactcaacactacttcttttagtgcaccacagaaaatcacacctcccaccactattctatcacactcggaatagtttatagggcgagaaaaaagaaatattcatcttgtcaccatttaaagaaatgaaaaaattccccattactcccgggttccccttcccccacataac

SEQ ID NO: 558572 - DNA, 660 bp, Homo sapiens
taacaataatgtcaagttaaatctgccaaattatcaagtggaatttggtggagcatgttttggccggggtgccccacagtaaacagaggttccttgaaatgatcaaggggtagggctgaaaatgggcactggccctagccaggtgaggtaggacccgggcagggaagggcagagatggtgaggccctgaggtcagtcagacaggactgaccagggaacaagccatgaccctcgaggacccaggggcacaggctcccagatgatagcccctcttcgtgaatgagcacccaggcaacacagctccggggctggtgtgtatgcaaaccgtgttcagcagattgccttccgtgggacaaccacccccttataaagtgctatctatctaccaggacaaattgaaagcctcttctataccccagtctcccagggcaccccccagacagagggctctgaaattctaaaagacgagttcaaaaacagcttttcaagagggggatccattattgaaacagtgggtgaaccgtgacatacgtattcgggtcctcaaagaataggggaggataaccccactacacaaagggaacaagcaaccaaaaaccacaaaaagaccaaaggataagaagaaatggaaaaggagaggacggaaggaatgagaggaaaa

SEQ ID NO: 558573 - DNA, 326 bp, Homo sapiens
acatcaccagagctcaccatagtctaatagaaaacaaccgaaaccaaataatccacgcacgggtttatacacaatttacacggggtctctattttcccctccctacaagccccagagtacttcgagtctcccttcaccttttccgaggggcatcaacggggtcaaaatttttggtgagccccagggcttccactggacttcacggtaataatggggctcaactttcctaggctatctgggttcatccggccacctaatatttcactgttacctccacaacatcccttagggcttacgaagccgccgcctggatactgggctttggg

SEQ ID NO: 558574 - DNA, 417 bp, Homo sapiens
agcaggaaaagggagataaggatccagctagctactttaacttttaacaacgatgtcctttaaaaatgtttgtatttgtatgcatactcatgtatgttgtgtatatgtgtatatatacacagacacacaaaatacagagtaactgcagtctgacattcaattaagctacagaatgcatggtattggcatacatttttattttatttatttattttttaattaatttttttgttttttgagactgagtcttgctctgttgcccaggctggagtgcaatggcacggtctcggtcactgcaacctctgcctcccgggttcaagggattctcctgcctcagcctcccaagtagctgggactacaggtacctgccattgcgactggctaatttttatatttttagtagagatggggtttcgg

SEQ ID NO: 558575 - DNA, 749 bp, Homo sapiens
ggagaggctctgtctctcgcttcttaggcggcccgaggacgccggtgctcgagttgccctgactgtcgcagggagcagtcatcgaacatcgcggacgcgcatgtgggcctgggtagaagttcgatgctatttggacgataagctgtcgcctggtgggtccttatctcatctgacgataccaggataggttacagttagctgggtgctctggcgtggaggaagatgtcgctccgtgggagaagtggctatagaaccccaaccggaataggcccataagcctgcatgcctatcatgtgtgcagcgtctacccgtgatgggatgataccggagtcctcataactccatgtttctggcgctataagttgtaccactggtcaagagttgacggcgtgtagttacatgcttctcgagtctgtctgccagatgactgagtgtcttgagcatggaccgtgtctccgttgtacaacccacgcggccgtgacgccatgcgtgcatgccataccaagtgggggatgtcgtgtatctggttcaccgttcgttgactatgcctgtgtcttctccaccacgctggggtctgggagagaagtggtacacgtgccacgcaggatgagactctatctcagggcctgtaggacctgcttgtattccagtctgctcgtgcttaacgttaccactcgtgccaaggaggatccatcttgcatagcttcttcaggtgccagtatcggtgtctcggtttctcagtggatgat

SEQ ID NO: 558576 - DNA, 770 bp, Homo sapiens
tggagaaagtagtaggggttttaatggtcaacacgagagatcataatagaagacacaaataaattaatgggtctcataatttaagatgtccaggggcctcgtctagggaaaggccaggttcttatacagacaaggtactatccaaaacaaaaaacgcgcggtattaggaccgaccacgggttgcaacgaccaaccaaagtggaacctggtgccaccagtggacaggacgaaccttaaaacacacggggggcttcctggtattgtccactccctcagataaggtaaatgttgtaggcaataaaaggggatagaaggctacatatttgggcgagaccgcgtgggtcgctggcgtagcacacacattcccggtacatttgggggacaccaacaaggaggacagggggtgggaccacagggccacacaccaaaagaaatcctcaagaggacacaatatcactaatttgggaaacaattccatgggcaatgggcacacctgtgggcgcgacaccgaacgactgagtatcgggagcacacaacaattgggtctccccgcggcacacctcgtcagaggaccataaccgtgtggggacaataaccgcaggggggagaaatcaccaagagggagcccccaagggaattgccccctccaggggggcatacaagcgcataccagtacaagatgtgccccgggacacaaagacgaaaacacgacaggatcccggggacacgcgcggggagaaactactgagaaacacacagagggggggcac

SEQ ID NO: 558577 - DNA, 375 bp, Homo sapiens
  misc_feature (17)..(17): n is a, c, g, or t
  misc_feature (78)..(78): n is a, c, g, or t
  misc_feature (96)..(96): n is a, c, g, or t
  misc_feature (169)..(169): n is a, c, g, or t
  misc_feature (208)..(208): n is a, c, g, or t
  misc_feature (234)..(234): n is a, c, g, or t
ggcaactgagtttcccnactgtctagcattcaaaattcagctgtggtcccaagggcacctcctggcggtaaaaacaancttaggcgtgccgggtgncgcgcctcacgcctgtggtcccagcactttgggaggccgaggcgggcggatcgcgagttcgggagttcgaacnacgcttggccggcatggtgaggccccgtgtctgctgaanatgcaggaaatagcccggcgtggtgncgggcgcctgtggtcccggctgctcgggaggctgaggcaggagaatcgttggaacccgggaggcggaggttgcagtgggccgaggtggcgtcactgcgctccagccctgggtgacagagcgagactcggtctcaaaaaaaa

SEQ ID NO: 558578 - DNA, 276 bp, Homo sapiens
  misc_feature (3)..(3): n is a, c, g, or t
atngtgggcatcatgcaactccatctcccggctcaggcaatcctcccgcctcagcctcccgagtagctgggactgcaggcttgcgccaccacacccagctaattttgtatttttttgtgagggatggggtctcgctatgttgcccaggctggtcttcaactcctgagcttgagtgatccacccacttctgcctcccaaagtgctgggattacagatgtgagccaccatgcctggcccatttatttatttccttattgcctgccatgcccaacatgg

SEQ ID NO: 558579 - DNA, 81 bp, Homo sapiens
gcggccgcctactactactactactgctcgaattcaagcttctaacgatgtacggggacatggagaaaccctgtctctacg

SEQ ID NO: 558580 - DNA, 117 bp, Homo sapiens
  misc_feature (48)..(49): n is a, c, g, or t
  misc_feature (96)..(96): n is a, c, g, or t
  misc_feature (116)..(116): n is a, c, g, or t
gaccccagggagagctgaccactgcccgagcagccggctgaatccacnncacaatgccgctctcaggaacccggcccctaataagaagaggaaatncagcaagctgatcatggaant

SEQ ID NO: 558581 - DNA, 107 bp, Homo sapiens
cgacgaggagacattgcggcggcgccggtagcggctgggtctggatgccggccgagggagagggtcggcagccacagtggcggcttgtgtgtgcggatgtggtgctg

SEQ ID NO: 558582 - DNA, 169 bp, Homo sapiens
gtatcagcagtgttctatgagaactcccagagtagtggctcccaacaatttaagccatagcgaaatagctactgggctccctggcctcgcaggccaccaaggacggcaagaaggacaagaaggaggaagacaagaagtgagactggagggaaagggtagcttgagtctg

SEQ ID NO: 558583 - DNA, 156 bp, Homo sapiens
gtgactctgaggatccgttttgggtgcctttcctaaaatcttttcttctgaattatctggttcttttcaatagtttccagaaaagaccaggctttgaactactatcaactaatcagagaacatttctattttcctcagagccaaaataaccaaatt

SEQ ID NO: 558584 - DNA, 889 bp, Homo sapiens
  misc_feature (889)..(889): n is a, c, g, or t
ggtttttttttggcaaacgccaccgccgagaaaaaccgtgtgctatagccatggtcaaccccaccgttgtcttcgaattgccgtcaaggggacctttgggccggtctcctttgactgttggcagacaaggtgtcccaaagacagcagaaaatttccggtgctctagagcacttggtagagaacgggattggcgtctataagggggtcctgcttccacagatttatcccagggttaattgtcgtcaggggtgttagactccacacggccataattgcactgttggcaacgtccatctatgggcgagaatttttgacggatcaaaatttaatcctaaaagcataccggggcccctggcatcttgtccattggcaagagtgctgtaacccaacacacaattggttcccaagttttccatctgcacttgccaataactgaattgttggcatggcaagcttgtggtgtcgggcaaagtgaacagaggggcatcgaatattggtggcagcccatgacagcgcctgggggccaggaatgccaagcaccatgaagaagatcacaattgcttgctttgtgacacaacctcgaaataagttggaactccgggtataaattttacaccaccaaaatacattcctttcttggaggctcaagagaagaagacccctcacacccaatttggtccgagtatcctaagaatcttgtgtggctcacgagggaagtcctttaggagtcccatggtatcttattccctccaatggctagttgattcgagacgctacgttttggttttcagagcaagacgtcttatacccttttctccaaacaacacatcaaaaaacaattgttggctcgccgaaagatttatacaactttggcgggcaagtaagactn

SEQ ID NO: 558585 - DNA, 210 bp, Homo sapiens
tctatgaggatccccgggcgtctcatgatacaaggacggagctgctcggctgagtacatcccttatgaggctgggactacaagctcaacgtcacctattgtgtgcatcaacgtgccaggcagtcctttcaagggccctgtgcattatgtgaccgatgcgtccaaggtcaacgtgctctgggcccgggctgtagcccagggattgttcgtg

SEQ ID NO: 558586 - DNA, 717 bp, Homo sapiens
tgggccctccgtcggttctctcgtaggtccacgtgtcgtggtcttacagtttacccgccttcgtctccgagttgtgcagactcgcggaaccggggtgttcccctggccggccgaaggagggctgggacttcggagaatttctgtttgccctttgacgccaagtggctttgccaattccgtgggcaaggaaaacctggggtggattggtgggggtagacttggaagcccttgtgggacaaggacatttgctttgtgcctcacaattacgttctttcgcgacaaaaggggaaccaaagttttccccccaagaaggcgtggttattgtggcccacaaccaaggctgggttttgggaggcaacctcatttgttggcgccccgagaattaactcggaaggggttgtggcacattgggacaacacggcagcgataggaacggtttggggagcatctgtgggtgggggagaacccaccagttggtctatttggccgagcaggccgaacagggcaatttttacgttggaattccctgacctgtttgatagtggggcccccacattagatctcatgataagccccagaggatatttaagccccgggaagttggttataacataacctgtggcactgtgggatggcttaatagatatccccaaagttgcggaaaagggaggcgctcccctattgaaacttaagggttcctgcaaggaaagcagaagt

SEQ ID NO: 558587 - DNA, 324 bp, Homo sapiens
accctgtacgatgactactcttgaattggagtgtgtgcaggtcacttcatggcagcttctctgggcagcaatctgctctttgagcagcagcagatgctcgtcttctggaagctgagctctctgaatgaggtcttcacacgcgaatgccagagaacggcagaccgatgatgagcggacacagacgacagggtacatctgcagcgcaatgctcatcctgagctagatgcgggcatctcatacacatgcttcaagtaccaggactgcgactctttcctgtttgcgggcccctttcaatccagctgctgcttcaggaagtaggaaaca

SEQ ID NO: 558588 - DNA, 115 bp, Homo sapiens
ggaatcgtgctggtgcttgtacatgggtattgccacatatcatataatgtaatgctaggtgtcagtggtaggaagtttctcatagtgaggtgtatgagttggtcgtactggaatc

SEQ ID NO: 558589 - DNA, 160 bp, Homo sapiens
ttgtggtatattagagctgagcaagaggtggtgaggttgatcggggtttatcgattacagaacaggctcctcttgagggatattatgcaccgccacggtccttttagagttttaaagctagtggcctcgtagctgttcttggcagagcgagggtgttcct

SEQ ID NO: 558590 - DNA, 631 bp, Homo sapiens
agacccaaatatctttcacagaattttgttccataaatgtttttcttaattattaagaagtgttaccttattaaaatgaccaccattctaaaccatttttcagtggtctggatactaagtttacagtttcataccaactatctaaaacctaattgcaaattgaccacagacctctaacctcctacttttatagacttgaatacttaagtaattcaaattaggggtggcatttcattcctttcttatctaaatcttagtttcctggaataataaagcttgatggtcaccaagagaactgcttgagtttaagccattttcaaaagaaactcgccttttacattattgtgttccagaacattaagtgactgtaggtactgggtataagggatggtaaactttgtggtgctctttatgaaatgatccatataactggtgggcgcattagagctttttaaagggggcttggtactattgggggaacatatgtatatccatggttaagagagtaacttgggtgtgggctggttccctggatttttatacataaaaggtgcccaaatgtgttctcaaatgaagggaagcctttcttttttcaaagaagcttttaaaaactgaacacccaaggttaaat

SEQ ID NO: 558591 - DNA, 135 bp, Homo sapiens
ctcctgttcacccaggctggagtgcatagctaccactgtcagctcactcgcacacctcatgcctctcagattccagtgattctcctgcttcagcctcccaaggcgctgggcactacatgtagtgtgccaccaaca

SEQ ID NO: 558592 - DNA, 267 bp, Homo sapiens
tgagggctcacgccagagagagtccagcacagcctttccctgccaggaacaccgacgacccctgtgagccagctgcagtcggccccgctccagcagctcctgcacctgcttgttcgctccaaacacatcccacagggacagctgatgctcaaactgctgccagtgctgttgagtgatccccacatcggtgcagagccgcaggaccacaactttctccagcagctccagtctgcccagggggacacgcttccggtcgccatggccaaa

SEQ ID NO: 558593 - DNA, 231 bp, Homo sapiens
tgggtcttaccacaagtcgaaattgtgggccacgagaatccgcgatcaaaactagatggcaggccggctcatataaggttcatctggcacaaagctacaggagaacagttgtggaacacaaggttgaaagttctgctggtgtctatcacgaagctcacggcaggatgttaattctgaattcccagagttcaattgtgacccaaagcctagtacaagtttttttccatcaca

SEQ ID NO: 558594 - DNA, 353 bp, Homo sapiens
  misc_feature (16)..(16): n is a, c, g, or t
  misc_feature (36)..(36): n is a, c, g, or t
  misc_feature (46)..(46): n is a, c, g, or t
  misc_feature (62)..(62): n is a, c, g, or t
  misc_feature (111)..(111): n is a, c, g, or t
  misc_feature (251)..(251): n is a, c, g, or t
aaaaggggaacgaaanaaaatctctgatggagtctnactctgttanccccaggctggaatgnagtgggacgatctccgctcactggaaagctcccacctccccaggttcanacccatcctcctgcctcagcctcccgagttgcagggactacagcacccgccacaatgcccggctatttttttgtgtttttagtagagatggggtttcactatgttagccaggatggtcttgatctcctgacctcattacncgccgactccggctcccaaagtgctggaattacaggcgtgagacaccgcgcctggtctccatcaaatgactttttaaataaaatacggttctcacctaaaaa

SEQ ID NO: 558595 - DNA, 727 bp, Homo sapiens
  misc_feature (12)..(12): n is a, c, g, or t
  misc_feature (123)..(123): n is a, c, g, or t
  misc_feature (135)..(135): n is a, c, g, or t
  misc_feature (181)..(181): n is a, c, g, or t
  misc_feature (195)..(195): n is a, c, g, or t
  misc_feature (206)..(207): n is a, c, g, or t
  misc_feature (217)..(217): n is a, c, g, or t
  misc_feature (221)..(221): n is a, c, g, or t
  misc_feature (227)..(228): n is a, c, g, or t
  misc_feature (246)..(246): n is a, c, g, or t
  misc_feature (264)..(264): n is a, c, g, or t
  misc_feature (270)..(270): n is a, c, g, or t
  misc_feature (288)..(288): n is a, c, g, or t
  misc_feature (291)..(291): n is a, c, g, or t
  misc_feature (366)..(366): n is a, c, g, or t
  misc_feature (381)..(381): n is a, c, g, or t
  misc_feature (453)..(453): n is a, c, g, or t
  misc_feature (471)..(471): n is a, c, g, or t
  misc_feature (478)..(478): n is a, c, g, or t
  misc_feature (610)..(610): n is a, c, g, or t
  misc_feature (613)..(613): n is a, c, g, or t
  misc_feature (636)..(636): n is a, c, g, or t
  misc_feature (655)..(655): n is a, c, g, or t
  misc_feature (707)..(707): n is a, c, g, or t
tccagcctgtanctgtacagcattcagctctctgggacaacacagtctgtgggcaggctgtagtcacatctcttagcctatagagtatcacagctgtcagtgtgaatagtcctgatggccacngtgtaaaaggtntttgtggtggagagaagctaaagtaggaaggatcttttgaagcacnaacaaatggggtanctgaacagacnntctcagtatnaccncatctnnttcaaaaatagcacaccnactcccttccaaagtgcntcgttncactgcaccatcgtgganganatggaagagcaggatggatttggctggctggagtcacatcttggggaagctggccaggttggctttgccacaggngttgttcttatttcnagccatgaggatatatcctttgtttccccagttttctccccagctgtttttaattatccagtgcttgtttcncttctggattccatatcntactgtnaaaaccgcatggttcagattatcgctattgcagctttcatcataatacacacctttgctgtaaaactggaaggaggtcaggcttgcatcaatggccacagagacaggtcccactcgggccactgccctcttnagnggctttctcattcccctcggggnatctctctgtaccctctgnattttagctgccttgcctgttggggttgtacatacaactctcttcctgtccnacatatgggtaggcatcttc

SEQ ID NO: 558596 - DNA, 1307 bp, Homo sapiens
gaggttgtgaggaacctgcagcgcggccgcaggaccgggccgctgagcctgcagccgccccgcgcgtgacctgcgatcctagacccctgactccctttggctcagcccgcgcgccccagtgcccggcccgggctggcgcgacagggaggatgagcgtgcgggcggcggaaggaggagccgcctcagccgcagctggccaactggggccctcaaagtactccgatctggagtacaggtgctgcgagagcgacgcaggcctgcgacggatcacggatgaactttcattagctgtgatcctactggattccgacaagcatcacttgctgctggatcctgggctgtcaatctggaggagatttttgccaattacgcaggcgttctttcgcggaactagccagcgactcctgccctgcattcaactgcacggcagtacctgataacactctaacctctaagacaaatatacctaacacgactccgactcgaccgacagcacctatcgcgttgcacacacatcggacgaaaccttacaccgaacgcggcacgcggctacacctgacccctcctacgcacaccctcacgagcaccgccagagcatcccctctcaggggaatgccatacactaacacacaccagccctggaacaaaccccactcgacctcgaacacggcaacagggaaggccaccaacgaccatcacccacaacagcgggccacacgcgcctaacgcccagcgacgacagacagaggacaccgccacactacagcacctcaagagcaacgacccacggcgagacccctcaggagaccgaaaccgagaagcaacaaaacaacacaaacgacgcgcacctacacgcggcacgcaccaccgcgcacagacaaacaccaacggagacggaaccacagccacacagcagagaaacaccgccgcaccaccaatcccaagcaaacgacaggacaaacggaagcgcacacaacccaacacaaaataaacaacagatcgagcacagccggcaagagaccggtggaacagcaagtgaacacgaaaccgcttacaaacaacacgaaaaccaaacccaccgcgcagcaacagataagaggaggcaaaaagcgacaagaataaccacgcacaaaccaccagaacatccccacaaccacaacacaaaacaacacaataaccaatacccgccagcgcagctaaccacgcgaagcagacacgaacgaccacaccgaaaccacaaatacagccaacaagaaactgccgaaaggcgagagcccgagcacacagaaccaccatgacaaacgacc

SEQ ID NO: 558597 - DNA, 365 bp, Homo sapiens
agaaacgcgctccttggcggacactgggggaggagaggagagcgcggtaacttatccgaaatgccgagatgcgttttagcttggttactttgctgagcgaagaggcaccgccccgtctcggccggtccatcaacaacggctcccccaccatcctgggcaagcgcatacgagcagcacaacggggtagacggcttatgaaaagcgcctcttgatgcccagtagggtctggcaaaccacggacagaccaggcacatggtaagaggaacaacccatgatggggtacggtgcgctcacccatgagctctctggggtgttgggaagaggctggcagccctgccaggtgccacgtggaagcttcaggaggc

SEQ ID NO: 558598 - DNA, 1108 bp, Homo sapiens
caagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaacttttcgtgtttttagtagagacggggtttcaccgtgttggccaggatggtctcgatctcctgaccttgtgatctggccgcctcggcctcccaaagtgctgggattacaggcgtgagccaccgcgcccggcggcgaaacacgatattgtactaacatcttaatttggttataacaatctcacaagacccctgacatagtctcagagatctgtagggccgaggtacattggagaaccgtactctagggccaaatcaattcttcttgcctggctcacttgtccccccacggcccgcgctggagccactgctagtcttcagcgctagaagagagctcgccagaactcctctcaaggccatcacagacagggctaatccttcctccatgaacaaaggctcccgccaactccaggacgaagaggctgtgaccttagccgggccaccatggcacacgggcgagaaaaaggcggcgcgacaacagcggagacggcggccgcccgcattgaggcgggctcccacacgatgtgtgctccatagaccgatcaacatctcgaaaaaacgagagcagccccgcagtatcgggaccactcgctaacaccgcgcacggacacagaggaacatacaggtcataatcagcccatggcgcatcagtctagcttacatacaacccagaggacacattcagcgcgcaccgacacagtagatcatcgatgctagaaacaagtagatgcctccacacgacgagtcaatttacgcaggcaca

SEQ ID NO: 558599 - DNA, 955 bp, Homo sapiens
aatgctggcgcgcgcggcgcgtggcactggggcccttatgctgaggggctctctactggcttctggccggctccaggcggccgttcgttggattggcccgaaccacgtgtatgttcgtgcccgatcggggacccttggttggtgaacaaagtggctgccggattaccaccggatccttgcagccgtgtattgaaccatctgtcatccctgttgtgagatcgggatccggattattgtgcagagtcttcaaggaaattgtgtcaatcaacgtgccttgaagacaaggtcggctgtgaacttcttcgaacaattgtagcgtcgtgcaaactcggatggagtccctataacctggccgcatttcagtggcgacccttttatcgagggggcaaatggcataaaccgcgttggtaggaagggaaccccttgagtgaaattgccccggaccaccgccaaggtttatggcctcaagaacatatagcccatttagaggaatcgaggagcgcttcggggaaagacgttcgtcttcgtatgagaaacaaagagtgttctacccccgggagacagcaggcacgatgtttccccattgaagttgcccatggcaattttggttgggaatttgccaactacaaacccaaggctttgtcctggaacttggctgggcggattatacccagagttgcccctcccgcttatgcaggaatccaggcgatttatttccgagttgttgacaaccccctgggttttgaacaaagaagttcttaattgcaagattgcagtggttgcaacggacacgatcgtggccgagaaaaacgggggtccaccaggtttcctagaaagttctggaggggggacccgaaagaaggttcggccaatcaagttgtggccaaaaggggataaaacgacggccagaaaatctgggcccccggaagacaaaaaagagcgtcacacgataatt

SEQ ID NO: 558600 - DNA, 170 bp, Homo sapiens
ggcccccccccccccgggtggggggggtttttttgttttttgggtttttttgggggggggggtttttcatgttacacccaaatcgggatttatattttatttgtttccctttcaaggggatcatggcaaatggccagatttttttgttaataatggggtagggtttggta

SEQ ID NO: 558601 - DNA, 1368 bp, Homo sapiens
gtgtggtcgggcactctctgtgcgtattgagtatcgcagcatcacgtgtgaggaggcacctcccgctgacgagattgttgttattctcccctcctctatgtgccccccttattgcgataggtcgcccttgtgtgactggagaatgcgcaaccactagtgggtattgctgtcgcttgatggattcttgtatcaagttgcttcggcgcgaggaacgatgctcgcggtgaaaatggtgttggttgagatattcttgttacatgcgctatcataataaggattccgtcgactgtatttttcgtgggcgtgctcttctgttgggggggggctccgcccacgccggggtggttgagcaaatggtgccctcaccataagtgggtgggtccctactctgctcctcctctttggtgctacagtgggtttatatccccccgcggtggtcttttgtaatagtaggctgtcccctcctcttgtgtggcgctgttgtcgccgctcctctctccgtggtagaatagctaccctctcttgtggtgttggtcttatgctgtttggcgtaacctttgttagtagctatgttggtttcccactagcggaaccgaggaatattgttgcggccgccccctgttggtcagttttatgtgcgcctgattttcttgtggtggggttcgccccagtatcgattggtgccgttcatcctcccgccccacgctggggcagcattatcggcgggcacataaacaacccactctggttgggttcctaattggttggtctcccacgaggtggcgggggcgctgtgctccttctgtgtcttggtccccccttgtgaaagacgtcgtattccaagagcacatatgggcgcgcacacaggttgtttctccctccaccacaagagcgctgtggccacagacacggttggtgggcacacagaggatgcactccgtgggcccactatatgtgtacgatctcgcttgcgcatggcctcttgctcacccagagtgacgtctccaagagccacaagtgtgtattttctggaatcacagcccaaggggttctcccacgattttgtccggagatggagcctcctggccagggacaccctccaacacccggttgtggtgcagaacaacaggggttttcccccagggcactgggacaaaggagaccgagggggcaggcccagaagctggggctctcgagatggccggaccaaggccctgtggctgcctatgggggactgaatagcctgagcgcccacctgactgccattttggaccacctcaccaccaaggggaaacgcaccccccggaaacctgggaatttccccttttggttccagggtttccccataaactttttgacccaccctta

SEQ ID NO: 558602 - DNA, 1662 bp, Homo sapiens
cgtgacgcgtggagtcctggactaaccaccccacgacacgccctcccacgtgcgcaggagggctgtacacgatggtgagtgagtcggtgtgggacctagagccggtcttgaaagacccgcgtgctgtgcgtgcacaggcctgacagagatgacaccgcacatcgagacccatgtgtaccaagggtgtgtgtaggctggaccagtagcctaggtgtacaagacatcgcgataccacggtgactagaagtgtgggcacacgtgactgtggacaaggtggcctatctactgagcagggggacattacggagtgtaaggcacaagcatggcatgactcacaagagggggcaattcggcccctgagtgcaatgtcactgcagtactgacacaaggaggcacaaaaagcctcaaggaaagagataccccgacgaggcgaggatacgagtgagtgcgtgcagccaacgggtaagatgagtccttcttctcagatcttatagaagccataagagcacgtggcatatcttaggggcaccgggaaaagggcgggcattgccacggtcatcaaacagtagttaacccacatgggaaagcagaagggcagaaggagtaggaacactacaacaacgggaattgcccccagaatacacgaagacacccaatgatggaggaacccaaagaaaacaggtaagaacccattacatagagcaaacaaagagacgagtaacacaaacaaactcgaggagaaaacaaggatgaacaccagaataaaccacgagggcactgcgtcatacccctgaaggcaggctaggggaacctgcaacgggggacataggataccagcctagagaaaccacaacatgcgcaaagaaagaaggagcgcagtacacccattagggagatatccagcgctcgagccagaaatacctacacacgaaacaacaaggaaatacagagggaagcggacaaagtaagacaggacaagggaataacccaccaaggatgtcagacgaacacacaaggagagtgcaatgaggcacaggactgacacagatcaagcgggaacaaaaggggcagcaacgggatagacaacaaccgagtatagtagaacgacagccacagaaaaaagagacatccacagagcaacaaccacaagacaacgacaataggaaacaaatgcaaaaacaacacgaggagaagcaaaagagccaccgagagaaaaaacgacacagaagagaatgacaaaagagacacagacgaaaacactacaaggaccagagacaatgaaggagaacagacccaatagcacaacgagagaccgagagtgaacgaaacaaaagaagagcaggcgcaggacgaacgaaagaagacaagcgagaacaagacagaggccgcgacagagcacaggaagaccaggagacagacgagacacggagacaacgcgaaatagcagaacacagaagccgacacagagcaagagcagagaacgcggagaagggagcaacacatcaccaagacaggaagcccacacaaaagtgaggaaacaaacagaccaagagcacgcacaacgacagagacacgagaacacgacaagcagaccaagcacacagacgacaagaagacaggacacagcagacacacacccaagagagcagaaacgaaaagaca

SEQ ID NO: 558603 - DNA, 193 bp, Homo sapiens
acagaggcaccaaggagcataaacatcacacactagggtttgacatgaaatcggattaatggaaggcatagcattaggagatatacctaatgtaaatgacgagatgatgtgcgcagcgcgccagcctggtgcatgaatacatatgtaacaaaactgcacattgctcacatgtcccctagagcttaaggtctga

SEQ ID NO: 558604 - DNA, 300 bp, Homo sapiens
aaattaaaaaaaatcattttaagaatttactaacctttgaacgtgccagtaagtaagtatggcgagaaaggcaagacagagtgggaccgatcgatagcgcagcgttcggtttggcgccctttcagcgtgcgcagagaacgtgcgctcggatcgtacgattgtgcaggattcgcgcctccattttttcaggagagagcgggataccaagagaaccggaccagctgctggcagggaaactgtgttccttttgtccaagatgtacagaaccaaagtgggcttgaaggaccgccagtagctcta

SEQ ID NO: 558605 - DNA, 116 bp, Homo sapiens
cactactgaagagctgaggtgtggacttctggacccacgcttcccatctcggaatgtactaagctgcctgcccacgtctttgaagaagtctttgcttcttaattttcttattaatt

SEQ ID NO: 558606 - DNA, 885 bp, Homo sapiens
  misc_feature (6)..(6): n is a, c, g, or t
  misc_feature (96)..(96): n is a, c, g, or t
  misc_feature (188)..(188): n is a, c, g, or t
  misc_feature (211)..(211): n is a, c, g, or t
  misc_feature (270)..(270): n is a, c, g, or t
  misc_feature (318)..(319): n is a, c, g, or t
  misc_feature (327)..(327): n is a, c, g, or t
  misc_feature (336)..(336): n is a, c, g, or t
  misc_feature (340)..(342): n is a, c, g, or t
  misc_feature (367)..(368): n is a, c, g, or t
  misc_feature (383)..(383): n is a, c, g, or t
  misc_feature (396)..(396): n is a, c, g, or t
  misc_feature (441)..(441): n is a, c, g, or t
  misc_feature (490)..(490): n is a, c, g, or t
  misc_feature (493)..(493): n is a, c, g, or t
  misc_feature (519)..(519): n is a, c, g, or t
  misc_feature (549)..(549): n is a, c, g, or t
  misc_feature (587)..(587): n is a, c, g, or t
  misc_feature (656)..(656): n is a, c, g, or t
  misc_feature (728)..(728): n is a, c, g, or t
  misc_feature (738)..(738): n is a, c, g, or t
  misc_feature (746)..(746): n is a, c, g, or t
  misc_feature (787)..(787): n is a, c, g, or t
  misc_feature (803)..(803): n is a, c, g, or t
  misc_feature (872)..(872): n is a, c, g, or t
gcggcnatggacccgagccgccgccagccccacggaggtgatccgagcggcgaagaaggacgagtactaccgcggtgggctgcggaggcggcgggnggcgccctgcacagcctggcgggtgcgaggaagtggctggagtggaggaaggaggttgagctgctctcagatgtggcctactttggcctcancacacttgcaggctaccagaccntgggggaggagtacgtaagcatcatccaggtggacccatcgcggatacatgtgcactcntcgctgcgacgtggcgtgctggtgacgctgcatgcagtcctgccctanntgctgganaaggacctnatannnctggagaaggagatgaaggatgaanncgaaagtaggcgaancttgcaggggagnctggggccaggtgggcgtggctgatcaggggcgcggagctggatnagtaaacacaaggcacaccctgacatagagcagcagaggagggagctgntgngggaggtcttcgtcctcaaaaagggnctcgcctgaatccagcggctacatgttgcntggttttacatccacggtgtcttctaccacctggccangaggctcacggggatcacgtacctccgtgtccgcagcctgcccggagaggacctgagggcccgtgttanctacaggctgctgggggtcatctcactgctgcacctggtgctgtccatggggctgcagctgtacggtttcangcagcggcancacgccangaaggagtggaggctgcaccgcggcctgtctcaccgcaggncctccttggaggaganacccgtttccagaaacccctgtgcaccctgtgcctggaggagcgcaggcacccaacagccacgccctgngtccacctgttct

SEQ ID NO: 558607 - DNA, 349 bp, Homo sapiens
  misc_feature (180)..(180): n is a, c, g, or t
  misc_feature (248)..(248): n is a, c, g, or t
tttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaataattttttatgggaattttgntaggaaaagagactagtgatttatatatgcaagaggtttggttcaaaatgggttttttagaactgggnatttcgaatgtggcatgtgactttattttatttttagaagcaaatttggatgtgacctgacagacatatttgcttgtaatagtatatccaactttgaagat

SEQ ID NO: 558608 - DNA, 452 bp, Homo sapiens
  misc_feature (57)..(57): n is a, c, g, or t
  misc_feature (120)..(120): n is a, c, g, or t
  misc_feature (125)..(125): n is a, c, g, or t
  misc_feature (132)..(132): n is a, c, g, or t
  misc_feature (144)..(144): n is a, c, g, or t
  misc_feature (155)..(156): n is a, c, g, or t
  misc_feature (159)..(159): n is a, c, g, or t
  misc_feature (172)..(172): n is a, c, g, or t
  misc_feature (174)..(174): n is a, c, g, or t
  misc_feature (179)..(180): n is a, c, g, or t
  misc_feature (196)..(196): n is a, c, g, or t
  misc_feature (203)..(204): n is a, c, g, or t
  misc_feature (213)..(213): n is a, c, g, or t
  misc_feature (216)..(216): n is a, c, g, or t
  misc_feature (219)..(220): n is a, c, g, or t
  misc_feature (223)..(223): n is a, c, g, or t
  misc_feature (234)..(234): n is a, c, g, or t
  misc_feature (243)..(244): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (256)..(256): n is a, c, g, or t
  misc_feature (259)..(260): n is a, c, g, or t
  misc_feature (265)..(266): n is a, c, g, or t
  misc_feature (270)..(270): n is a, c, g, or t
  misc_feature (281)..(281): n is a, c, g, or t
  misc_feature (289)..(290): n is a, c, g, or t
  misc_feature (293)..(293): n is a, c, g, or t
  misc_feature (295)..(295): n is a, c, g, or t
  misc_feature (298)..(298): n is a, c, g, or t
  misc_feature (301)..(301): n is a, c, g, or t
  misc_feature (303)..(303): n is a, c, g, or t
  misc_feature (309)..(309): n is a, c, g, or t
gaaaggtgcaaatatatgggttgagctggaggtagaaatacaggtaattaaggtttntagtttaagggaaaacagatctattgccatttaaataaggtaactgggatttggttaagttcncaaanatagcanaagatttatttncaggcttcccnngtnctgtcagggcaananaaagnntggtaaaccactacancagtttnncagtgtganggntgnnacncagctcccctncccgggtgnncncancanaggncanntgggnnggcntggttcagtgngaatcaanncgntnaanccncncatggnacatgtcatgttgggctgtgaccgcgcccccgagcccactgtttgtcaaagctgcatgtatgcagtggcaataaaaccttatgccgtcctgttctattcaagcttacggccaatgccccttcctccctgtagcaaaaaaaaaa

SEQ ID NO: 558609 - DNA, 756 bp, Homo sapiens
ggctcacttggggtctgggacttaatgagtgcttttcacttaagtgccaactgaaggagtgaggctgggagagtagaaatagcttgctcaaggtgacacaggtcaaagttatcaaacctgtcatcctcactccaaagccagtgatcatcttgagggccctcagcatttcagagctgagttcctgctccctcttgacctcagacttgtcaggggaacatttgtcctgccaaactcatttcttttccatttttgatgtgtgtgtatgtgtgtgtgtgtgtgtgtgtgtgtgtgtgtgtgtgtatgcgttgtgtatgcacaggggggctgttgaggtcacagatagtatcacagagttgtattgtgggattgccccccaacccaatgtacgtaccagagcttctaagagaagcaggggctcctcgtgatcgtgggtgctcaccacgaggcgccacctcgtggtctctcagtggccttcgtgtgcgtcgctcccaaccagggtgcaccccaagatagtgggtcgtcatcctcaatatttcgtgtaggaacgacgccactacccttctatgatggcagtgccatagggcgctgctctacccctcactgctctcttcccaagcaccgtggagccttgggatcatattacttccagggacgcggatctccatacgagacgcctgatctacagtctcccgtgctcctcctcgtgcccttttctccctctttcttttcccctccacacaatagagcaaaaaagga

SEQ ID NO: 558610 - DNA, 519 bp, Homo sapiens
tagctggccgggtgagtggattggcaggaagagaactggttggtgttcacaggactgatccacaatgggagaatggagcttacgagaccctggtgatgctggagacagttcctcggagtggagaggtttacacctggcaagtggagcacccaagcgtgacaagcgctctcacagtgcaatggagagcacggtctgattctgcatagagcaagatgctgagtggagtcggaggctaggtgctgggccttgtcttccttggggccgggctgttcatctacttcaggaatcagaaaggacactctggacttcagccaagagggattcctgagctgaagtgcagatgacacattcagaagaagaactttctggcccagctttgcaggatgaaaagcttatcctcctggctgttattcttccacaagagagggctttctcaggacctggttgctactggttcaggaactgcagaaaatgtcctcccttgtggcttcctcagctcctgcccttggcttgaagtgc

SEQ ID NO: 558611 - DNA, 382 bp, Homo sapiens
  misc_feature (134)..(135): n is a, c, g, or t
  misc_feature (143)..(144): n is a, c, g, or t
  misc_feature (158)..(158): n is a, c, g, or t
ccgtagctcgatcaacagaaagtagttcttgagaagataacaaaatcaacaaaacgttagtgaaactcagaaaaaaagaaaaaaagagactcaaatttgaaaaaatcataaacgggaagaggatatgtcacaannggacaccnntagaaatataaagngatcatatagagagtactatagaacaacacatatgccacataaatttgaataatttaaacggaaatgatataaattcctggtacacatggcaaccttataagagattgtgaccccagaagggaaaacgaaaacacaacatagaccaagttacaagatcatgcagagcagaatcacgtagtaaacaggtctttcaacgaacaaagaaatccaagaaccacgacgg

SEQ ID NO: 558612 - DNA, 405 bp, Homo sapiens
  misc_feature (57)..(57): n is a, c, g, or t
  misc_feature (120)..(120): n is a, c, g, or t
  misc_feature (125)..(125): n is a, c, g, or t
  misc_feature (132)..(132): n is a, c, g, or t
  misc_feature (144)..(144): n is a, c, g, or t
  misc_feature (155)..(156): n is a, c, g, or t
  misc_feature (159)..(159): n is a, c, g, or t
  misc_feature (172)..(172): n is a, c, g, or t
  misc_feature (174)..(174): n is a, c, g, or t
  misc_feature (179)..(180): n is a, c, g, or t
  misc_feature (196)..(196): n is a, c, g, or t
  misc_feature (203)..(204): n is a, c, g, or t
  misc_feature (213)..(213): n is a, c, g, or t
  misc_feature (216)..(216): n is a, c, g, or t
  misc_feature (219)..(220): n is a, c, g, or t
  misc_feature (223)..(223): n is a, c, g, or t
  misc_feature (234)..(234): n is a, c, g, or t
  misc_feature (243)..(244): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (256)..(256): n is a, c, g, or t
  misc_feature (259)..(260): n is a, c, g, or t
  misc_feature (265)..(266): n is a, c, g, or t
  misc_feature (270)..(270): n is a, c, g, or t
  misc_feature (281)..(281): n is a, c, g, or t
  misc_feature (289)..(290): n is a, c, g, or t
  misc_feature (293)..(293): n is a, c, g, or t
  misc_feature (295)..(295): n is a, c, g, or t
  misc_feature (298)..(298): n is a, c, g, or t
  misc_feature (301)..(301): n is a, c, g, or t
  misc_feature (303)..(303): n is a, c, g, or t
  misc_feature (309)..(309): n is a, c, g, or t
gaaaggtgcaaatatatgggttgagctggaggtagaaatacaggtaattaaggtttntagtttaagggaaaacagatctattgccatttaaataaggtaactgggatttggttaagttcncaaanatagcanaagatttatttncaggcttcccnngtnctgtcagggcaananaaagnntggtaaaccactacancagtttnncagtgtganggntgnnacncagctcccctncccgggtgnncncancanaggncanntgggnnggcntggttcagtgngaatcaanncgntnaanccncncatggnacatgtgatttttttttgtgagccttaccccaagccaaactattgtcaaagcatcatttttataaaaataaagccttattttgccctgttttttta

SEQ ID NO: 558613 - DNA, 297 bp, Homo sapiens
tgaaatcctgtccacagcagcagccgcagccgccaacagagcgctgttagagagctaagatagcactgacttcgtagaaaaccataacatcggccatcttggacacagagaaaaacaatggcgttacttatttacaaaccacgaccgacagttatctcttcccaggagaggctagaattagcttatctgtcttttggccagtgccgagtggaatgcctggttagggggaggaggagggcctgggttttattagtggtgctttgtatgtaaaaggcagcctggcctattgtactgagg

SEQ ID NO: 558614 - DNA, 811 bp, Homo sapiens
  misc_feature (310)..(311): n is a, c, g, or t
  misc_feature (322)..(322): n is a, c, g, or t
  misc_feature (402)..(402): n is a, c, g, or t
  misc_feature (778)..(778): n is a, c, g, or t
catatcaacgaaaatcactcagttgctcggaagcaggatcgtgccagcccctaccggtactaatgcttcgattcaacgagagccttacaggactccactagggctggcgcaagcttacgcaatttaacaatttcggaaatacgctcgaggggatctatatgacgaccattctctaaaataaatattattgctgtaagggatgctctcaatatgtgaatttgaacattgcgcgccgggtttaggtcgtcatcaaaattagcatttagtcgattgataattcggctgaatgcaacagacacgatttggtcgnncaatcctgaantatcttcttgtgcaggttcaacgacatttaaaagcgtatcgcaatattccttcgcgatcaggtacagccttcctgcttgngccaacgaagtctgggcagcgtctttcttttcccttttgacttggtttctggcctggcggctggcgatccacatcgccgcgatgatcgctgcaatagatccaaatgcctgcacccacgacgccaagcctggatgactttcgatccagcaaaatacgacttcccaactcataacccactcccctgtagatcccggaactatacacggtgaggatcccctatgtccgcacaacaagaaattgcctcagttcatccatgtccagccgagcatgggcctgccgttcgaaaaggaactggtggtagacctgttcgccggcgtggcggcgccagcaccggcatcgccagggcataccggagccgactagcgtgaaccacaantatcgcctgattcatttgggggtaccgacatga

SEQ ID NO: 558615 - DNA, 515 bp, Homo sapiens
tttttgtaaattgatcattgaaataaaagcacaacaaggtacttaaggcattaatctgttcttcagtgatatttttaaaagtttataaaaggtttttgcctttttaaatgtctgagtcatcattttggcaaaataaataatttatggtaatctgtaattccatttcataacatcaagtgttttaaatctccaacatttaacaggtttctaaaaatcaaacttcagtttaaaaattgtctttcgtgatgcctggcttttggatgctacagagggcccctggagcatccagaaggaaggtaaacaggattagttaacatgtctaggtatctgggattgccaaaataatgtttaatcttcaggttatattttagggaataatattaatatatgctctaaaattgtttggaatgtctaaaattctaatgtctgagtatatgctatcaatcacaatcaaggttatgttaagttaatgtacaccaaggagataataaaatttctctgtaaataatgttaaa

SEQ ID NO: 558616 - DNA, 253 bp, Homo sapiens
  misc_feature (108)..(108): n is a, c, g, or t
gaaaggttaataatgacttgttggttgattgtagatatatgggctgttaattgtcagttcagtgtttcaatctgacgcaggcttatgcggaggagaatgttttcatgncacttatactaacattagttcttctataggcctaaagcagccaccaattaagaaagcgttcaagctcacacccactacctaaaaatcccaacatatactgaactctcacacccattggacaatctatcacctatagagaactaat

SEQ ID NO: 558617 - DNA, 167 bp, Homo sapiens
ccaatggcaggcagatcagtgaggtcagagactgagacttcctggcaacatggtaaaactctgtctctactaaaagtgcaaaaattaactgggtgtggtggtgcacgccgtgtaatcccatctacttgggaggctgaggcacgagaatagcttgaacccaggaggcg

SEQ ID NO: 558618 - DNA, 264 bp, Homo sapiens
accgctatactcggctgatattaaagatgctgcaatgctgcaaatgtaagcagtggtttcatgaagcttgtgtgcaatgtcttcaaaagccaatgctatttggagacaggtgagaagagcatttgagctttatcgatttttttttttttttttttaagcttttaaaaaatgggggtaggagtccccatcagggtgcaggggttaacgaatccgactaggaacaatgaggttgtgggtgttcggccccagagttattggcggtcg

SEQ ID NO: 558619 - DNA, 292 bp, Homo sapiens
ccgtttagaaggacgagatgaatgaccacagtgagtaacggatgatggagaggtcaatgaggtggacatggaaggcaacgaacaggatcaggaccagtggatgatctaggtagacaaggcagggtggcctcagagaagattccagtgccagcccaagactacccatgcatcccaatgcccgcaaccccatgcccacatgaaccagctgtatggccccgagtgcctagaaagtgcccattgggcaccatcctcacgctgctgccagtgatctggtctctattggccccatccc

SEQ ID NO: 558620 - DNA, 240 bp, Homo sapiens
gtaatggacgttaagcccgtgaaacgcctgtgactcacgaaaaatgttgtgccgtagataccgtcggtaatcggtgaagggagactcgaagtactctgaggcttgtaggagggtaacatatatacccagtaaaattgtaataagcagtgttagaagttattaggtttcggttgttttctaatcagactaatggtgagctcaggtgattgatactcctagagctcactgtgtggggaaggg

SEQ ID NO: 558621 - DNA, 337 bp, Homo sapiens
atgtcctagcgggagggcagcggcgagagcttggagtggacaagtcctgggtgatgagtcagagtaggggaatgtatcatcaaggtctccctcctccccgcataaggaggtcttggcaaaggcatctgaaaaggacgtctacccaaggtctgccagagactagcaatgaagactctggggccaggaatgtaaacataggaaaagcatgactgaccaggagagcctgagtccttgactgcaacttccttcagagaccgtgacccactggctgtgcaccaaatgtctctcagagagcagcagctttctgtgtgaggtctgccagggtctcactctgtta

SEQ ID NO: 558622 - DNA, 97 bp, Homo sapiens
ggatttgctggtgcagtacaactaggcttaatagggctcgaattcgagattttgtgttatttcttacattcttagcccagaaaatgctgtgtacaca

SEQ ID NO: 558623 - DNA, 225 bp, Homo sapiens
ttctttctcatacaggatgagaccaaaagagtttcagagctgtgcccaatatcatgtacaccgctatcattaaatcagatttttatgctgtttttgattttgtggtggtattggccttcctttgaactaatccagtacacgatttagataaatcgcgttaggtaattcacgggaataagaacggttcttaggtctggcaggtttggacagtagtacgacattttc

SEQ ID NO: 558624 - DNA, 596 bp, Homo sapiens
tcttctcctgacactttgcttctccagacatgggcagcaggcttgggtggattgcctgagtgttggataattttcacaatacttgactggaaaccaaggtggccctcccctccttgaggagggatctgcccccagttttctcgagaataagcccacaaagaaatgcagcccttcggtgtttgctctacataacgatgctattggatgtcagtgacacaaaacagaagtgctcccagtagcactggcccagtgccccaaatgagagcatctagcagaggctccgcacactgaacacagcacagcttgtccagcaagacccaacaccacacgtgtcatggcacagcatgcccgctatcaaagtgcccaccagggcctgacagacaagcccgtcttcttgacgcaattcaggtccatgacatgtgatgtggtggaatgattaggagcaaaacagttgtaaacaaaagcctgatctgtccatcaaaactcatccgatcgttttatggaaatagctgataccaatcaagatgacttcaggaaaatgaaaagttttggaaacaaattatctgcatgctatggaaaattgtcaaaaattaaaa

SEQ ID NO: 558625 - DNA, 1501 bp, Homo sapiens
  misc_feature (282)..(282): n is a, c, g, or t
  misc_feature (292)..(292): n is a, c, g, or t
  misc_feature (298)..(298): n is a, c, g, or t
  misc_feature (315)..(315): n is a, c, g, or t
  misc_feature (350)..(351): n is a, c, g, or t
  misc_feature (381)..(382): n is a, c, g, or t
  misc_feature (453)..(453): n is a, c, g, or t
  misc_feature (464)..(464): n is a, c, g, or t
  misc_feature (469)..(469): n is a, c, g, or t
  misc_feature (471)..(471): n is a, c, g, or t
  misc_feature (502)..(502): n is a, c, g, or t
  misc_feature (518)..(518): n is a, c, g, or t
  misc_feature (1032)..(1032): n is a, c, g, or t
ggtctgacacttactgccaaacgcatggcgagggaaaaactgcgttagtgaagaacttagaagctgtgagagaccttggaggtccacatccaccatctgctctgataaaactggaacatctgactcagaaccgagatgacagtggcccacgagtagatgcgtttgagcaagtcgagatatccactgatatgctgatacgacgagtagtaatcacgagtcggtgtgctctctctatgacgaagcacttcagtcgtacctggacttgctctgtccagaattgcnggtctttgtnacaggncagtgtttcaggctaancaggaaaacctacctattcttaagcgggcagttgnnaggagatgcctctgagtcagcactcttaanngtgcatagagctgtgctgtggttccgtgaaggagatgagagacaagatacgccaaaatcgtcgagataccnttcaactccancaacnangtaccagttgtctattcataagaaccccaanacatcggagccccaanacctgttggtgatgaagtggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgcttgtctgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgccgcctcaacatcccagtcagccaggtgaaccccagggatgccaaggcctgcgtagtacacggcagtgatctaaaggacatganctccgagcagctgggtgtaacttttggagatttcaccacatcgtgaatatacgtgtgttgccaagggacctcccttcagaagaagcctcatcatggtggacggcctgccaaggaccgggggtgcctatcccggggcggggaccgggtgaccgggtttaaatggaccctcctcccacgttttggcaacaaacggccagacatgggggcgtggcctatggggaatgtgcggggctcagtatgtgtccaagcaagcttgtgacatgattctttctggatgacaactttgcctcaaattgtgactggagtagaagggaaggtccgtcctgatctttgataactttgaagaaaattccattggttttactttaaccagtaaccattcccgagataaccccggtccggattttatttttgcaacttcccctacactggggctgtcccactctgattgattgggccggagtggtcc

SEQ ID NO: 558626 - DNA, 545 bp, Homo sapiens
agtgatctagaggatcccggcttaggaggtatacagtttgtgattatctctcccatactgtagactgtctgtttactctgttgatagtttcttttgctgtgcagaagctctttatttcattaggtcccactcggcaatttttgttttagttgcgattgtttatgaggacttaatcataaattcttacccaagactgatgtccagaatggtgtttcctaggttttcctctatgattcttatagtttaaggtctcacatgtaaatatgtaatccatcttgagttaatttttatatatggtgaaagatagcgatccagttttagtcttctgtatatggctagccagctatcccagaaccatttattgaatagggagttctttcccccttgcttatttttgttggctttgttgaagatctgatggctgtaggtgtgcgactttaattctaggttctctcttctgtcccattagtccttgtatctcttttagtaccagtaccttggcattttggttaccctagccctatagtatagttggaatcaggtaa

SEQ ID NO: 558627 - DNA, 714 bp, Homo sapiens
  misc_feature (245)..(245): n is a, c, g, or t
gccttccaaaatgatgagcttctgctgagggaagtcctggcaaaacactatctcaagtgtggtaacttgcaaaatgtcatccagctgctcgtaggtcatgtcctatagagaacttgccgtgtactacgcaggccttggcatccctggggttcacattgctgccgcctcaacatcccagtcagccaggtgaaccccagggatgccaaggcctgcgtagtacacggcagtgatctaaaggacatganctccgagcagctgggtgtaacttttggagatttcaccacatcgtgaatatacgtgtgttgccaagggacctcccttcagaagaagcctcatcatggtggacggcctgccaaggaccgggggtgcctatcccggggcggggaccgggtgaccgggtttaaatggaccctcctcccacgttttggcaacaaacggccagacatgggggcgtggcctatggggaatgtgcggggctcagtatgtgtccaagcaagcttgtgacatgattctttctggatgacaactttgcctcaaattgtgactggagtagaagggaaggtccgtcctgatctttgataactttgaagaaaattccattggttttactttaaccagtaaccattcccgagataaccccggtccggattttatttttgcaacttcccctacactggggctgtcccactctgattgattgggccggagtggtcc

SEQ ID NO: 558628 - DNA, 775 bp, Homo sapiens
  misc_feature (219)..(219): n is a, c, g, or t
  misc_feature (329)..(330): n is a, c, g, or t
  misc_feature (386)..(386): n is a, c, g, or t
  misc_feature (410)..(410): n is a, c, g, or t
tattttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgcgnctcccttccccctcccactccagcagctacggccagttccctcaacctgacccagtatgtagaagccagtctctgcaggcggccacgggacttttggaggcccagtggcnnggccaggcagggcgggtacggagcctcccaggctggggcagtgggcatgggcaggngctgtggctgaagacctcgcccgnccactgcagaccccaggggactctcacaccgcagctgccatggccaccaataaggagcgactctttgcggctggtgccctggggcctggatctggctacccaggggcaggtttccccttcgccttcccaggggcactcagagggggtctcccgcctttcgagatgctgagccctagcttccggggcctgggccagcctgacctccccaaggagcatggcctctctgatcggtggagacacagagcaaccaggctcacacgagcatggtgcccaagctcgtcctcgaccccctacgacatactcggggtctacaaaggccatgactaccgtgttgcacatgccacaggtcctcgtgggctaccacc

SEQ ID NO: 558629 - DNA, 467 bp, Homo sapiens
caagaaaggtaaaaaaagaacacaagatgatctgatgaatatgatgatagacgactctgcagcctcaacttcatttcagacacagcctggtcaacctcagcaaggttatattcctccaatggcacagccaggaactgcaccagtaccaggagcaccaggaatgcctccaggcatacctccattaatgccaggtgttcctcctctgattgccaggaatggcaccagttatgccaggcatgccacctggattgcatcatcagagaaaatacacccagtcattttgcggtgaaaacattatgatgcccatgggtggaaatgatgccccctggaccaggaataccacctctgatgcctggaatgccaccaggtatgcccccacctgttccacgtcctggaattccttccatgactcaagcacaggctgtttcagcgccaggtattcttaatagaccatctgcaccaacagc

SEQ ID NO: 558630 - DNA, 237 bp, Homo sapiens
tacccgctgagctgacgcgctcttcgtggctggggtggctcggggcgtcctctcgacccgctccttggggctggggtggggcgggggccctcttcgtgccccctcacggttgccaggcaggctcgcgccctctgcgtcactagccctggcgccagcggcggcggcggccgccgccgccgctgctgccgcggcggaggagctagaggacgacgacgacgagcaggacctccgccgctc

SEQ ID NO: 558631 - DNA, 112 bp, Homo sapiens
aaacattctgccctctgaagggtaaaaattttatttttgaggaaccacaaactgctcgctggcttagagtgttttataagaaagcaaaaatgttttcctcccctcatcctag

SEQ ID NO: 558632 - DNA, 582 bp, Homo sapiens
cttcaccagccagtatttatctttattcaattctgctccttcatagccatagccagccaccaaaagagcaaaatccatttttatactgctgcactgtggctcaaacacttggggaagtaaaagaaagctgggggtgagaagctctaggagacacctgacagtaacccaccctgtcatccaaaggtataaaggcatctctaaattcagtgaaatgacacacattccagatagaacttaacaagaggatctactgttatcaaggctctcatctaaagctagcagaaatacaaatttgcataaatccttttgtcggccgacaaaaggaaataggaggccaatactatttatttccagaaaaataaccagttctaccaggctcatttactaaataaactttcccccacttaaagtaaaatcagcaatatctttatttactatcaaattgtgataaatattgtgatttactttgataccctctaacctgtacctcttacttgattgtattgattaaccttgataatgtttgatttcgtcttccatcaaaattttgaaataaaaattttattctgcttcaaaaaaaaa

SEQ ID NO: 558633 - DNA, 338 bp, Homo sapiens
gcggaagcggagagcaacagcgcgccgaacctgtagagccacataagaaaaccattctcgctgggcgcggtggcccacgcctgtaatcccagcactttgggaggctgaggcagcggatcacgaggtcaggagatcgagaccatcctggccaacatgatggaaccctgtctgtactaagtatacaaaaattaggtgggtgtggtggtgcatgcctgtgataccagctactcgggaggctgaggcaggagaatcacttgaaccctggaggcggaggttgcagtgagccaagatcactccactgcactccagcctgggagacagagcgagactccatctct

SEQ ID NO: 558634 - DNA, 259 bp, Homo sapiens
caacatcgctcggttggaacttaattactgcgtccccatgggagtacagccaggcgccaggctctgtgatggctcccatttgtgaccagatttattatccattataactatctcccacagcctacaccaatctatttcaatacctacccgtgccacatttaccccaacccttctctctgggaaaacgcggttcagcgattctttgactgcggaccctttggaaaccccgtcaataaatgttaaagacacactccaaaaa

SEQ ID NO: 558635 - DNA, 101 bp, Homo sapiens
aactgatatcatccatccatctatcatccagatgtatattgagcacctgtgtctgggtcctattggggagcttgtaaccaccaagaccttcctaagccatg

SEQ ID NO: 558636 - DNA, 384 bp, Homo sapiens
agtcagctgcagtagcatgatgtcactgcactccagcctaagagtcgaccctatctaattaaaaaaaaaaaaaaagagggcggggcgcgttgctcttgcttgcaatcccagcatttgggaaggccgaggtggttgatcacaggtcaggagatggaacccatcttggttaacagggtgaacccccttctctattaaaaatacaaaaaaaattaggcggggtgtggtggcgggcccttgtatccccagctcctcgggagggctgaggcgggagattggcgtgaccccgggggggcgggtttggcggtgagccgagattcgcgccttgtgcactccagctgggattgacggcacaggcttccgtctcaaaaaaaaacgggggggggg

SEQ ID NO: 558637 - DNA, 328 bp, Homo sapiens
aagaaatggtcttacatttcagtagaactaagaaagtattcctggccgggcacggtggctcacacctgtaatcccagcactttgggaggctgaggtgggaggatcccttgaggtcagaagttcaagaccagcctggccaatatggtgaaaccccatctctactaaaaatacaaaaaaattagctgggcattgtggcatgtgcctgtaagcccagctactcaggaggctgaggcaggagaattgcttgaatctgggatgcggaggttgcagtgagccaagatcacatcactgcactccagcctgggcgacagagaaagaccccatctca

SEQ ID NO: 558638 - DNA, 437 bp, Homo sapiens
  misc_feature (17)..(17): n is a, c, g, or t
  misc_feature (19)..(19): n is a, c, g, or t
  misc_feature (27)..(27): n is a, c, g, or t
  misc_feature (29)..(29): n is a, c, g, or t
  misc_feature (218)..(218): n is a, c, g, or t
  misc_feature (333)..(333): n is a, c, g, or t
  misc_feature (373)..(373): n is a, c, g, or t
  misc_feature (418)..(418): n is a, c, g, or t
  misc_feature (427)..(427): n is a, c, g, or t
ggagctgggaaacccancntgggaagnangcattccaggagctgctttccaaaagaagaatagcctccaccaggaaggtgtggctgagcccagagccccagaaacctgcgggaagctccaaaggggggcctgccagaggatacacacccaccctacctcctgcacacgggatcctccaaccagacagtgtggcccaagcagcctggctactttcaccnttagccagcagccctgggcacactggggatggtcccaaacatggcctgtgctgctgtcacggtgctaaggggcctggcaagcacggggtctttcttgctggacggaggcacaggntccagaatctatcttttgccctacagttgtcccgggcaanagcctagatcttatggacccctttaacgggtggcttattcccaanccccagaantcttgggacc

SEQ ID NO: 558639 - DNA, 113 bp, Homo sapiens
gttacctgaaaacactgtgcacatcttgtgtctgtttggaatattgtccattgtccatcctatgttttgttcaagccagcgactcctctgtgaccaatgtcttgatgcatgca

SEQ ID NO: 558640 - DNA, 583 bp, Homo sapiens
  misc_feature (470)..(470): n is a, c, g, or t
  misc_feature (475)..(475): n is a, c, g, or t
  misc_feature (528)..(528): n is a, c, g, or t
  misc_feature (548)..(548): n is a, c, g, or t
agtcaacatctggggtgcatgactgttggcatgtgctatttttagaaatctgaaattccataaagtaggtaagcttttattggcctctaagaggccagggtgggcaaggtgaaagtttacaagaagctggggatggaggaaaacatgaggtggtgtccaaggtatttgaaaactccatagtaaataagagctctagaactcatcagcttctacaacaaatgagatgcttgggttcggtaaagctatttgggtagatggctcagttttcccaatcacctcctcagttataaaggaaactcgctctgatgctgtcatcggccagtctccctcatgtttaaggtgaggtggagtatatcttttaaaaaaatggttggacagacaggcatggtgactcatgcctgtaatcccggcacttggggagaccaagacaggtagagcacctgaggtcaggagtccaagaccagcctggnccaanatgatgaaacctcgtctttactaaaaatacaaaaaattaggtggccggggtgncatgcgcctgtaatcccagntactcaggaggctgagggaggagaatgtgttgaac

SEQ ID NO: 558641 - DNA, 120 bp, Homo sapiens
tcatgtgcctcagcctcctttgtagctgggattataagtgagtaccattgcaccagcttatttttgtattcttagtagacacggggttttgccatgttgaacaggctggtctcaaactcc

SEQ ID NO: 558642 - DNA, 127 bp, Homo sapiens
ataatttcttgcctccgaggtctatcgtctgaggctgagcatgataagaaaatgacctcatgctccttattcatgtgcagcaaaattgccatatgggccaggcggggggagatcctcatagaagtcg

SEQ ID NO: 558643 - DNA, 870 bp, Homo sapiens
gaccttcactacccggagagcccgagatattgaccggaataacggaggccttcgccaagcgatatcgcctgtcaacccgggcttcatccagtccacatacacggtgctatgctgcggtcctttaaccgtcatcaggctcaacaccaagtgctccgcaatcgccaatgtgccggggacaaatcagggcgtggagcgctatgtggccattgaaccggggcatcaacgaggggcggtgacctgctgaggcacgcgcttcaggaaccggtacgccaacgcatccgaaatgagcccttcaagattcctgagcatgacgggaatgacgctaacccacactcttcttcaacccggactcggcgattggtctggctcctagaagctggttggccgggcgaagacgtgtaagcggcgttggtttatccttacagacaactgcctctactacttgtgagtacatccacggacaaggagtccccgaggaatcatccccatggagaatcttgagcatccgagaagttggacgacccccggaaaccgttctgctgtgaactttacatccccaacaacaaggggcagctcatcaaagctgcacaacgaggcggacggccgagggggagggaaaccacatggtgaccggatctcggcccacacgcaggaggagaaggacgaggggatcaagtccatccagcgcctggagtgtggaccccttctatgagatgactggcagcgagtaagaagcggatttcagttaagaagaagcaggagcagtctgaccgcctgcccccaactccattaattatacggagctgccccgcgtgggtggccagaccctggcttggggctgtgatcctgttccctgtttggaaagtcata

SEQ ID NO: 558644 - DNA, 88 bp, Homo sapiens
gctacggctcgggcacgccgacgaatccgttgggcatctcgtagaccacggcatcttggcggtactgggcccacgtgtcgcgaacggg

SEQ ID NO: 558645 - DNA, 371 bp, Homo sapiens
tatattagtcagctagagctgtgtattaggccatcttgcattgctataaagaaatgggtaatttataagaaaagaggttaatggccaggcacggtggctcatgcctgtaatcccagcgcttggggaggctgaggtgggtggatcacctgaggtcgggagttcagggccagcctggccaatgtggtgaaaccctgtctctactaaaaaaaattgcagggattggccgggcgtggtggcgggcacctgtaggtccggctgctcaggagtctgaggcaggaggatcgcctgaacccgggaggcgggggttgcagtgagccgggatcgtgccattgcactccagcctgtgcagcaagagtgaagctctgtctcaa

SEQ ID NO: 558646 - DNA, 598 bp, Homo sapiens
  misc_feature (234)..(234): n is a, c, g, or t
ctgacctagaggatccctcgaattcgacggtttctcttttttttaaacaggtctcactctgtcactcaggctggagtgcagtggcgcttcatggctcactgcagcctcaatctccctggctcaagcaatcctccggcctcagcctcctgagtagctgggatcacaggtgtgtgccaccatgcctggctaattttttttttaagagatggggtcttgctatgttgcccaggctgntctcgaactcctgggctcaagtgatcctcccgccatggcctccgaaagtgctgggattacaggcgtgagccattgcgcccggccgccttggaactaacttctaactcttgttttctagaataatatgtggattcgagaccatgaggatagtgggtctgtacattgtggggaccccaggtccatccagtgggggcctggcctcccagagtggggacaactccagtgaccaaggtgagaatcttgggaggtggaaggccaaacatgggagtcaaccagaggattgacgttagatcggcaagtaagacttgtacgaggggcagagatggctggggtgtggagtgtcgtcttgggggaagagtctggg

SEQ ID NO: 558647 - DNA, 294 bp, Homo sapiens
caaattcggtcagctttccagtttgttccgcatatgtggagcttgtcgtgagtgatcgctaggaaaaaggaaaaagccaagatactcctactgcagcaggtattcccagctgtgtcaagtcacagtcattaataaccttctacaagcaacggggaaacaacttgggattggcaggttattgaggccagggcaagcttgtagtgccaacattcagcaaaggggggtcgccccaaaaggttagacacgttccccaggtcaagggacagccaagcaccttctgggctctttctggga

SEQ ID NO: 558648 - DNA, 447 bp, Homo sapiens
  misc_feature (12)..(12): n is a, c, g, or t
caccttagaagntgtggctcagggcacataaagttgagacagagattatacatccagccccacctctctggaacgggggagttgtctggggaggaaacacaagccggcatgggaacaggggtcacggtggacacgggggtgggctgtctctccacctcctcacattatgctaacagggacgcagacacattcaggtgcctttgcagaaagagatgccagaggctcttgaagtcacaaaggggaggcgtgaagaaatcctgcatctcagtccctcacaagacagctgtctcaggcttttcaagctgtgagagacacatcagagccctgggcactgtcgctgcacgcagcctgagagtagctccctccttttccacctgagctcttcctcctacacatcacagcagcgaccacagctccgatgaccacaacttctaaggttaaggggta

SEQ ID NO: 558649 - DNA, 831 bp, Homo sapiens
  misc_feature (5)..(5): n is a, c, g, or t
  misc_feature (89)..(89): n is a, c, g, or t
  misc_feature (112)..(112): n is a, c, g, or t
  misc_feature (125)..(125): n is a, c, g, or t
  misc_feature (129)..(129): n is a, c, g, or t
  misc_feature (131)..(131): n is a, c, g, or t
  misc_feature (133)..(134): n is a, c, g, or t
  misc_feature (137)..(137): n is a, c, g, or t
  misc_feature (140)..(140): n is a, c, g, or t
  misc_feature (142)..(142): n is a, c, g, or t
  misc_feature (147)..(147): n is a, c, g, or t
  misc_feature (153)..(154): n is a, c, g, or t
  misc_feature (158)..(159): n is a, c, g, or t
  misc_feature (161)..(161): n is a, c, g, or t
  misc_feature (190)..(191): n is a, c, g, or t
  misc_feature (199)..(199): n is a, c, g, or t
  misc_feature (209)..(209): n is a, c, g, or t
  misc_feature (211)..(211): n is a, c, g, or t
  misc_feature (220)..(221): n is a, c, g, or t
  misc_feature (223)..(223): n is a, c, g, or t
  misc_feature (245)..(245): n is a, c, g, or t
  misc_feature (247)..(247): n is a, c, g, or t
  misc_feature (249)..(251): n is a, c, g, or t
  misc_feature (272)..(272): n is a, c, g, or t
  misc_feature (300)..(300): n is a, c, g, or t
  misc_feature (332)..(332): n is a, c, g, or t
  misc_feature (351)..(351): n is a, c, g, or t
  misc_feature (356)..(356): n is a, c, g, or t
  misc_feature (377)..(377): n is a, c, g, or t
  misc_feature (479)..(479): n is a, c, g, or t
  misc_feature (491)..(491): n is a, c, g, or t
  misc_feature (730)..(730): n is a, c, g, or t
  misc_feature (789)..(789): n is a, c, g, or t
ggatntggggttgcagcgcccctcccagcaagggcacggggccctcctcctcctcctctgggggcggggggggtgggggggaaagggcnccggggggtgggtctggggggangggagggtggggngggnangnnctntgngncctcngagatnnctgnngnttcgccctgcgccccctcgtccagggcanngaataagngttgtggtgntngttgttttnntngggggtgttggtgaaagggttntngnnntttaggtaggggtccaggttnttggtgatgagcttgttgttgagaatantggggggcaacatgagggaggagtttttggantgctccatcatgagcgtgnggttncggttgtgatcgatggtcttnagatggttctggatgattccaaactggatgggaatgaagaggtgggagggtggaaaatggggtggcttcaggtttttgagaaaatggtccatgggaatttcntgggtcagatcntggtctctgtagatttgctggatgagggcatcaaggtggtccacggtttttcggagctcctctgtcttcttggtcttgttagtgacgtactcctgcagaaagtcagccgtctgcttagggagcttggtgcctacgtacttaaagtgttccttgtggaacttgctgtcaagatggctggccatctcgtcctcatagaaggtccggtatttgcacagagaacacacaaactggatcctttncaccatgcggtctcgctgccgctttttctgcttgtcctgactcttcttgcctgcctgcnacttgcgcttggtctggccattttcatcctgggtggttaggg

SEQ ID NO: 558650 - DNA, 160 bp, Homo sapiens
tctcatcttgaatcccagggagacccaatgcactagtattggcccccaccagagaactggctcaacagatccaatacaggtaattctggcacttggagactatatggtgagccacttgttcatgcctgtcattgagtgcgaacaagatgtttctgaaatg

SEQ ID NO: 558651 - DNA, 693 bp, Homo sapiens
  misc_feature (22)..(22): n is a, c, g, or t
  misc_feature (61)..(61): n is a, c, g, or t
  misc_feature (102)..(102): n is a, c, g, or t
  misc_feature (130)..(130): n is a, c, g, or t
  misc_feature (135)..(136): n is a, c, g, or t
  misc_feature (141)..(141): n is a, c, g, or t
  misc_feature (147)..(147): n is a, c, g, or t
  misc_feature (174)..(175): n is a, c, g, or t
  misc_feature (178)..(178): n is a, c, g, or t
  misc_feature (258)..(258): n is a, c, g, or t
  misc_feature (280)..(280): n is a, c, g, or t
  misc_feature (309)..(309): n is a, c, g, or t
  misc_feature (326)..(326): n is a, c, g, or t
  misc_feature (378)..(378): n is a, c, g, or t
  misc_feature (401)..(401): n is a, c, g, or t
  misc_feature (406)..(406): n is a, c, g, or t
  misc_feature (428)..(428): n is a, c, g, or t
  misc_feature (458)..(458): n is a, c, g, or t
  misc_feature (472)..(473): n is a, c, g, or t
  misc_feature (480)..(480): n is a, c, g, or t
  misc_feature (508)..(508): n is a, c, g, or t
  misc_feature (524)..(524): n is a, c, g, or t
  misc_feature (534)..(534): n is a, c, g, or t
  misc_feature (550)..(550): n is a, c, g, or t
  misc_feature (562)..(562): n is a, c, g, or t
  misc_feature (618)..(618): n is a, c, g, or t
  misc_feature (651)..(651): n is a, c, g, or t
gtgaggggtgcgcccaccacancaatgatggtgtccttggggtcaggaccaagtccgggtncagtgactgccggctcagcagaggccgggcctgggcctgangctggtgtggcagggccccctagcagancagcnnggggnagtgcnttatgacggtgccgcagcatctgcagnncanactcgcagttggcacaggcctgcttgagctcgtagagagcaccaggtcgcttcgcagctcattgaacatgtgcacaagcncctccgtagtgtggggctcagntccacaccaagctccaggcagcatctgtnccagggccttgatcttnttctgtcccacagagcttgggagcttcatccgttggctccgcagcgtgaaanctgcagacttgaagtctggaaantaaangcctgcagtttcaggaacagcnggcttctcagcctcctttttctggggtagnttctttttgggggnnttgggtnccgtgcgccgctgctctgcagtggtgtntgcggctgtgatcagnttctgcaggncctggctgcgtttctnccgctccttctnccgggcctcaatcttgcgcagtccctgtagcaggtactcctcctctgccacctgcnctggggtccggttgtagagacgctcaagctgtnccttccgccgtcgttcgtgcccagcatcaaatactggtatct

SEQ ID NO: 558652 - DNA, 961 bp, Homo sapiens
taaaaaccctcatcaatagatggagacatacagaaatagtcaaaccactttctacaaaaggccagtatcaggcgggggcttcgaagccaaagtgatgttgggatgtaacacgtgaaactattagtgggcggatgaacgcagatagtgaggacaagttgagccaataactgaccgtgaagtccgtggaaccctggtggctacaaaacacatgttgagccgtaaatgccgtcggacaatggtgaagggagactcgaagtactctgaggcttgtaggagggtcaacaatagagcacccagtacacttggtaactaagcagcggctctgaattattgggttccggtcggttccctattagactatggtggagctcaggctgactggaaacatccgtgagcgcgagataaaacgggatgtcgcacacggagggggaccaccaaggggactaaacgcggaggctgaacgccaggctacgggggccaaggccctcaacaaatgggggcggaaacgggggcaacgcggaggacggtggcaaacaagggggccccacacaaacaacgccgtgcgcaaccacacaaacacatccaccaggcaggcacatacacccacggactaaacacccggacatcagcacggccccacacagggaacagggagagcgcagcgccagcacacctacggcaaacagaaatagcccggccccccccctagtacaacaccattagacgcccaaacaccaccgggcgacaaacgacagcgcaaaagaagaagcagacacagcgaaaaagtaacacgcccccacacacacaaagagacgcccacagaccaaccgagaagacgcacaacaacgaacaaacgaccaatgaacacaacagagcaggcgaaagacacacaatacagccacgaccaatcacaaacagggccccaacgcaaaagagacacacgggccaagaggcatccaaa

SEQ ID NO: 558653 - DNA, 153 bp, Homo sapiens
tcatgttaggagacaggccatgcctttcaagtgcatgcagctcactgattgcatcctcaaagatttccgcatcagtgcccaccagaacttatgtccgacaatgcctggcagcaaggcagatcttcaaaatctcattgtaccagccacggggct

SEQ ID NO: 558654 - DNA, 425 bp, Homo sapiens
gctaccctaccatgtggccaaggaagggaaccaggagcctggagaagcccaaacctaggccagcgggggcaagaggcacctgaagtgcttctccaggaaggagacattggctgggctggggaaggcactctcagcaggggacaccctgcaaaaagccccagaggtgccccctctagatttgcttctttgccttctaggcttctggcctggctgagctcctgggaacacgagtcagcagcaccccaagcctgagcctttagggaaccaacccccgccccacccacattacactgtcctgagaggctgggaaactcctggaacattccctggccagtctcaggttttccaccctctgcctttgggccctgaggaccccttaccccagccacctttagaggatacagcagaggccagggctcttgccc

SEQ ID NO: 558655 - DNA, 243 bp, Homo sapiens
gaagcaggcaatcctggacgacatgaccacccaagcgggccgtcccagtgggcttcttagcactaccttcagtaattgaaatctgcccagcgtaggctgtcactgtggaggcgcttcgcaagattgggcttcgccttggaacacaacaatcacctttggggacgagtaagaagcactacacatagtagttttagtaagcagaagcacccgactatgtcagagccccaagagcaccccccagta

SEQ ID NO: 558656 - DNA, 253 bp, Homo sapiens
gagatgatcatagttgcctgccacaagcacgttcttgactataccacgaagtgaccaagccacacgttactagaggttgaactcatagatatgtacaggatataaacaaataccacggggaacagtttacttcaatacaaggtcaaaatcagcaacaagttctacaatccagtgctgatatcagatactagctgcaaggacaatttcttttcgaaggcttattccagtttcgtctggatactcggcgtgtgca

SEQ ID NO: 558657 - DNA, 344 bp, Homo sapiens
tctatttggcagatgagaaaactcaggggtgaatttttacaacaggtggttctcaaccttgggcagcattattgtgaaagtgaccagaaagtttttaaaaactccttagtgaccagctcatattccagaccaacatcagaatcttgggcattagcggaacccaagcattcgagtggtgtctttccaacatttccaaaggtgactacaaaggtgtattacggccaaacacgtggaaaaccacgtggtttgtgaatgtgatttacactcaatctctttcgagggcgcaagtgtggtcttccttaccttattttccccttttatattactaattaattctttattat

SEQ ID NO: 558658 - DNA, 430 bp, Homo sapiens
actctagaagtaaaggaatattggtagaaacaattgtactataaaattttaaaactgaaaatagtaacgaccatattatagcatttgaaaaacattatttaaatacagattttgggtaacattaaataattatttattccaagataatatggtaaatatttatatttatactggcagatacatagagaaacaggattaattctaagtaatattaccccaaaaagaaatactttctaatattgaattcaacaagatgtaccaccaacagagacagtgaatgtatttcaccttcctaaacagctatttttatatgaaaatcctaaattatctacatcagtcaatgactggcatttcaagagtaaatgattcattttacttacaatgcatcaagataaaaaggttacactgaacaactagaatgtttactgaa

SEQ ID NO: 558659 - DNA, 185 bp, Homo sapiens
  misc_feature (169)..(169): n is a, c, g, or t
gcccggcttacggggattacggcagtagacgatgacgtcacgaggagatcggcatcgcgacttgaacatctatggagtcgtcgcctcgacgaatctgttccgcaatatcatcaatttcggctacctcatcgagcaaggttctgcttgaacttcagaatgacgatcctcnggcattccgggaaaag

SEQ ID NO: 558660 - DNA, 118 bp, Homo sapiens
cccactttagatgtacttattctcctgactgttcttcccagggagtgtggaggtcttggccctgttccctgtcctaccaagtacgtagaataaaaacataacccactgacaacggcct

SEQ ID NO: 558661 - DNA, 281 bp, Homo sapiens
agcgggtctacctccccatgctttgccgtcgagcggacgcggctgggacctctgtttcgttttggtcttattttaccctccactttagcctttctgtcctttttcttatagttctccgttttcgtcccactcctccgcccatgtccagacaattgtccaccttgctacgcagaaagatgtcccttcagggtctgggtagacccaaagacacgaggtggtgcaaacacgcgcggggagctcttggccgtttgctccaaccgttggcctgtaacacacgcacc

SEQ ID NO: 558662 - DNA, 906 bp, Homo sapiens
  misc_feature (157)..(157): n is a, c, g, or t
ggtgtatgcaaccgaagaaaacagttgtggtcacattatatcttcacgggcgtccccctttattgcgcttacagaaagtgtcgcccggatcttggcggcctactattgaagagggtgtaaataagtaggccggcggcgctttttgtgggcgcccccnctctccctactggggaactctttgcgatggaggctttagcaaccgcccgaaccgtggtgttacaaaagtgttgccgcgaatgctcgcgcgaaagatcctgtccaatttctggatcatcggccctcccactcaggtaattctgctccgcacgccatctatcgtcatctcggccccaaagtcgggcatgttcttctccgtcaacggaagacagtacactttggggccgcacaccccactgagggcccgagctgtttctcccccccgctgagaagggagacttcaacccgtcaaccattgggaaatcttgcgtcccccgttgcggttttttaaaaatattggagatgtgatctcacgtagtgacaatggtggaaccaaatattggcgccccacgtttcccccaacaacataatgttgtgcgacgcactaatgttaatctctcttcaaaaaactagtacccgcgagactcttttcttttaggcaaaaatacgcggaccccatacagtaatggttgatgcgcccaaacggttcaacatacaaagccgccttgatgacccacataatggcacgcatgtcaccccttaactcccactccatattatccacacaaagtgggcgacacccgctctcgctcgatattaagtaccagccacccacaaaaaacatttcttgctcacctattatccccccacgggacatctatttcttatggcactacagaaaaaagagccctttcaaacccccacataaca

SEQ ID NO: 558663 - DNA, 167 bp, Homo sapiens
ggcaccaccactgacctgggtctgtgaatcgacaatgccgtcttctgctcttcgtggcgaatcctcctgctggcagcctgtgtgcctggtacctgtctaccctggctgaggatcccagggagatctgaacagcaagacacatagatcccatcatgataggataccaa

SEQ ID NO: 558664 - DNA, 354 bp, Homo sapiens
catctgtactttagtatagccaatatttttcttaaaatggacttctttttttttttaaatggacttctttttaaaacttaaagtttatttaagagaaaactctgtgggccgggcatggtggtacatgcctgtaatctcagctacttgggaggctgaggtgggagaatcacctgaacctgggaggcagaggttgaagatcacgtcactgcactccagcctgggtgacagagcgagactccatttcaaataaataaataaataaataaattttaaaaataaataaaaaagtagttcgggggaatgatggaaggctcacccaaaattctcacttgaagggcctcagcacaggggcgc

SEQ ID NO: 558665 - DNA, 83 bp, Homo sapiens
catggatttgctggtgcagtacaactaggcttaatagggacatggggcttggctttggtagccctcttggtcttactttccca

SEQ ID NO: 558666 - DNA, 971 bp, Homo sapiens
gcattaccatctcacttctaggaatactagtaatatcgctcacacctcatatcctccctactatgcctagaaggaataatactatcgctgttcatgatagctactctcataaccctcaacacccactccctcttagccaatatgtgcctatgccatactagtcttgccgccgtgcgaagcagcggtgggcctaggccctactagtctcaatctgcccaggcacatagtggcctagactacgtacagtaaccgtagacctactccaagtgcgtaaaactaatcgtggcccaacgaattattattactagcagctgacatgactgtccaaagaaacacataagttgaatcaagcacgaagcacgccacagcctaattattagcgatcatcccctctactatttgtttaaccgaaagtcaacaacaagctatttagctgttccccaagcgttttcctccgaccccctaacaacccccctcctaatactaactacctgactcctacccctcacaatcatggcaaagccaacgccacttatccagtgaacactatcacgaaaaaaaatctactctctatactaatctccctacaaaatctccttaattataacattcacagcacagaactaaatccatattatatcttcttcgaaacacattatccccactggctatcattcacccgatgagggaaacctggcaggaagccgaaaggaggcaccatactaccctatctacacctagtaggtccttcccctaataatcgaactagttgacatcacaagacctgggtccacgaaaaaatcaataatcagtctcacgccaaaaatatcaagtctgagacacataaagaaagaaacacagttaaagaaaacacaagagccaatatcacaagccgggaccagggaaaaagcgaccaaggggggaagacaacgacacaaaaacaccgaaaggaaagacgaaagatagacgaa

SEQ ID NO: 558667 - DNA, 844 bp, Homo sapiens
ctcaaaagggcaaatctaagagatattggtgttacagaggaagtagagaaaggggcagggatggaaagtttattcagagaaataatatcagagaactcccaaacctagagaaagatgtcagcattgaagtacaagaaggttatagaacttcaagcagatttaacccaaagaagcctacctcgagacatttaataatcagactcccaaaggtcaaggatgggaaaggatcctaaaagcggcaagagaaaagaaacaacatgcaattgaagtctgatacctgtggcagcagacttttcagtggaaactttacaggccaggggagagtggcatgacataaagtgccaaaagaaaacaacttttaccctagaatagtatatccagtgaaaatatccttcaaatatgaaggagaaataaagactttcccagacaaacaaaagctgagggagggattttgtcagcaacagacctgtcttttcttgtaagaaatgctaaaaggggcaagagaaaagaaacaacatgcaattgaagtctgatacctgtggcagcagacttttcagtggaaactttacaggccagggagagtggcatgacataaaggtgcaaaagaaaacaacttttaccctagaatagtatatccagtggaaaatattcttcaatatgaagggaataaagactttccagacaacaaagctggggaggatttgtcagcacagactgctttctgtagaagctaaagggtctcatcgaagaaagtgggttgcgagaatctccagcccaatccgggtatatttgcgaaggattgtggccaaaggggtggagcgtgcgtgaaaacaggggggaaatg

SEQ ID NO: 558668 - DNA, 424 bp, Homo sapiens
caaatctgtggattgtagtagggacttatggtgcctcttctgggtccccgtgggacaaattggcagccactttcctcctctctgaggtccataaaagccctgggctcagccagagcagggcagaggatggccagaggacaaagagggcagagaggtggtgggatgaccagctgcagagaggagtactctctgctgatagctggagacaatgggatggctggctgcagagaagagctaccttctccactgagagctgcagagacaacctgccagcagagagaagccaccctttccagggcctcctctccactgagaactgagcactggacagatgacctgcctacagagaggagctacccactgtgggcctcctctgagctgttctagcactaaataaagctcttcttcatcttgttcacccttc

SEQ ID NO: 558669 - DNA, 104 bp, Homo sapiens
aagtccatcattttcttcaagctttcaaagtagctgttgtaactggagctgttgtaactgaagctgttgtaactggagctgttgaaactagagctgttgtaact

SEQ ID NO: 558670 - DNA, 1381 bp, Homo sapiens
gggagccaaggtccgctcggagtgagtgccctcgcggtttattgagtgagcaaatcggagccatcgcattccgttccctgtcggacgtactccataccacgggatcatgcagagtctccgaggatgtcacagtgctcgagaaagcgccctgctgtacggcgggagatgtaccccgtgaattgcctgggaagatgctccggaagcctgtcggctcaagatgccagattctggcgtctgtgtccgggttccgtcactgaggtctgccccttgtccgggcccttcctccctagttctcttcaccgtcgcccatccgtgtcgcgcgccgcggtcagggtccccattcgggcatgtgggtgtgtcttccactcggtccccaacccttcggcccttcttgtggccccatcagggaaagccctgggctttctggcagacgccaggttcttccctgagaatgcttcccccgtccatttcccttcaggcacagggcccataaggttcatccggaaacaccaaggactttcggggttgggccagcttcaggaaagggaaccttgacgttccgaaagactggggtaagggcacctggccgatcctggtaacaaccctcgtgatttctggcaaatcggctacaattagcgggagctgtgggtgtcacctcccggggtccccatgggaaggcgctcctggaggggggacaaaagccggggagtcaggggagagaatgtggcacacacgagggggggaacccaggggcacaggggcggtatggagagggcttgatagaaccacagggtgtggcgatggagttcatgtccattgtattgttggcgtccgtcatcttttgtatattttttatatacccaagcagcacagctagcgaagagagtcaaaagagcgaaaaacgaaagagaatagacacaagcagaacagatagagtagggagaggcgggaggggcggagaacgaaaaggagagcaaggcgacggaagagagggtgaagaagaggagaggacagagcgaaggaagaagcagcagagaagagaggaggaggagaaaggacgcaagacaggcagcgacagggagagaagccaacagggacggagaaggaggaggaaagacagaggaaaagaaggaaagcgcacaggcaaggcggagacggaccgcaagggaaggaaacagagaaaagcgaagaagaaggaagcagcaagaggggagaggcaagaagagaagacaggagaacaacaacacagagcagggaagacaacgagggaagaacagaagaaagacagaagagaaacggaagaacgacaaggacagaaagaacgacagaaagcagagccagagcggcgcacggaaagacacagagaagcaggaagatgggg

SEQ ID NO: 558671 - DNA, 110 bp, Homo sapiens
ttaaataacaacttcccgtgaccgtgcttcctccctgctttccattctccttcatatcgaaagaaggaatttgggtatacgtagacaccataaccgttccggggcggccg

SEQ ID NO: 558672 - DNA, 496 bp, Homo sapiens
  misc_feature (6)..(6): n is a, c, g, or t
cgtgcnggacattttacaggagagaggaattggattcgatgagtcttggtgaggtagaagaatgaatggaaggtctaaaggaaatccaggaagtttttggagagttaactcaacaagtgtgagaaaaagattctttgggctcacaggtccatgttcggcacgttggcatcgaacaggttctggagaactggtctaagttaccatggtctgccagtagggcgaacaggaatgaagtcgcacctaaccataaacaactgaactaaacagacttacttcgtatggcctgccctttattggttatcccagaaattgaaactttgaaagacgtttgaagaaagttggggtccgtttttttatggtccattaaatttggcaaacactacggcagtatttaaccatctttggtcaataaacggccgatcattatactctagtcttctaagggctcactcattctgggtcatttggggactcttttttcccagaattactccac

SEQ ID NO: 558673 - DNA, 168 bp, Homo sapiens
  misc_feature (20)..(20): n is a, c, g, or t
cgtgactctaccggagcttnattctgcacccacagcagcactgggtcgtacacacaacactgagcctgcagctccacaagcgctggccttcacggagaatctaccactttccagagctggcaagctcaagtgacacaacaccttcacctcccggctccggcgctgcgg

SEQ ID NO: 558674 - DNA, 201 bp, Homo sapiens
ctagaggatccccgacgggttcaacggaacttttgagaaagcccccctaaaaaaaggcttagagtcaccggcatgccgctcacgttgcaggacggaatcgcgcgcccctcacgctggagtaagttacgaaacatgatcgtcagggctctttgcaaacgagtagcccaagaacgctggatggaggcctcctcggcccttgcg

SEQ ID NO: 558675 - DNA, 180 bp, Homo sapiens
ttcacctgaatcctctagctgactcttagagtatccccgcgagaggacggaatacctgaagccttacacggttcgaccacaggccctaccctgatccattaacgatcgcgtcggaccgtgggggcgtgcaaatgccaacggaccgggcatggctcaactggcccatgaattgaaaattgg

SEQ ID NO: 558676 - DNA, 197 bp, Homo sapiens
cttggggagaggctgtgctgagccgaaaggtactgctggacggtgtgcagaacccccgagcagatgacctggtgtggaagtctttgtacgtgtctgccaccgtcatcttgcactcatgcagtgacatggtgcaggcagagcgcagcgggatccccatctgtagacctctccctgaccagatccacttcaccaacgcc

SEQ ID NO: 558677 - DNA, 1084 bp, Homo sapiens
taaaaaaaccttgtttttattcagcccaaaccgtgggcaatctacctctggtggtatggccaaagtttaaaaaataaaaaccaacaacaacaaaacaaccatgtgtatgagaaaaggtgaagttatttaaaagtggggctcgtggcgtctccggaatctcccgtgtgtggtttttcactccacgtttcgcctcccgtagaggccggcaggggagggattgccccttcccgtgccgtggtgggttgtggggcgctgtggcgcccctctcgggggagaggcgctttgcccggggagaaggcagggggcctgtgtctattgtgagaagcggggacagaagattgtgcgccatctctgtgtcgtccctctctcgcgagaaaaatctcacgggattgtggcaccacacattgtgtgtgcgaaagatgtgtgtgtgtgtccgagaaaaacagcgtttgacgcgggaaacccttgtgtgtgtgctgagacgtgacaaaacgttggtgtggttggcactcttcttcttcagcaccaccgcaacgagtgatgttgttgttgtggacgcgatgaaacaagtcgttctgcaagagactcttgcgcaacaaagagaacaccacaagtagttattattacaacccttgtgaggaggaggtagttcttcacacacatggtgttgtgcacaaccacctgttttttgtagaagagagatcaattgttgttcgaagtgtactcccccccacgaagaaggagttgttgtgcacaaacaggtcgttgacgaggaattcataaagttggtagtagcccggagaaaaactatccccccccacaacctatggttggggggcgcccgacaagatcggcttgccggacaaaaaggttgggttgcttcccccgggaaagacaatagtttgtggagcgacagaacggcaggacggtagggttgatctaacaccaacaatacaatgagagcacgcaagagggcgccgcctgcctgggaggggggggaggcctacttacccgaaggaggggcagcccccccccctcggctgtgggaggagggggagatactaaatacgtttgcgacaagcat

SEQ ID NO: 558678 - DNA, 334 bp, Homo sapiens
gatcctcacgctccaccgactgctgtcaccttcatcgttccagtttttaaatcctgagtcacgccaaaaaaaaaaaaaaacccaaaacaaaacaaaaaaaaaaattaagtgccttgccattctcttttggttttcgggcgcaggtaaggtttggtcaagaaagggtttgtaccgcaattgaagtcatagtccggcctaaaaagcgcatttggcggggggacaaggggaggggcccggagactcggtcaattattccgtgctgtgcgggttccacattcgggcgggagaaaggtggagacaggagagagggccaggagattggagagggggtacc

SEQ ID NO: 558679 - DNA, 252 bp, Homo sapiens
gtcgacagatggggtttcatcatgttggtcaggctgtttttttgtttgtttgtttttcttttctcacttgcaagctaacaagttaagtgaattgtgtttgtcttgagctctgcagagacaaacacaacctttgtggaatggtgctttaggggacattggcgtggagtgggacaacaagagaagtgcttttgctggatggtgttcgtatcgtggcttgcttggacaggtgcagggcagaggaccaacgtcgac

SEQ ID NO: 558680 - DNA, 211 bp, Homo sapiens
ggagaggagctgacgactatgaactatcagcaagtggcgattactacccggagtacaagctgctcttcgagggtgcaggtagcaacctggagacaagatgctggaggaccgattctttgagcacgaggtaaagctgaacaagttggacttcctgaaccagttccacttttggtggtcttctatgccttcgtagaagctcaatggagccggc

SEQ ID NO: 558681 - DNA, 106 bp, Homo sapiens
acgtcgatttttccccaatcgatgaagccatgctttgcaatgacaatattaatgtgatccgaccctaacattttttctatggaagacgtatgttgcataaagcaag

SEQ ID NO: 558682 - DNA, 233 bp, Homo sapiens
ttctcttaagaacaaacaaaatcattaccaaatatgtgtgtctgagtccagatcagacttaattctgtagttattttgttatggcttagtgttgtcatgagatttgtccactgttgatcatcttgtttaaggctcttacctgtcatatggatatctcgaacgtggaagcagtaattcctactctgctagtttgtgtaggccacatactctagcagtagtaatcctgggtttcc

SEQ ID NO: 558683 - DNA, 394 bp, Homo sapiens
atccttccgcctcagtctctggagtagctaagactacagttgtgagacaccacacaaggctaatgtttttatttttcatagagatgatgtcttggtatgttgcccaggctggtctcaaactcctggcctcaaatgatccttcccgcctcggcctcccaaaaagctgggaccacagacaggagccaccatgcctggctgtactgtatgctttaaatgggtgaactatgtggtgtgttaattatatctcaataaaaatgttttaagggcagggcatggtggctcatgtctataatcccagcaccttgggaggccgaggcaggaggatcacttgagtcacttgagtccaggagtttgcgaccagcctgggaaacacggcaagaccctgcctctacca

SEQ ID NO: 558684 - DNA, 1199 bp, Homo sapiens
atctcgctcggtagttggttactttatgagtggtgtaatgtctctgtgggtgcgcggggcttttttgttgtttgctgttttctgggctttctggttgtccgaatagtatcgctgtttttcttttatcctattttgctcttgatagtcgtcatccggttgtgtacgctggctcttgatacgggttctgtcttgggcatgagaggggggtcgtagatctattgtcttgagcgggaatccgtttcgggtgtttggtgtgtttgtgtggatactgtgtttgtgctaagattatttgacccctttgatgttggcatatggctgtgtggtttctgtcttgtattcttcccttgtttgcctttgtatttgtctggttcctttctagtttttgttttgtactatgcgttgtgtgcggttcctgattgttgagcctggcatgttgctctagttcttcatgcgactcagatgatcttgttgattggagttgcttggcctctgtcacccatgtcttgtgtgcgatgttgcgttctcggctctctgcatcctccgtgtccctggttcagtgcgagtcttctgcctcatgccttctgagtagcttgggattacatcgcgtgtgccaccacgctcgtctaatttttgtatttttagtagagttgggattttcagccatgttggcctggctggtctcgaatctactgagcctcgtgatccacctgcctcggcctcccatatagtgctgggtattacaggctgtgagccatccatgctcggctctattttactattttcttgaagtatccgattttgtgcatagtaatgacacagcaccattcctgagaaatatggaaagatatgtgtgtggtatgataagcccatattctgttcattgtcactctgtatctaggcttcctctttggatgtgaacgcgggaatgatacagtggctgtatttccacccaaaggggcgtggagaccttttggaaacgggctttctcctttccattttgcagcctgggggcagggtggagaccttccttcagaagggtagtgccttggggagcagcagacctgctctgagtccagcttagcgttccaaaattctgtgtggaatcttactggagatgtttgttatatatttgaaaataacggcctgtatttgtcacgctatacttatacccaaggacctttacaataggtgggcgtggg

SEQ ID NO: 558685 - DNA, 417 bp, Homo sapiens
cctcatgaagaggccatatggaaagggagaagccttgtccaaccatctccaccaaggtcccaggcatatgagagagccaacttggacagtctggtcctgttgagcccccagatgcccacagtctcagttgacgacatgtggagcagaagaactgcccagatgagcccagccaacccagtgaatcatgagaataaggaaatggtttttgcttaaagcttttgctttgaagtggttccttatgcagcagtagatatctgaaacagggggcattgattagtgacatcaaggccctaggggatggcagaactcccagatggaagaaagctggatgtctgagtcatggcaaggagagccattcaccaactaggaaaccacgtagaaatattccacaggagaaataaacttttgttgtatttg

SEQ ID NO: 558686 - DNA, 545 bp, Homo sapiens
  misc_feature (337)..(337): n is a, c, g, or t
  misc_feature (401)..(401): n is a, c, g, or t
  misc_feature (405)..(405): n is a, c, g, or t
  misc_feature (411)..(411): n is a, c, g, or t
cctttactcatcatgctccagcctcatgatctgtggcagtctcatgaagagaccaagttccttcttacctcagggtcttgcatatagactttcactgtctgaagtttttccctgtctctattgattattagctctttctcaacccccttttttttttttttttttctggagagggagtttcactcttggctgcccggggctgggagtgcaatgggtgcgatctcagcccacggaaacctcggccttcggggttcaagtgattctccggcctcagcctcccaagcagcggggatcacgggcttgcgccgccacgctgggccaacttggtatctttagntaaagaggggatttcaccaggtgggtcaggcgggtctcaaactcccgacctcggggtgatcggncggnctgggnctcccaaggggcggggattacgggcgtaagccagggggcccagcccctttctcaatcttttaggcttcaacttaaataccaacccctcagatgggtgtctttttctaaccaaaatgtggtccaaatcttcctcg

SEQ ID NO: 558687 - DNA, 1427 bp, Homo sapiens
  misc_feature (478)..(478): n is a, c, g, or t
  misc_feature (661)..(661): n is a, c, g, or t
  misc_feature (683)..(683): n is a, c, g, or t
  misc_feature (788)..(788): n is a, c, g, or t
  misc_feature (807)..(807): n is a, c, g, or t
  misc_feature (860)..(860): n is a, c, g, or t
cgcttatatgcgcccggttgtgcaccgccccgcccgcgaaaatgtggtttgtcgatgtgtgttaaaaagggagaatcgttcccaccccacgatgtttcctcggtgggaagtgcgccttcctttgtggcagaatggacaacatccttgtgttgacctaagaagtgtttttggggagagagaactcccccacaagaggtgtgcgccccacgaagaaccccaaggcgggtgaccgcgcaccaacccggcgttgttggggagaccctttactcaaacggttccgttggttttttttgggggggaaacatcaagagagaagttttccaccgcccctcacgaggatccatcaggagaaacccacccttgggggattccccccacgctctcaagaagtgttaatttctccgtttcctcgggggccttttttctgggtgtcccttaataaaaagtgaacacctaaatatgtcgggataaatacggngtgttccacatcatgtgtgatgccccccgtggtgaaactttttaggtgtaccccgccgcggacccccacgccgcatgtgtgagattaatttctcgtaaatgttgtatgggaaaatatcgtcgtagatattttgcgcgctctaaaaactctttagtttttattggcgccacacacactcggcgncttctgagacgcgcgacgagancgctctactattttgggtgtcctctctctataggtgagagataatgtgttgtgtgtcgctctcacactacgggagcacacacacagagggtgtgtgtgagaaaantttgagagaaaatttattnttttatagggagatgtttatatgttcacccagaaacgacacagagtctcaatntgctccgttgtgtttgcacagcctctctcacagagaattgtgtgtgtctctttgagaatctctctcacagaggagacacctctctcgtgtcacacacacgctttgagagagtttgcctcgttgagaacaagagaaagagaagagaaggagggcgcgagaatctctcttccacgcggagagaagttatatttccctctttctcttttctatattttaagaatacaccctcgcgagaggcggtgtgggaagaaatgtatacagagaattgtaaagggaggggttcacgtatagtggggaaatttctgtgaccacgcctgagattgaaagaatgatgattgagagaacctcctgcactttctaagttaaccccttgcttccctctcaccctcttgtaaaaatttggcttggccacacatgagcacttgtcaatgcttatttgtccccaatatccactcctgtcgtagagtcttaaatgtttttgagtcgcttgcgttataaagtggagaagtgccaccccaccacgtgaaaccagatcccctttataaataagcttaaaggccactgcca

SEQ ID NO: 558688 - DNA, 187 bp, Homo sapiens
aaactgaatgaacgtatcagtataaatggtggttatctgagtattctagaatggattctggaaaagaaagatgccatgtggatagggtccctcaatagaacagttttggaaaatagcacaagttatgaagaaagcaagaatttattggacaagaacaagatattggacccagactactttatcctgg

SEQ ID NO: 558689 - DNA, 466 bp, Homo sapiens
gacatagtagatatggtagtgtgaggacaagatgctatctgagagccagccaatccgacatcatcccctgcaaatggtatgcttatactatcctctcaaaccctgggtcattggtttcatacacagcctcttccacggataaaaggggttcttgtacacgcttgttactccaccattgaggcgagttctgagttctaggttttcctaggacactctactctcagtcaccaagatctctggaatgatcatacatagtggagtggcagggtgaggtatttcaaaaggagtatgtgtaacaagaagtcttgcccaagccctgtcatgtcagtgtgtgtgtgtggcctcccagcccaagcagaaattgacagacaggcctgtatatagtgaaaagatatatatatatttttttttccgaattaggcagctggactcagtttaaatgatccctattgtgttgggcacatcc

SEQ ID NO: 558690 - DNA, 808 bp, Homo sapiens
aatcatggctgcaaaggaggtctccccagccaggccttcgagtacatcctatacaacaagggcatcatggaagaagacagctacccttacataggcaaggatagttcatgcagattcaacccccaaaaagctgttgcattcgtcaagaatgttgtcaacatcacactcaatgacgaggctgcaatggttgaggctgtggctctatacaaccctgtgagcttcgcctttgaggtgactgaagattttttgatgtataaaagtggcgtctactccagtaaatcctgtcataaaactccagataaagtaaaccatgcagtcctggcggttggctatggagaacagaatggattactctactggattgtgaaaaactcttggggctcccagtgggggggagaatgggtacttcctcattgaacgtgggaagaacatgtgtggcctggctgcttgtgcctcctatcccattcctcaggtataagccacggctgcacgggcaactgattggcagaccaagggaggaactggtccttcgatgagaatgccaccctggagaaaattgtgtggaaatccacccagaggccctctcactcctgagtctagacgcctaaagacaggaaggacaaacttgaatagcgacaagcccacccacgtgacatcatcaccagaaatacgcttggattgtggttttttaatgacccaaacccacgtggacctagaatcgtctctctttccagctctcttcatgtactgggagctgtaatggttaccttttctatgttgtgtattcaataaacacacagtaaatacc

SEQ ID NO: 558691 - DNA, 471 bp, Homo sapiens
  misc_feature (34)..(34): n is a, c, g, or t
ggagaaggaaaaggcaagaagcctatccacattncctaggggtttccagccttttttttttccatttatgcccctcccttgcctttttttaaaattaagaaacctattttttttaagagcagttttagattccacagcaaaattgagtgaaaagtgccagaggattcctcatataccctccctgtccctcacacacactagcctcccccactgtcaacatactgaaccacaatgctaatttgttacattcaatgaacctgcattgacatattatcacccaagtccatagtttatattagaattcactcttggtattacaaattctgtaggttttaacaaatatataatgaggccgggcacagtggttcatgcctgtaatctcaacactttgggaagccgaggcaggaggattgctggagcccaggagttcaagaccagcctaggcaacatagtgagaccccatccttacaa

SEQ ID NO: 558692 - DNA, 348 bp, Homo sapiens
aggcacgtggaatcactttgagccgtagggagttcaagaacagcctgggtgccattgccaaacccccatctctacataaaaataccaaaaaaaaaatgaggctggacatggtggctcaggcctgtaaacctaccactttgggaggttgaagcaggtggatcacttgaggccaggagttcaagagcagcctggccaacgtgatgaaaccccgtgtgtactaaaaatacaaaaattagccaggtgtggtggtgcatgcctgtaattccagctactcagtaggctgaggtgggagaattgtttgaacgtaggaggcagaggttgcagtgagtcgagatcacgccactgcat

SEQ ID NO: 558693 - DNA, 338 bp, Homo sapiens
ggcaatggaggaagtgtgtgttgagtcgagctggctgggggtaggttgtaatcttcaaagggtgttgggtgtaggaggtgaaggcgtcgtgtgagttgaggctgcgtggtctgaacgcggtagatctccctgaagtccagtgcttgtggagctggcagggacagtgttgtcgtggtgagccagtgctgctgtggacgcggtgtagatgcttcaacgatgcctgagcttgtggtgctgtcagggaagagtgttgtgtgagtggagcctgggctgctgtggaaggttgtagaattcttgaccaaaggataaggctgtggtactggcattgggccagcggg

SEQ ID NO: 558694 - DNA, 303 bp, Homo sapiens
  misc_feature (17)..(17): n is a, c, g, or t
  misc_feature (219)..(219): n is a, c, g, or t
  misc_feature (271)..(271): n is a, c, g, or t
gaacccataaacaaatnccacattagccctaactgacttttgacaaaagtgccaagaacacacttggggaaagtacaccctcttcaataaatggtgctgggaaaactggatattcatatgcagaaaataaaactaggcctctatctttcaccatataaaaatcaactcaaaatggattaaagacttaaatgtaagatccaaactataatactaccagangaaaatataggggaaatgagtcaggacattggtttgggcaaaggttttatgnacaaaacttcagaagcactggtaatgaaagca

SEQ ID NO: 558695 - DNA, 334 bp, Homo sapiens
catacactgggggaccgacagtctttacaacaaatgatgctagaacaactggaaatctgcattacaaaaaatgaatctagacaaaggctttaaactcttcacaacaatttactcaaatagatcacaaaactaaatttaaaacacaaaacaataaaattcctagaagactacacatacggacgaaaaactctagatgaccttgggttcggctgctgactttttacatacaaccaccacgagaccctgactccctgacacacggacaagacactgactaacgctaaacctttattaacacacttagaacatttcctgctttgacggggaacacaga

SEQ ID NO: 558696 - DNA, 221 bp, Homo sapiens
tgcttgtcttcatcctcctcttctgaatctggcttttgctttaattgaggctgccttcgcctctcagcctcttgtaccatcctttggagctctgcatctggatctggatgcccttttgccataaagcgcttcctgaattcctcaagctcctgcttctctctcttcctatctggttcatctgcttccatttccttatctctattacgcaaccttttttgaag

SEQ ID NO: 558697 - DNA, 242 bp, Homo sapiens
gatagactggccgtcgctatacaaaagatattaggtgtgacgatcattactcacgcgctgacggaacttgtacagggaggcatgcaccgcagtgttgaatacacgtcgacctggctccatctaaacgagatttggaggtgaacgcggatctcatgtggcgacggtgcttgtatacagaggcatgcaccgcagaggttaatacacgtggacctgcaagcatgcatgcatgctcgggtactgaa

SEQ ID NO: 558698 - DNA, 392 bp, Homo sapiens
agatggagtctcgctctgttgcccaggctggagtgtagtggcgtgatctcagctcactgcaagctccacctcccgggcccacgccattttcccgcctcagcctcccaagtagctgggaccacaggcgcccgccaccgcacctggctaatttcttgtatttttagtagagacggggtttcaccatggtctcgatttcctgacctcgtgatccgcccaccttggccttccaaaatgcttaggtgggtggatcgcttgatcccatattgttggtgtacctgctcttttaatattgatgaatcccttttctgttctccttttcaagtatttagctgtgccgtggtaattttcatcctttggtcccagtttcttattgtattttatgcgggatggtt

SEQ ID NO: 558699 - DNA, 871 bp, Homo sapiens
  misc_feature (71)..(71): n is a, c, g, or t
  misc_feature (107)..(107): n is a, c, g, or t
  misc_feature (133)..(133): n is a, c, g, or t
  misc_feature (173)..(173): n is a, c, g, or t
  misc_feature (197)..(198): n is a, c, g, or t
  misc_feature (200)..(200): n is a, c, g, or t
  misc_feature (206)..(206): n is a, c, g, or t
  misc_feature (215)..(215): n is a, c, g, or t
  misc_feature (230)..(230): n is a, c, g, or t
  misc_feature (237)..(237): n is a, c, g, or t
  misc_feature (260)..(261): n is a, c, g, or t
  misc_feature (272)..(272): n is a, c, g, or t
  misc_feature (293)..(293): n is a, c, g, or t
  misc_feature (296)..(296): n is a, c, g, or t
  misc_feature (299)..(299): n is a, c, g, or t
  misc_feature (301)..(302): n is a, c, g, or t
  misc_feature (309)..(309): n is a, c, g, or t
  misc_feature (313)..(313): n is a, c, g, or t
  misc_feature (335)..(335): n is a, c, g, or t
  misc_feature (385)..(385): n is a, c, g, or t
  misc_feature (403)..(403): n is a, c, g, or t
  misc_feature (427)..(427): n is a, c, g, or t
  misc_feature (429)..(429): n is a, c, g, or t
  misc_feature (457)..(457): n is a, c, g, or t
  misc_feature (479)..(479): n is a, c, g, or t
  misc_feature (497)..(497): n is a, c, g, or t
  misc_feature (564)..(564): n is a, c, g, or t
  misc_feature (703)..(703): n is a, c, g, or t
  misc_feature (706)..(706): n is a, c, g, or t
  misc_feature (725)..(725): n is a, c, g, or t
  misc_feature (730)..(730): n is a, c, g, or t
  misc_feature (739)..(739): n is a, c, g, or t
  misc_feature (744)..(745): n is a, c, g, or t
  misc_feature (751)..(751): n is a, c, g, or t
  misc_feature (755)..(755): n is a, c, g, or t
  misc_feature (757)..(757): n is a, c, g, or t
  misc_feature (760)..(760): n is a, c, g, or t
  misc_feature (765)..(765): n is a, c, g, or t
  misc_feature (772)..(772): n is a, c, g, or t
  misc_feature (776)..(776): n is a, c, g, or t
  misc_feature (792)..(792): n is a, c, g, or t
  misc_feature (797)..(797): n is a, c, g, or t
  misc_feature (804)..(804): n is a, c, g, or t
  misc_feature (809)..(809): n is a, c, g, or t
  misc_feature (823)..(823): n is a, c, g, or t
cgggcgctcgctggtggcggacccggaagctgctgcggcgccggggctccgtggcctggattgaatccgancgggaaccatgaacgtggacaaaactgaactatgcngagtctctgctcacctggttacaaangttccacgttccgtctccctgtgccaaccctcaagacctnaacaacggccttgccgtaacctanntnctgaancaaaaaaanccctcctggttcaangaagcanggctccaaggcatctcggaaaanncaagtcccaantggaaactgaaagtcaacaanctnaananngtcttanggancctaataaaatactcccaagangtcctggcgcatcctgtgtcaaaaaaacatctcccaaaagtgaacctcantggaagaattctcaaganccggcaaagctgcggcaagctggntncagctggtggctggggctgtggccatcnagttgcggagaaaaagccaggnaccacatcccagagaatncatggacgctgggaagaatcggtttcagacatgtgggttgatgtgaagccatcccaagagactcatngacccaaagacacatccttgactccctggtcaccagagactgtatgggcaacttgtgacagccaggtcccgcaggtacatattttcctaaagtgagggaaggctgagggaggggggacgaatttacaagcagcgctgtnctnggatctgggagctggcagnggatngctcctgtncaganngagaanacananccngggtngcaaaanaaangcagggctggcggggncgggntgggccngcctngaaagcgcagggtnaccccaggtctcactggccaaaaaaactgctgctggctgcaatcccca

SEQ ID NO: 558700 - DNA, 166 bp, Homo sapiens
acattgacgccgccttaatatgatagtgaaactggattatggcgtatagttcggtcttacgttgtacctgatattcatgggacatcagtgaatgaagcctcctatgatggccactacagctcctatggatgggtcctagtgtaagtgagctactaccttattacgt

SEQ ID NO: 558701 - DNA, 956 bp, Homo sapiens
atgccccacatattctggacccattctaccaattcagcaagtacccaccattccaaatggacacagctcctcaccccccatggcttttcaagatctcccaaacacattggatgaaatcgatgcattattaactgaagaaaggtcaagagcttcgtgcttcacaggactgaatccttcggtggttgaggagtactcaaaaagagaagtagaaatacagcagttgaccgaagaactgcaggggaagaaagttgaactagatgaatacagggaaaacatttcgcaggtgaaagaaaggtggctgaaccccttaaaggagctagtagaaaaaattaatgagaaattcagcaacttttttagttccatgcagtgtgctggtgaagttgatcttcatacagaaaatgaggaagattatgataaatatggaatccggattagagtaaaatttcgcagtagtactcagctgcatgaattaactcctcatcatcaaagtggaggtgaaagaagtgtttctactatgctatacttgatggcacttcaggagcttaacagatgtccgttcagagtagtcgatgaaattaatcaggtatggacccaattaatgaacggagagtatttgaaatggttgtgaacactgcctgtaaagagaacacattcccaagttattttctttcattcacaaccgaagcttctacagaatctgtcctttattctggaaaagatgacaggttgtttgtttgtctaccaatggtcctccatatgctgggagcccaaaccgatggaatttaagggtttccaaaagcgtcggggaggtatacctttattcaactcgtgaaaggaagacagggggccttgggagggttcccctcacggtttagtgtggccgcccagggtaaagtgcgcttaaaaaaaaaaggggggcatatcccgaggcacagccctttaaaggccaggaaaaa

SEQ ID NO: 558702 - DNA, 428 bp, Homo sapiens
ggtgagccagacctaatcctatatacttggggggggcccatggcctctttccattcaattggtgggtagccgtgaactgtttcctgggccaacttttctctataatagggaagctccttggcaggggttgcatccaatttttatgtttcctcagggtccagccctggagtgaaccagaggtagtccttggcaagtgtttggtgaatgaatcttctctttagatttatcctcatcatcgtttttttaagactgtggtaaaaatatacataccctaaattttgccattttaaccatttttatggggcaggttcggtggcattaagtacatatacattggtgagctaccatcaccatcatccacctccaacacacttccatcatccccattgaaattttgagcctgtcaaaccccaaagacccccccccca

SEQ ID NO: 558703 - DNA, 899 bp, Homo sapiens
  misc_feature (29)..(29): n is a, c, g, or t
gtaagggtttttccttttttcttggcttntggttcacataagaggcagcagagcccagataaaagcacagccctggggtcagaccgattctggttctgtcactccctgtgtgatcttgtgaaactttatgtgatgggcctcagtttctttgcaaaatgaggaataatattgcgggcctgtaggtattagtgagaagcgaataagataacacatacaaaatgtttagcacggtatttcgcacatagtacgtaggtactcaaacattagctttttttttttttttctctcccgtgaaagggagtctcgctcgggtcacccaggcgggatgtgcgcatggggtggaaatctgggctacagtggcgaatgttctggcgcttcgtgggattcacggcaattctctgtggcccaagcttcccgatgtagctgggagactacagggtggcccggccaccatggcctgggaaaatttttgggtgattatcataattttttttggagaaacgggagttctggctctggtccgcccaggctgggatgtcgcagtgggcgtagatctggggctcactgggaagtctccggcccccagggttccatggccattctcagtgccgtaaggctcccacaagttagcgtgggacctacggggtgccccacacacacaaattaggagcaaaacttggggggaattttaaaggctagacaagaagtggggggttaacacacccggtgttttaccacaggagtgtggatcttaaaaatctcgtatgaacactggtgtgaactcaaaaattcgggaccatgtgggactctatttaaaaagaggcgcgggggagatttaaccagagatatttagtgccacacacaaggtcacgggggcacgagcatatattatatacagt

SEQ ID NO: 558704 - DNA, 350 bp, Homo sapiens
ctctgcaggatccccctagatgctgtccatcgggaattctgagtccaacagtcaggtcgttaacccgtattgtctcatatggactctagaatatgattcgcgctgctttccctcgggcttcttgttctgttggtcacgttattggatcaattgagtatatgtagttcgcctttgacctggtgcaagtccttaggcatgtactgcttcggtggttcgggtttcttgctccgagtgtcgtccacctaacctgcaaattttttatgcagtgtttggttactttaggcacctttgggtttgttaggctctgtttgcattaatatattaaagctccataaggatctcctcgtcta

SEQ ID NO: 558705 - DNA, 431 bp, Homo sapiens
  misc_feature (124)..(124): n is a, c, g, or t
agcccctttcccaggggcttcccaatagagcccccatctcccagggtttttttgtgggtttgccgtgccaacccctccgttccccctggagagaagatggttccccccaaagttaaggggtggnaactgggtataaagctttaaaaaattgggccaaaccagcccccccccccttgggtccccccaaaaaaaaggggggggccgggggctttttctggtgggggccaaaagctggaaaaaaaaaaccgggcttttaaaaaaagggggggttccccggcccaggggatcccggcccctaaaaatttttttaaaaagggccccccggccaggggggaaaaaaggggcccccctttttggattgtcccgggggcccatttgcttggtcctaaagggccggggccgtgtgttccccttaatttttttgttgggga

SEQ ID NO: 558706 - DNA, 91 bp, Homo sapiens
ttacagggaagaccgaaacgaccattcttaatttaactatttatattatcctaactactaccgcattcccattacgatttcgggcttagaa

SEQ ID NO: 558707 - DNA, 236 bp, Homo sapiens
  misc_feature (144)..(144): n is a, c, g, or t
  misc_feature (152)..(152): n is a, c, g, or t
gtgtgcggtgtttagaggatccctcgaagatggccggtggtcacctggaggaggtggaggaggaggaggagaagaagaaaggggtctgggaaaggatccggttcaaattaagttctcaagcgctggtggaaggtttagctacanggtcacgngagacagatcgagggacagcaacatggacacgctggggcaaggtgagcgtgatggcttagtgagcaatcacgagggagacaaac

SEQ ID NO: 558708 - DNA, 147 bp, Homo sapiens
gccttccttgggatgtaggtagcctgtttctcatgtgctccctctcctgtgaatctgaacccttgataccccgtcaccctgtgttcaccatggtagtgcactggctgaactaccactcgaaatgttgatatgggcagactgttctga

SEQ ID NO: 558709 - DNA, 914 bp, Homo sapiens
  misc_feature (1)..(1): n is a, c, g, or t
nctctgttgcactctatcaatttccctccgtctcccacattccccgcttccgcccttcccccgggccctttttccctcgccccatgagccattctacctgctcccaaaataaccggaacattctcccgcccacccctggggccccaacctccgttaagtggcgccctctgtaccccccacgcttctaccctcctttcattacaaaccggtatttgcccccccaaagttgtctgtcatcacccaccttgtggctaaaaacatggcgaagcgtctatattatggtcccgcgaatcccacgtgggggcaccacccaccaccaaggcgttcccccccatgaacacggcggcttctttgaaccccacggccctgtctcccgccggctggctaccctcgacataaagggccactcttccccctgtgcccaggcccccacaggagggatccttgcgtgggaaacaacgaatagaagggcacattccctccccctttcggttggcgtgttccacccatcggtaagaggcgcccacatatctctgcagccggtgtgtctcccaacacgatggtgcgtgttcgtggaaaacaacgagcagaccgataaggattaattttcctcgcgacccctgtgcgcgataaaatacaacacacatccctctgaccctctgggcccccaaaacagacgttccacaccgcaaataccccccaacgctttcaccacacgtcttccttacaaaaaacagtaccgccccccactagtgttgtataaaaagccgccttaattaaaacaagcgttagaataaccctggtgccccaccccccccacagagttacacgacgtctctttcaagactccactcttgcctcaaaccaccaccaccctcccgcgtctttcctttaaaaagcccccgcccccatac

SEQ ID NO: 558710 - DNA, 304 bp, Homo sapiens
cttttggggtctttgctaccgctaattgtgctgcaatgaacatatgcgtgcatgtatctttataacagaatgatttatattcctttgagtatatacccagtaaagggattgttaggtcaaatggtatttccagttccaaatctttgagaaattgccacactgtcttccacaatgattgaactaatttaactttaaaaaatttttattggcagtactctctgagagactagagttatacattaacaaggccagacgttaccatttacatgagagcaaagaccccaaaagagcaaagacccaaaag

SEQ ID NO: 558711 - DNA, 231 bp, Homo sapiens
cgccccggtggtgcatgatggatctcaactcgctgatactccaccttctgagttcaagcgacttctcccaccctcagcctcccaagtagctgggactacagtgcgtgtgccctcacgcctggataatttttgtattcttagtacagatggggtttcacaatgttgggctggcatggtctaagaatctcctgacctcgtgatcctaacacgactcggcctcccacagtgcag

SEQ ID NO: 558712 - DNA, 1105 bp, Homo sapiens
  misc_feature (228)..(228): n is a, c, g, or t
  misc_feature (370)..(371): n is a, c, g, or t
  misc_feature (376)..(376): n is a, c, g, or t
  misc_feature (380)..(380): n is a, c, g, or t
  misc_feature (382)..(382): n is a, c, g, or t
  misc_feature (411)..(411): n is a, c, g, or t
  misc_feature (413)..(413): n is a, c, g, or t
  misc_feature (417)..(417): n is a, c, g, or t
  misc_feature (422)..(422): n is a, c, g, or t
  misc_feature (424)..(424): n is a, c, g, or t
  misc_feature (426)..(428): n is a, c, g, or t
  misc_feature (447)..(447): n is a, c, g, or t
  misc_feature (458)..(458): n is a, c, g, or t
  misc_feature (470)..(470): n is a, c, g, or t
  misc_feature (472)..(472): n is a, c, g, or t
  misc_feature (474)..(474): n is a, c, g, or t
  misc_feature (477)..(477): n is a, c, g, or t
  misc_feature (487)..(487): n is a, c, g, or t
  misc_feature (494)..(495): n is a, c, g, or t
  misc_feature (534)..(534): n is a, c, g, or t
  misc_feature (543)..(543): n is a, c, g, or t
  misc_feature (546)..(546): n is a, c, g, or t
  misc_feature (549)..(549): n is a, c, g, or t
  misc_feature (560)..(560): n is a, c, g, or t
  misc_feature (562)..(562): n is a, c, g, or t
  misc_feature (588)..(588): n is a, c, g, or t
  misc_feature (654)..(654): n is a, c, g, or t
  misc_feature (717)..(717): n is a, c, g, or t
  misc_feature (757)..(757): n is a, c, g, or t
  misc_feature (784)..(784): n is a, c, g, or t
  misc_feature (796)..(796): n is a, c, g, or t
  misc_feature (809)..(809): n is a, c, g, or t
  misc_feature (824)..(824): n is a, c, g, or t
  misc_feature (840)..(840): n is a, c, g, or t
  misc_feature (846)..(846): n is a, c, g, or t
  misc_feature (858)..(858): n is a, c, g, or t
  misc_feature (860)..(860): n is a, c, g, or t
  misc_feature (862)..(862): n is a, c, g, or t
  misc_feature (884)..(884): n is a, c, g, or t
  misc_feature (890)..(890): n is a, c, g, or t
  misc_feature (910)..(911): n is a, c, g, or t
  misc_feature (934)..(934): n is a, c, g, or t
  misc_feature (939)..(939): n is a, c, g, or t
  misc_feature (1093)..(1093): n is a, c, g, or t
tccatgtttaaggacctcctgggcctcaggagggtggggcccgcccctgggcggactccccccatccgcgggcgcgaatggccgggccgcgtcgcagtgctgctggctgctccctggttgctgggtgcaaagtgctgggttctgggtttctggattcgcgggccgttcacacgtagcctgtgccggctcctcgggtgagtccgtccgcgcgcggtgccccgggacggnctaggctgccgggggtccggggccccaggcattccgggctgcagattgacggggatcccggatgcaccgcgcgcccccgcgccctcaccgacgggtccaagacctggtgggaaagaaggtgcggggacgggtccctgaagannccgangccnanaagccaaaaagctcaactttaaaagtgtnancaanacaantnannncacctcaattttgtgaacngtaaaaagganaaaatcgaagcnantncanaatgctgttnaaaagannaaaaaaaaaaaagcttgtaaaactctttgcaagaaggancctcggaancanggnctggccggcanancacacctgctgtcaccaggaccacangcagcatgaagacccccgtggaagctggccgtcagtgggatgcagaccctcggccttcagcaccgntgccgaggtggctaccgggtcaaggccaggacgtcatatgtggatgagactctgtttggcagnccagcaggcacccggcctaccccaccggacttcgatccgncctgggtggagaaggctaacagaatcngaggcgtgggcnaggaggcatcganggccttgggggcaanggggagctgtgagacnaccccntcaaggggcagnancnccaccctcacaccaaggaagangaacanatacagacccatcagccacnncccgtcttactgtgatgagtcgntgttnggctcccgatctgaaggcgccacttcggggccccgcggatggcgaagggggatgccgcaaagctccgtgctctcttgtggacgcaccacctacccccaggggtagccactcgccccgcccagggaggcacactgcgagcaatcaccagctggtncctcaagaaaga

SEQ ID NO: 558713 - DNA, 357 bp, Homo sapiens
atccgaggatttcggctactccacaaacaggtcagactattctcctgcctcagcctcctaagtagctgggataacaggcatgcgccaccacgcccagctaatttttgtatttttagtacagacggggtttcaccatgttggccaggctggtctcgaactcctgaccttgtgatacactggtctcggcctcccaaagtgctggaattacaggcatgagacactgtgcctggccgaggttttatattttgcagataaagcccctgaggcacagaggttaagtatctagtccaaagtcatatagctgtatgtggaggtagcactctgttagtggaggtagcactgggtacctgagctcga

SEQ ID NO: 558714 - DNA, 871 bp, Homo sapiens
tccctgcctagcgcggcccaactctttactccagagatcatggctgccgaggatgtggtggctgacatggcgccgacccaagcgatctggagagcggcgggctgctgcagtgagattttcacgtcgccgctcaacctgctgctgcttggcctctgacatcttcgctgcatctacaagcatcgtgcgcggggaaccagaccggcggcacagcggcgacaggcgacgaccgacgagccgcccccatctgaccccgcctcaagcgagcgcgacttcaacccccgctcgagctgcaggccgcttcgacaggcgtccaaggacccgcgcatactcatggcccatcaaacggcaagggtggtcgatgtgacccaaacgggccggcacaaattcttacgaggcccacgagcggcccagcaatgggggctcctctggcccgcgaagccaccatgccattccagggctccctttgccacatattgtagggccctggaattcacgggaagccaccttggaaaggcgactcgcagataccgacatgacccctagtcctggaaccctccagcttgcctgcccccacgcagagacgcagaccctcctgcggctggcactgggaaagctcctcagagctcacacctgtcacacagcggccactcgatcccaccgcgtttggcgcgccacaacaccgtggccttgccagcggacccgcgggcacaacggaatgcacccaacgaatgtatgcgtaccctcacacctatttaacgcgagagaggaaacccccaagcagggatctcgaaacacagtgggcccaccgggccaacacaacctcgtgacttaacaccggccatattccgccgtcgccacggctctactcgct

SEQ ID NO: 558715 - DNA, 974 bp, Homo sapiens
  misc_feature (228)..(228): n is a, c, g, or t
  misc_feature (403)..(403): n is a, c, g, or t
  misc_feature (412)..(412): n is a, c, g, or t
  misc_feature (415)..(415): n is a, c, g, or t
  misc_feature (418)..(418): n is a, c, g, or t
  misc_feature (429)..(429): n is a, c, g, or t
  misc_feature (431)..(431): n is a, c, g, or t
  misc_feature (457)..(457): n is a, c, g, or t
  misc_feature (523)..(523): n is a, c, g, or t
  misc_feature (586)..(586): n is a, c, g, or t
  misc_feature (626)..(626): n is a, c, g, or t
  misc_feature (653)..(653): n is a, c, g, or t
  misc_feature (665)..(665): n is a, c, g, or t
  misc_feature (678)..(678): n is a, c, g, or t
  misc_feature (693)..(693): n is a, c, g, or t
  misc_feature (709)..(709): n is a, c, g, or t
  misc_feature (715)..(715): n is a, c, g, or t
  misc_feature (727)..(727): n is a, c, g, or t
  misc_feature (729)..(729): n is a, c, g, or t
  misc_feature (731)..(731): n is a, c, g, or t
  misc_feature (753)..(753): n is a, c, g, or t
  misc_feature (759)..(759): n is a, c, g, or t
  misc_feature (779)..(780): n is a, c, g, or t
  misc_feature (803)..(803): n is a, c, g, or t
  misc_feature (808)..(808): n is a, c, g, or t
  misc_feature (962)..(962): n is a, c, g, or t
tccatgtttaaggacctcctgggcctcaggagggtggggcccgcccctgggcggactccccccatccgcgggcgcgaatggccgggccgcgtcgcagtgctgctggctgctccctggttgctgggtgcaaagtgctgggttctgggtttctggattcgcgggccgttcacacgtagcctgtgccggctcctcgggtgagtccgtccgcgcgcggtgccccgggacggnctaggctgccgggggtccggggccccaggcattccgggctgcagattgacggggatcccggatgcaccgcgcgcccccgcgccctcaccgacgggtccaagacctggtgggaaagaaggtgcggggacgggtccctgaggatcccgatgcctacgagtccaagatgctcagggancctcggaancanggnctggccggcanancacacctgctgtcaccaggaccacangcagcatgaagacccccgtggaagctggccgtcagtgggatgcagaccctcggccttcagcaccgntgccgaggtggctaccgggtcaaggccaggacgtcatatgtggatgagactctgtttggcagnccagcaggcacccggcctaccccaccggacttcgatccgncctgggtggagaaggctaacagaatcngaggcgtgggcnaggaggcatcganggccttgggggcaanggggagctgtgagacnaccccntcaaggggcagnancnccaccctcacaccaaggaagangaacanatacagacccatcagccacnncccgtcttactgtgatgagtcgntgttnggctcccgatctgaaggcgccacttcggggccccgcggatggcgaagggggatgccgcaaagctccgtgctctcttgtggacgcaccacctacccccaggggtagccactcgccccgcccagggaggcacactgcgagcaatcaccagctggtncctcaagaaaga

SEQ ID NO: 558716 - DNA, 992 bp, Homo sapiens
attactgcctggtgcatgcgggggggccctggtgtgccctggtggccctgggaatggggaaacctggtggtgtgcttcctgcgtgagtgtttctggcagtggcaatcctggggcctgggggtctgctgggctgtgtgactgtgttgcctggtggcccgaagtgcctgctggagctcgcggaggcaatggccgatggataatgtgatgtggatgcccgtcaccaagtttggggcctgcttgggtcaaggacatgaagatcaatgtccctggaggagatctatctcttctccctgcccattaatggaatcagagatcatttgatttcttcctgtgttgtgcctctctcaaggatgaggttttcaaggcatttggttgctatcggggactacaattggccacgtcggtctgggtgttaagtgctccaaggaggtggcaccgcatccggtgtgggccatcatcctggccaagctctccatcgtcccctgtgcgcagaggctactgtggggaacaagatctggcaagccccaactgtcccttgcaaaggttgacagggcctgtgcgtgtctgtgctggtacgcctcatccctgcacccagtggcactggcatcgtctccgacctgtgctaagaagctgtcatgatggtgggtatcgatgactgctaactcagaccggggtgacttgcaacgtggggaattagccgatgcaactttggatggcatttctaagaactaaggtacgtgagccccgtctttggagtggatgtattcacaaagttactatcaaggagtcattggccacttgtagacaaacagagttcgtagggggttacggtcaggtgtggtaaatagggttttccagcaaataagtgttgggtaaaggagagagaaaatggggggaaattctaggggaagtgtatcggtttacatgcccttgttaaagtagggggaaaaggtgatatgttgtgctgtttatggaagatttgaatgtgtcgg

SEQ ID NO: 558717 - DNA, 1173 bp, Homo sapiens
  misc_feature (228)..(228): n is a, c, g, or t
  misc_feature (722)..(722): n is a, c, g, or t
  misc_feature (785)..(785): n is a, c, g, or t
  misc_feature (825)..(825): n is a, c, g, or t
  misc_feature (852)..(852): n is a, c, g, or t
  misc_feature (864)..(864): n is a, c, g, or t
  misc_feature (877)..(877): n is a, c, g, or t
  misc_feature (892)..(892): n is a, c, g, or t
  misc_feature (908)..(908): n is a, c, g, or t
  misc_feature (914)..(914): n is a, c, g, or t
  misc_feature (926)..(926): n is a, c, g, or t
  misc_feature (928)..(928): n is a, c, g, or t
  misc_feature (930)..(930): n is a, c, g, or t
  misc_feature (952)..(952): n is a, c, g, or t
  misc_feature (958)..(958): n is a, c, g, or t
  misc_feature (978)..(979): n is a, c, g, or t
  misc_feature (1002)..(1002): n is a, c, g, or t
  misc_feature (1007)..(1007): n is a, c, g, or t
  misc_feature (1161)..(1161): n is a, c, g, or t
tccatgtttaaggacctcctgggcctcaggagggtggggcccgcccctgggcggactccccccatccgcgggcgcgaatggccgggccgcgtcgcagtgctgctggctgctccctggttgctgggtgcaaagtgctgggttctgggtttctggattcgcgggccgttcacacgtagcctgtgccggctcctcgggtgagtccgtccgcgcgcggtgccccgggacggnctaggctgccgggggtccggggccccaggcattccgggctgcagattgacggggatcccggatgcaccgcgcgcccccgcgccctcaccgacgggtccaagacctggtgggaaagaaggtgcggggacgggtccccttgaagggattcccgaatgccttacgaagccaaaggaatgcttcagtttaataaggtgtggacctacacattgtgactttcaaccctcagttttgtgtggatccgtacaaattggacaaaattcgaagctacttccacagggcttgtcgaaagagggatttaaactgtgaaacaagggcttgtgtaaaacggttccttgtggcaagggaaggggaggccttcggaaagcaagggggcttctgggcctgggcaagaggcaacaaccttggtgtcaacccaagggaaccacagggcagcatgaagacccccgtggaagctggccgtcagtgggatgcagaccctcggccttcagcaccgntgccgaggtggctaccgggtcaaggccaggacgtcatatgtggatgagactctgtttggcagnccagcaggcacccggcctaccccaccggacttcgatccgncctgggtggagaaggctaacagaatcngaggcgtgggcnaggaggcatcganggccttgggggcaanggggagctgtgagacnaccccntcaaggggcagnancnccaccctcacaccaaggaagangaacanatacagacccatcagccacnncccgtcttactgtgatgagtcgntgttnggctcccgatctgaaggcgccacttcggggccccgcggatggcgaagggggatgccgcaaagctccgtgctctcttgtggacgcaccacctacccccaggggtagccactcgccccgcccagggaggcacactgcgagcaatcaccagctggtncctcaagaaaga

SEQ ID NO: 558718 - DNA, 384 bp, Homo sapiens
cacatggcgagccgtactagtgagctccaagagtgtccttctaccagctgacatcattacctacagtgctcccgaggaccaccccggaattgtgacggcgtggattgtgctatctttgaatccccatacccgatgacaatggcgctctctgtactactaactatacaaatgtgtaacgccctcaacagctagtccgaaaaccagtccttgctgaggatgcccccctgggagaacatctggctcgtgggctccatctgcctgtccatgtcactccacttcctagatcctctatgtcgaacccttgaccaacgcaccgtccagttcgtcccttaccagttttacagtgaatagctgccggtgttggcccacggtgcgttggcccaa

SEQ ID NO: 558719 - DNA, 246 bp, Homo sapiens
tccatgtttaaggacctcctgggcctcaggagggtggggcccgcccctgggcggactccccccatccgcgggcgcgaatggccgggccgcgtcgcagtgctgctggctgctccctggttgctgggtgcaaagtgctgggttctgggtttctggattcgcgggccgttcacacgtagcctggcccctcccacatcatccattgtcttgctgccaagtgcgaataaacggcgtgattgccaacctgga

SEQ ID NO: 558720 - DNA, 354 bp, Homo sapiens
tcaatctttcctttaattagtgtaatagtatcttcaagtttatttagtcttataatatccattgcctggtaaagtatttcagattgatcaactccaagaaccttcttcgccccagctttagcagcaaacatagagagaattcggtatatgaaatctcggtagctttctgttcgtattttgtcctttagcatttcttcatgtatcccataatgcccgtatgagctgaaataaacaccatcctcatcctcctggaggtccgcaatgacactagtagatgacgagcaggttctgacatctgtgtgcatcacaaaatcctgagcaaagtgtctcattttttgcagatcctcacgtgct

SEQ ID NO: 558721 - DNA, 166 bp, Homo sapiens
  misc_feature (22)..(22): n is a, c, g, or t
tcgagctctttagccccaatgnggggcctcggagagtggcccatgtgcccctgaccgagtgactgctagaaacacaacaaggtacccaccacttaaggaaggacatctctccccacctgccaaggggactttggcttcaacaggacaagaggcaagcgtcagtcag

SEQ ID NO: 558722 - DNA, 288 bp, Homo sapiens
ccaggacttctatccctgcacccgttcataaggggagggccatggttaggtttatagatacctgggtggttgctgtaaatgaatgaggcaggagtcccaggaggttattattggcattaaaaatgattaaggatactactataagaaatcaggttcgtcctttaatgttgcgtatggttatcatttgtttgaaggttagtttgattagtcattgttgggcggtgattacccggttggtgatgaaatatttggaggtggggaccaatccagggggaaatagaatgatca

SEQ ID NO: 558723 - DNA, 170 bp, Homo sapiens
gagtggcgggaaatggggggcatcagcatgcctcccgtcgggttcctgcgctgacccctggtttgggcccctgtgttgctcccagttgaaaactggacccttttgtatgtatattataaagaccctgtttcccttttaatttttcaaaaatgggttttttttagaaccca

SEQ ID NO: 558724 - DNA, 239 bp, Homo sapiens
tcgttttccggtagccgagaactgtgccagtggattttcaggctgactctgctggtggcagcctgcaaggacacactggactattactgtaggaatgcagacaaaagatgatgagggcctgacatagggcaggagtaacaggctggagagacaaaaatctgggcgcagcttttggcaggtcagcaatagactgggcacgcacaccaataagctgcagctcattgcagtgaagtcatcca

SEQ ID NO: 558725 - DNA, 229 bp, Homo sapiens
  misc_feature (229)..(229): n is a, c, g, or t
cgggtatctaagatccaaacgactcaggaatctattgttagtgtaaaaggacagggaaatagagaggtaataggatatgtcttctacctataattgacaattttgccgctaagtagacagctggcagcacacaggagcggcactacacagacatgtgaaaccacttttttttttctttaaagacaggtttcgtctgtgcccaggtgagtgcagtgccagatggaaaatn

SEQ ID NO: 558726 - DNA, 1195 bp, Homo sapiens
  misc_feature (389)..(389): n is a, c, g, or t
ggcactcggtacggggcgggggtctggggagcgcagtaggccatgggaagccgtctcctgctctacaatggcgccaagatgcccatcctggggttgggtaccggggaaatctaccgtccatgggctatggtgtacgtgaggccggtgaaggtggcgcattgatctgtctgggttacgcgcactactatcagacatgttgcccggtgttgtactcagaactgatgatatgaggtggcgggtgtgacatgtcgagggagacagtctcagggagtcaggatggctgaaagacgatgagtggagacttccttcatgtgcgatacagaacaatggctgatgcgatgacagcgttataccatctgtatgcgaaggtgctcgtggctgaccacggngggtgcgcggtccaggaaacgagcatatccaggccgagccttcgaagtctggcactgtaagccgtggtacccgtcgtagccttatgtccactgtgcccggacatgcgctttgtgacatgcgctggggcacagggaaattctttccccagataagaatcggatgtgctgggccaatggttggtcttcctcatgttgccacaagcctaagcacgttttcttggcaccaacagttgatgatgggctccaatggaaatagaagcttgggtaggggaagcaagcgcgcctggtcgaaaaagactaatttgggtaaaactcgctacatcattactggaacgccattcatcccaagggtgggaaaattgagtacttgtcaatacacaaaaccctagtgggttgtgcaacgtctcatcaccgtccctggacttgtttcaggccagaaatttggaaggaggtccagccacaatggttcttcaaccttcaaggggaagaaaaggtttagattctcgaagtaaccttgtcccaatgttcgcgaaagagcggcaatacgctgggatgaccaccggagcgtaaggggggcgtcccctatcggggtttcggccatggagacaagggcccattgcgggccaatagggccctgacgagagcccatttctggtttccgtggagagagaggatccccagaggagttcaaaggccgggtccgcaaaagccaaagtccgagagtaaaaacatacaacggcccagggtcacaaggaacacgggtgcccacaaggcacgaaagaaagattgggggggagaatcgcacg

SEQ ID NO: 558727 - DNA, 534 bp, Homo sapiens
  misc_feature (11)..(11): n is a, c, g, or t
  misc_feature (74)..(74): n is a, c, g, or t
  misc_feature (76)..(76): n is a, c, g, or t
  misc_feature (78)..(78): n is a, c, g, or t
  misc_feature (81)..(84): n is a, c, g, or t
  misc_feature (105)..(105): n is a, c, g, or t
  misc_feature (151)..(151): n is a, c, g, or t
  misc_feature (154)..(155): n is a, c, g, or t
  misc_feature (164)..(165): n is a, c, g, or t
  misc_feature (171)..(171): n is a, c, g, or t
  misc_feature (176)..(176): n is a, c, g, or t
  misc_feature (184)..(185): n is a, c, g, or t
  misc_feature (191)..(191): n is a, c, g, or t
  misc_feature (199)..(199): n is a, c, g, or t
  misc_feature (206)..(206): n is a, c, g, or t
  misc_feature (210)..(210): n is a, c, g, or t
  misc_feature (305)..(305): n is a, c, g, or t
  misc_feature (361)..(361): n is a, c, g, or t
  misc_feature (376)..(376): n is a, c, g, or t
  misc_feature (380)..(380): n is a, c, g, or t
  misc_feature (385)..(385): n is a, c, g, or t
  misc_feature (395)..(395): n is a, c, g, or t
  misc_feature (423)..(423): n is a, c, g, or t
  misc_feature (460)..(460): n is a, c, g, or t
  misc_feature (525)..(525): n is a, c, g, or t
tggtgagagtntgtatgattaataagaagccgctttttcatgaaatgcttggaggtgaacgagttctcagcctntntnatnnnncctatcccattaactttgaantttctcttgattaatagaagaacaaaggggagggtgaagaaaaggnggnncatgctaanngccttntggcnatcatccnnatgtgngggaagancaaccgnttcnccagctcccctttttctattttgcaactttctacatctcactcttgattttggccttcctggctgaaacagcctggcagtccctagagcccctgngaagagccctggttctccaaaaggcagagggggagaagccctgcaggatgcgctgnccacttcccagaganctgncagtncgtgctcccnaaagtttgggccggcagcctaatgtganaagaaactgcactgaaaggtaaagggggaaatggtgntgaactgggcttatgtgagaatgtctatattttcataagacagccccagaatctttctctcagtnacagcctct

SEQ ID NO: 558728 - DNA, 733 bp, Homo sapiens
gatggtctaaagacccctgggcccttctttcccaatatacgttatttccgtctaggaggccccataaggaagcggaaatggatgttgaacgagttgaatacgctgaaataggtatgagattgtcacgctgtgctcatgcacacgggataggaaagtctcgtccttgcacgaccccagcaatggatgagcacgcgctcagacgtccccatcaggattccatgggagcagtcaggcagtttatgtcgtacggtgggaatggtgaagcgtgggaaaggaatgcgttgcgttgtgtagaatggcaccctgcttaccttagaaaaaggcatatagctgccacatgcacgtagctcatctacctgtctccagatccgttgctcagggcgtgcgtgttttgcaaagtggcgacataccatgcctcttgcatctttgcttcgctccgtgttcatgtttctcaagtacgcgatgactgtcagcagggggaaacacagaaaaacagaagcagcagataccaatgcaggcaggtcagctgcagcccaccagggtctccagctggagatgacagcatcctgaccttcttgccagcacacttggcttattttattcagtcgcctgattcatggccgctcatctgtgaaatacctcatgctcctttggggactgggctttggaccaagagcacctggggaggagacatggtgcataactaagccagtgagtaagtccactcgtttac

SEQ ID NO: 558729 - DNA, 175 bp, Homo sapiens
  misc_feature (51)..(51): n is a, c, g, or t
cctgccttgtcaggaatcagacaggtgagagccagttctgacttgcttggnatacttgcacaaactatgacaaacgtgtacctttagtgctgacttctaacaagctagtgcctgagctggagagtgagggtgtgggtggctcaacacacaaaccatgttctatgtttgtttgttt

SEQ ID NO: 558730 - DNA, 231 bp, Homo sapiens
ttcactgaagcaagtgatcataatcagtggtgacaattcaactgggcagtgtactcacaggaggtctgagaatcctaaccgagtgctgtcgctacatctgggtcccttccaatacagaaagcaaagtgtaaccatagtaccaggactatgtcaaagatgtctatttatgcatagcacatcaaaaagtaggattcctgtttactctgtctagtatcctcagaaagggcaggg

SEQ ID NO: 558731 - DNA, 134 bp, Homo sapiens
ccatcacccctggtaatgaatcaaaatgtcaggcggggcagtttctctagagtatttttaaaagttctgtgggtgttttacagaatattcctcaatttgagtttgcccagtgtttatcttacaattagccaggg

SEQ ID NO: 558732 - DNA, 123 bp, Homo sapiens
ccggggtctctcctgactcttggatctggtggtggaccaacactggatcctactagttacttaatttttttaagtaaaaaattattattatttggtttctgcaaagattttctcaaagccata

SEQ ID NO: 558733 - DNA, 188 bp, Homo sapiens
agcgggtgccagaggatcccgggcaggtgctatgatgctagctacttgggaggctgaggcactaaaatcacttgaacccaggaggtggaggttgcaatgagccaaggttgtgccattgcacttcatcctgagcaacaagagcgaaactccatctcaagtaaattaattaaattcttcctcttttctga

SEQ ID NO: 558734 - DNA, 427 bp, Homo sapiens
aggatagaaatcatagtgaaacatttcatattccctcattagtagaattaatgttacattgctataacaaattcacactatattaacaaaaatctcttcactactgcgatatcactctctgcttctttctttttcttttggttttaattaggcctccttttgatattctttggatggaaccctttttacatggcctcagacattcttgtttggaagtaaaattgtatttcatattcccccacatacactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcatagagctgggtt

SEQ ID NO: 558735 - DNA, 743 bp, Homo sapiens
cccgaccttgaggctggcatgtggggcttcctctcccgacgctgaggctggcgtgtggggctccctctcccaaccttgaggctggcatgtggggcttcctctcccgacgctgaggctggcatgtggggcgccctctcccgaccttgaggctggcatgtggggcttcctctcctgaccttgaggctggcatgtggggcttcctctcccgacgctgaggctggcgtgtggggcggcctctcgggagcaggcggcctcggggatcctgggggtcagcagcccctccacagccgcacctcccgggactgaccctgcagaacccacctcccgccagcccctccacagcaggacagcacccgcctccttttccaagcccgcctcgcccagtggaggctgcagctctactgggtgtgagtcaggaggaaacgctcgcagccaacacaggcaggacacgcccacgtgacatcggatcccacggggaggagtccactgggcaaatctgaacaatgtgggggaagatattgatgagatgttaaacataacccatagaagaagaatctacaagtccgtactgacgtaaataaataaacaggcattggggagagacagcttttccttaccatagaattccaactcagccgcagaatcctggtgggaaccgtcatcaaagtcaacgggagcagacaccaccaaaccccagatcaaagtcagcatcgccagcaacgggcacacggacaccaggaaac

SEQ ID NO: 558736 - DNA, 304 bp, Homo sapiens
tctccttcctgagccaaaacttgtagttccaacattgggcttgatacagtggcagagttttaaaattcttagcagtgctgtggttggtcattttactagcagatttctaaaggagaagcagggcccataagagctaactggaggtttcagaagagtctctggaatagtttcaggtggcttcccactggagtgtggggttctcacgtggaagcctggcccatgagccctggatggtggttcagcgtgctgctggctcttggagagtgcttcagaccccgtgctgtggagatactgcactttttgc

SEQ ID NO: 558737 - DNA, 130 bp, Homo sapiens
ccatggccgactctagagtatacaaggctcatttgagttgcgctcatttcagtttggctcatttcaggttggctcatttcagtttggctcatttcagtttggctcatttcaggttggctcatttcagatt

SEQ ID NO: 558738 - DNA, 728 bp, Homo sapiens
tggaataaaaatcagtctatcacccaggcgggagtgcaggggtgacatcatagctcacggtaatcttctcccatactctaccaatcctccgttgcctcagcatccaaaatgggctgtgatggcaggtgtgcaccaccaacacccagctacattttttttggggtaagaagacaggggtctcactggtggtacacccagtctgggtctcaaactcccgggcctcaagcaatcctcccattgggcctcacaatggtggggataacagggtataacgccactgcacacgggccttactatcgctatcaaatccatattgtgggaaggggtggtttccccctttttcagaggcctctttaaagcctcgtgcagcaagaatctcacagtgcgtgtccttataagagcttaaagaagacaactctcggggccatgtggacaatctgtgagtgtggtgctaatctaacaattttaacacctctctcagtgtcaatatacctccagtgcaaataaccgtctctatactgctccatctcgtcgtgaaaagtttgtgtcggtaagaaagcccacgcattcccgaggttaaggaaagcctaccccagttcagtggaataccccctttattttacccaaacaaggccaaacgctcctccacaagataagtgggtctccaagcaggcaggcacggcaccaaaacgcgggttcacaacgcgtgaacatattggggggcatcg

SEQ ID NO: 558739 - DNA, 541 bp, Homo sapiens
  misc_feature (101)..(101): n is a, c, g, or t
aggattcaacaagtggtctgttaggggctttcagcggtgggggggtgcaaaaaattttcacacattttttcctttttggagtctccaccacacaggttcanaccagtaggaaccagggtgggtcaggctttttatttccctatggtggggggcaaaaaaaaccctgggttttgttccctttgcccccaaaaaatttagtcctttcctgtgatgggttcccccaaccctgttggaagtttgggtttttcccaaaaccggatgtgttggggggccggagggctatggccccaccccggaatttaaaaggggagccatttttttattttgttgggaaaagcccaaaggtttgggccccccctgtgagggatatactaaaaaaaatgtaaaaaaagggtgggtttcccccctttaaggaacggggagttttttttgggggattaaacaaagttttttaaaccttttaacgggttttcccagggggaaaaatgtcttttttgggggttttttttttttggaaataaaaccttgcctaagcccttta

SEQ ID NO: 558740 - DNA, 116 bp, Homo sapiens
agtagaagtatagcactgctccatgagaatacgtgagtggtatagagtggtatagggttatagggtggtatcagagctataccacctgatctcagatttactcagattttgaaatt

SEQ ID NO: 558741 - DNA, 123 bp, Homo sapiens
  misc_feature (116)..(116): n is a, c, g, or t
tcctcactgaccacgactctggagcgcgactcgactactacgcgcttaccactttgcgcctgtacgctactcgttctacgacggtaccccggtgtgttacaccgttacagccgagntaccgta

SEQ ID NO: 558742 - DNA, 1108 bp, Homo sapiens
gcacacaagtaatctcgacattgtcttatcccgctgatgattatgcagtctgaggcggcttatgagccctacgcttatcccagcgactatgatatgcacacacggagatccaaagcaggaccttgcttatgaacgtctgtatgagcagcaaacgctatcaggtgatccctgaggtgatcgaaggcttcatccagtatttccacaaaactgtctcagatttgattgaccagaaccgtgtatgagctacaggtcagtcgtgtctccagtgatgtcattgagcagaaggtggttgagatccaggacagtctatgagcaacagcgtggatcgcaatgctgactgaaagattcttcacagaatacagccttggcccgagagttgccgccattgttccacaggttggcaatcgctgctgtcttcctgattttatactaaggaattattctacagagcacagtactatgcgcgaagtcatgtggtgggaccgttccttggagcatgaggttatgaagtacctattgacaactactagcaattctcttcaacgtacgattcttaatgccgatggtcctgctccccttgaaggtacccaaaacagtggatctgggatattatcgactgactttcatctaccagtgtcagtcattcagtcagtaccgctgtaagactgccaccaagtcaggagggaggcagattgaccttggcttcgtacaaatcccaaaatctggaatgtcaccagtgtcctcaagtgtccttcattccctggtagacaaatccaaacatttagcgacaggttggcaggtaaaacagcgacgccggaggttgaccctgagagtcgtggtggggacattttggggcggcgcctctgttcggacgaaataggtcctttggaaagctatcgccgccctgtgtcggtggacacgttcccggcaggacaacaaagttgtgggaaaagtcctatcagggcggatcagggtgtgtaaaaccctaacttgagtatgacccgactatgtgaaaccgtgttgcacaagtgtcgggaccccgcgacataagtacggctggaattcgcgcaccggtgtcaccagtggcgccacaggcttgccaaaaacg

SEQ ID NO: 558743 - DNA, 466 bp, Homo sapiens
  misc_feature (233)..(233): n is a, c, g, or t
  misc_feature (392)..(392): n is a, c, g, or t
  misc_feature (424)..(424): n is a, c, g, or t
  misc_feature (459)..(459): n is a, c, g, or t
gtctgagcaagtggggaatgagatcaggtgttgcacatttctggtccatggtcccgatctggtttgtggcttggagggagagtagatttagatctggggggctgggtggggggccatagccttggcagctggctgggctaaccagtacttatatctttgggtcttgggcttctcaaagttcacgacagacataggcactctcacagtatcaagcccatttaccgtcacctcanaccaatactcgccccaccgtgtgataggctcttcgggtaactttactggtctcgtgggggcaaccacaacaccaagattcttaaagaaggggggggcaactatttcagggttcagctcccattggacattgttcttcatccctaactccaggcgacagntttttagaacatttcacggtcgcctcaccggncttggtctggatcttctctaattttcccagttggntcagacg

SEQ ID NO: 558744 - DNA, 158 bp, Homo sapiens
tgtaacagctaccctcgatgtcgcgcacttcgtatcattgtgaatgcggtattcaccatagcagttggaacttgtacaccctactaatagggaacgtgacctgggattagaccgtcgtgactgggataagaatgacccgactggtgatgtatcgtcgc

SEQ ID NO: 558745 - DNA, 206 bp, Homo sapiens
  misc_feature (78)..(78): n is a, c, g, or t
cagccttgaactctggggctcgagtgatcctccttccttagcttctgaagtagctgggtctccacacaagcgccatcnccggcttgtggtcccagctactcaggaggctgaggtggaaggatcacttgagcccaggaggtcgaggttgcagtgagccatgattgcgcccctgcactctagcctgggcaacagagaccctgtctcta

SEQ ID NO: 558746 - DNA, 522 bp, Homo sapiens
  misc_feature (69)..(69): n is a, c, g, or t
  misc_feature (73)..(73): n is a, c, g, or t
  misc_feature (75)..(75): n is a, c, g, or t
  misc_feature (103)..(103): n is a, c, g, or t
  misc_feature (109)..(109): n is a, c, g, or t
  misc_feature (113)..(113): n is a, c, g, or t
  misc_feature (115)..(116): n is a, c, g, or t
  misc_feature (124)..(125): n is a, c, g, or t
  misc_feature (130)..(132): n is a, c, g, or t
  misc_feature (136)..(136): n is a, c, g, or t
  misc_feature (142)..(142): n is a, c, g, or t
  misc_feature (145)..(145): n is a, c, g, or t
  misc_feature (150)..(150): n is a, c, g, or t
  misc_feature (498)..(498): n is a, c, g, or t
aagcagttaatacagactcagtgtctgcctttaaatataaatgatatgttgaaaacttaaggaagcaantgcnanatatatgcgatataaaatagtaatgtgnatgctngatncnngttaaccnnaaggnnnaganataatnagncaaantgccacaaggggtcttaattgaaatgaaaatttaattttgtttttaaaatattgtttatctttatttatttgggggtaatatagtaagtttttttagaagacaattttcataacttgataaattatagtttggtgggttagaaaagttgctcttaaaagatgtaaatagatgacaaacgatgtaaataatttggtaagaggcttcaaaatgtttatacgtggaaaccacacctacatgaaaagcagaaatcggtggcggtgtggcttctttttccctcttattttggtgatggggggcatttcctatgcaaataatgggggcaacagctgtatagttgtagacaatcntgagagaatgagtctgtattaaca

SEQ ID NO: 558747 - DNA, 456 bp, Homo sapiens
aagcagtgctatcaacgcagagtgcccattacggccggcgggggaggaacaaaaaaaaaaaaaaaaaaaaaaaaaacaatctgtgttggcgccgcgcccgtgggaccctgagaaaaagcttttcaagaacccattgccgtgtgggcgcgcgcgcgggccccagttagggtataatggtaaaagcggtggtcacataagcgtgtgtttcaccaaagagaaacacccgcggggccatagcatcaaagtggctgggggattttctccacccaatatataaaaaagacgcccgggggggaaaacacggagaggtgtttccgtgaaaaacaaatttccgcagatagggagagtttccgaggagagctcacatcgcggggatatctttatcaagcagaggagaattccccaaaggaggagctctccgaatatcataatttagcacgccccgggcgtggtggc

SEQ ID NO: 558748 - DNA, 798 bp, Homo sapiens
  misc_feature (305)..(305): n is a, c, g, or t
gaattattttttacgataccgctggacaacagcgctggtgggagcaggagcttaaaataaatgggaatattcaaaagggagaatcttttacatataacttgacccagctaattaaaccagaagcttatgaagtccgactgactcctctcaccaaatttggtgaaggagattcaacaattcgtgtgatcaaatatagtgcccctgtaaatcctcatttgagagaatttcattgtggatttgaattttgtaatatttgtttgttcactcaagatgatacagatattcggtgcggtacaaagcaaagnacagcaacaagaaatacaaaatatgcgcctcctacaggacctaatgctgaccgtagtggaaaaaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgcgtatctacgtttgaaagggcaaacaaccatagagaatcccctgtggggtttcagtgggaacaaacgacagagatggaatgaggctcatgttaaaatatacccaagtacttcattgccactcaatttttgaggttcccaggtccttgaatagaaagtgacattggtatggtgaggtgtgaacgcagacagagactggcaataatgaccaaccacctatagttccgtgacggggggcgggatcaaggacaatt

SEQ ID NO: 558749 - DNA, 377 bp, Homo sapiens
agcgaaagacagcacagaccaattcggaacagcctcataatgaagaaaaatgaaggctcataatctatcaagagtgctgaatatctgcatgtgaaagacttagtgtttctgttttcttgagacatttaatctggtggtaactgtgtgtaacattgcagccctgagcagcatgtgtatataatgatcattgtgttgtgatgctactcactttgattgcaatgatgatgtccaaggtaagctatcaaaaggcaggttacttccaaatcgcactgtaggataaggtttagaataatacatgatcaccgaaatgcataccactgtctgtgaagcctacaaaattcactgttctcttttggatttatttagcctgatgtatt

SEQ ID NO: 558750 - DNA, 318 bp, Homo sapiens
attagcaggtaagcaaagcggctacttctgaggagaaaatgtggtttctgactttacggtacatcacgactatcaccagtctgaatgagtatccttatatctgtaaagcagaaagtgtcatattactatattcactccagtgtgcagatgctcctacatcgacaaatactctatcagagaaagtatctgtacgtctgtcttagtacaaaaccattccttccctatgtctcaatgactgacattcaatgcctgacagaatcagcatttggcatgtccttggatatggcatcactatgatgctatgaactgaaagttcac

SEQ ID NO: 558751 - DNA, 615 bp, Homo sapiens
ccacgcgtcggttctggacatttcatatcaatggaatcatacaccatgtggctttttgcgtctggcttctctcagcttcatgtttttggggttcatccatgttgtagcacggagcagtggttccttcctttttatggctgaatcatactccgttgtgtggatggaccacgttttgtgtatgcattcatctgccgatggacatggggttgtttccacctttcggctattgtgaatagagctgcggtggacattggtgtacaaggaattgagtcgctgctttctattcttttgggtctatacctgggagcagaattgctacgtctgtatgtagttatgtaatctcttttgtcaggcttcttcttttttttgagacggagtctcgctctttcacccaggctggagtgcagtggcgcgatctaggctcagtgcaagctccgcctcctgggttcacaccattctcccgcctcagctactcgggaggctgaggcaggagaatcacttgaacccgggaggcagaggttgcagtgagccgagatccgccactggactccagcatggtgatagagtgagactccatctcaagaaaaaaagaagcgtgcagagggtgaattgggg

SEQ ID NO: 558752 - DNA, 279 bp, Homo sapiens
tcgatctcctcaccccatgatccctcgccttggcctcccaaagtgctgggattacaggcatgcgctactgcatccatcctgtttggttctttttatgatttctgtctctttgttgaactaattttgtttatgtattgtttttctgatttcatttagttgtcttaatgtagttcagtgagctatgcaatatagatagacaactattttttattcttttttgattcttttttatttttatttgagacagggctcacttgcacccagactggagtgcaatgg

SEQ ID NO: 558753 - DNA, 730 bp, Homo sapiens
tggaaaggtttaaacgctttatggtgcccaaaaaaaggcccagtggaatgaagggaaaagccggcagccctgagcccggagcgatggtttgtcgcgcacccaaaggcaaggagggtggggagccgggaaaggatgcgcggcctccggcgcccccgcgcgcctgtgggcccggccaaccacggaccccgcccgggtgggcaggcgcgggagagagcttgaccaatgactgggaagatcactgtggcagtgaagcatttttcagtgtgaaggacagttgtggaattcaaagccctctctattgtgtcccacgagggtgctcctttggatctgttggaaaacagaaagaaaaagaacaacatcaaatggtttgtacgcagagtttccatcagggataacgtggtgaggagctaatcccgtgaatatctgaacttcattagagggggtggtagactcggaggatctccctctaaacatatcccgtgagatgttgcaacaaagcaaaatttggaaagttatcaggaagattttgggtcaaaaatgtgcttagaactctttactggaactggggggaagataaagagaatctacaagaaattctatgagcagttctctaaaaactataaaggttgggaatacacgaagactctcaaaatccggaagaagcttccagagttggtaggggtactaccatctgcctctgtgatgagatggttctctcaggactattgac

SEQ ID NO: 558754 - DNA, 267 bp, Homo sapiens
  misc_feature (39)..(39): n is a, c, g, or t
aaaagcccctggaaggcaaaaaagttgggagcatggcanacagggaagggaaacattttcagggaaaaaacatgtatcccatgttttcaaaaacaagtcaggtttcatgtaaccaagggtcctcttgggggtccaaaaaaaacccagggctgtagcacaggcttcccagtgattttgtgttcaaccgtgagtcacacaaaaagcccccgtaaaattgggcattggggacgtccaggttgtccttaagaaaaaaaaacgtatgttgca

SEQ ID NO: 558755 - DNA, 280 bp, Homo sapiens
aaaaaaaaaaaaaaaaaaaaaagaagaaaagaaaaggaaagaaaattctaggatacatcagattgaactccttttgacaaagataattagaattgcatttataaaatcataagaattcttaaaaaactaaagaactttggaatctcctctgagatgagaaaataaataacaaaataatgaaacatgaagatattagatggtattagaaagcagatattagatggtagcagattaatattacatggagattgtggccaacacgtaatagtgtttcagagaa

SEQ ID NO: 558756 - DNA, 409 bp, Homo sapiens
cgacatcttcgggcgcacggtgagcaagcgcagcagcctggacgagaagcataagccagaggaggaggagaagaaagcggagttcgagcggcagcgaaaaattcgaccgctcgaaatagaagaaaaactcatctgtgaagaaacagcgcgaagagtataataattggtatcaaaaagggtggaggaagaactggggaaaaggaaggatgaaattgaacgataagttctccgaatggtggcggaagccaaacgcatcatggaaaaacacatgctcgaagaacttgagcgacagagacaagctgagcttgtcgcacaaaaagctagataggaggaagaacgtgctgaacgtgatgagctaggagcgaatctgcaagagaatgaccgagcaattggtgaatcacaagccaaa

SEQ ID NO: 558757 - DNA, 1013 bp, Homo sapiens
ggaagttgagcaaccgggaggcgggcttagggccggaagcaggaaggagggctcaggacgcagggcgccgctgccagccttgctgtcggccggtgggactgtcggtggccagagcaggatggagaagctacggctcctgagcctccgctaccaggagtatgtgactcgtcatccagccgccacggcccagttggagacggctgtgcggggcctcagttacctgctggcaggtcgcttctccgattcacacgagctgtctgaactggtgtactctgcctcgaacctgctggtgctgctcaatgacgggatcctgaggaaggagcttcgaaaaaagttgcctgtgtcgctgtcccagcagaagttgctgacatggctgagtgtactggagtgtgtggaggtgttcatgcgagatgggggctgccaaggtgtggggcgaagtaggccgttggctcgtcattgctctcatccagttggccaaggccgtcctgcgcatgctcctgctgatctggttcaaggctggcattcagacgtcaccccccattgttccactggacagggaaactcaggcacagcccttggatggtgaccacaatccgggcagccaggagccatcatatgtggggaaacggtcacacagagtggtgcgaaccctccagaacagccatccctgcactcacgggtactggggaggccctcagcagcgggaaatcggcagaaacgcagcaggaggactgagcagagccaccaaaactctgggggttgcaggagacccctggccgaagcttgggcatctgccgggccctggctggacttggccagcctgggagtacgggcgcacggatcttggggcacccctggtacagtgctgggtgcgccactttagtacacgagctcccgcaggagcgacaaccttgccccaaacggccggatcaccacgggggcgacacccggggaaataccgcgagcagcacggatttacgagctctagagcaaccttgtcgcatgttacgcac

SEQ ID NO: 558758 - DNA, 976 bp, Homo sapiens
ctactctgaagcgttataaaaacctgtaaacattatacaaagcccacaaaccttatagaaactcgtaagtgtgtgtgactggaaattgattcattagaacccagttttctttaagaactttgtgactcggttttattttttccttttccaaagactgtaacaaatacgttgccccaaaatgtcagcactgcacaccctccagggacttggaatacaatccttttctactttttctttctctttttttataaaaaactgggtctcccgtggtcacccaggcgtggaggtgcaggggcaacgatcaatagctaacgtgcagcctctggacctccgtgggctcaaggtgactcctccgtgccctacagcttccggaagcatagctaggacatacacgggtgacagtgccaccagtgaccgggcctaattacaaaacacaactccctctccaacgacacgaagtgggactcccctcaccctttcaaacactcagaacaccccggtccaccagtgggagcgctgcgtcctaggtgcgccacaacaacggacgttccacaaacctctcggcctccccgcatattggcataataaaatccggactacaccaaaccccgtggtaggaggcctagaacaccctgggggcgactccgagaaccccttctccgcccaccacacacgacaaaaagcgtgacccctaaacctaaccccacacgcggcgaccacacctcctcactcatctcgcgaacaaccttaaaaagggtagccccaccactgtcgtaaaacgtgggccacgaccaacaaagactcttgcgcacactcaaaaccagccaccagagagagtgaggcgaccatacacactagtacatcgtcacaaggcgcaggaccaataagagccccaccataaaccggcgcacgacacaagttgacgacacaacctggaccaagacagacagccaccaagacggggccccatacatga

SEQ ID NO: 558759 - DNA, 124 bp, Homo sapiens
gcgggtcgctggactctcgccatggcaggagaagagtttgaattctaacgacgagccgtgttgaaacttctttgtatgtgtgtgtgttgttttcactattaaagcagtactggggaatttagta

SEQ ID NO: 558760 - DNA, 266 bp, Homo sapiens
tgacctactggactgacactggtcggctgtttccactgcgctgcccgttactgcgatgtcatcctgggctcggcgcaggagtttctcacgccgtcggcttccttctctgccgggtagccccgtgtgctgggcctggccagtggatacccggaacaccaaatcgttaccattgaggtgcagagggagagtctgaccgagcctccgtatctcttgaccacgatggcgcttacctttcaggacttccattaaactaatgagcaaagaaa

SEQ ID NO: 558761 - DNA, 180 bp, Homo sapiens
  misc_feature (11)..(11): n is a, c, g, or t
tagaggatccncagtgccccacccgaaacgacggagacaatgagaacggtggccacgacggtgacgacggacaccagccctagcgaagtccaatcaatattcatgctgcagtccctccggctacggcggagcccttacggacgcccacctgggtggagtcgttaacgttcctatggtcaa

SEQ ID NO: 558762 - DNA, 147 bp, Homo sapiens
caatcgagctcctaccttaatccccatacagagtacgcgactgtttgaaaaaacaaagataattatggtatttgcttatggaattcaataatcagtaacctaaagtacaggttcggtaaaggtttagtaacctttagttaacccagt

SEQ ID NO: 558763 - DNA, 132 bp, Homo sapiens
tcacgtaaaaagtatagaacggcacaagacaaacactgacacaccagtagtgatgtcaaggatgtgaagcaacaggaactctccttcactagctaggtggagaatgcaaacatggtacagccactttggaaa

SEQ ID NO: 558764 - DNA, 579 bp, Homo sapiens
gccgtacacacaagggatcccagcagaagactgcgccaaatgtccatggtctctatgggcgagaatacaggtcacggccccttgggaatattattagacagccgccaataagacacaaagcggcctcatcgtggggagaggagtactacttgatggacggtatctgcacgagtcccaagtagagtacctgcctggaacaaggagatgatcctttgtcggcatgaccgacgacggccagaacggcggcgcccagtcaagaggttcatctcaaaaaacgctactattgacgatacctacattgggcccactggcctacttgactgcacaacacgagaacttggtcctcagtgactttatttggaatgtgctacacatcgctgtacaatagactctacaataagagtcaggaatacaggatcctgacatgattagacccgaaatacttggggtggggcagtcctggggttaaacgtaccgactggctgtggggggaattgactcatgtacggtgtccggaatcataggagttgacgtccatgcagcaaatggtaccaggttcccccttcacaatctgataac

SEQ ID NO: 558765 - DNA, 510 bp, Homo sapiens
atgatgtacagacatgctcctgatcccctgcttagcccacggaggactgtggtgtaggtggggggttctaaaattaacttttagcccccgtctacctattatgagtagggtacagatctaaagcagctccatgcaattgtattaattttggatgacaagactcccatctaaggtttttctccggcctgatcatttcatgggtggctgaaggatactagagaacctttggtccttgcatggaaaacaagaatccaaaaccagtgactgttctgtgagtgatgggtgtctgtgccgttggtggtcaggtccaggttccaggaagggtctttccagtcaaggtcagtggaggcccaacagccacagcccacagatggatccatcgctgcagtgaaggaggagcagggcctagatggtggaggagcgggccaacctggtgggcactcctggccttgcttcactgtccagctcgagacactatctccttagcatcggcctcagctagctgaagta

SEQ ID NO: 558766 - DNA, 724 bp, Homo sapiens
cgattcgccctatacaaggtgtgactttcccgtgctgtgaaaagacatttatcactagagaatgccctgattttaccataaccgagtccacttctgggaacaagagctcttttcctgctcctattccctgggtgcatcaaagccttgatatcgataaacgccatagtcaggtctgaacaattcacactgcggagccatacaggtcgcacaatgacccatctctatttgtgactctgacagcatgtggctggcaccttcaccagtcatgtccaaacttctaaggcacagaaggaaacatgaccgcatgaccggaggtttacctgcccctgtctgagggctgtgggaaatcattcaccagagcgagagcatcttgaaaggccacaggcataagcccacctaggcacaaagccgttcgagtgtcctgtggaaggatgttgcgcgaggttctccgctcgtagcagtctgtacattcactctaagaaacacgtgcaggatgtgggtgctccgaataagccgttgcccagtttctaccttgcaacagactcttcacctccaagcacagcatgaacggcgcacatggtcagacagctacagccggcgccaagatctcttacctcagctagaagctccgagttctcttactcccagcagtgaactcagcagcccaggccaaagtgagctcactaacatggatcttgctgcactcttctctgacacacctgcc

SEQ ID NO: 558767 - DNA, 210 bp, Homo sapiens
atcagagtgtgatgaaagatgtggagcaactaaaactctcatacatctgtggtagaaatgtacagtaatacagcaactttggaaacgagtaaggcagtttcttataaatatatgcgcaccatatgacctagcatttccactcctaggtggaaataagataacagcacatgtccaagctgggcacggtggctcatgcctgtaatcccagca

SEQ ID NO: 558768 - DNA, 476 bp, Homo sapiens
tcctttgacgacatcgctgaaggctctcgtaactctaccgtcatgtctaagtccgagtctcccaaggagccagaacagctgcggaagctcttcatcggagggctgagcttcgaaacaaccgacgagagtctgaggagccattttgagcaatggggaacactaacagactgtgtggtaatgagagatccaaacaccaagagatccaggggctttgggtttgtcacatatgccactgtggaagaagtggatgctgccatgaatgcaagaccacacaaggtggatggaagagttgtggaacctaagagagctgtctcaagagaagattctcagcgaccaggtgcccacttaactgtgaaaaagatctttgttggtggtattaaagaagacactgaagaacatcacctacgagattattttgagcagtatgggaagattgaagtgatagaaattatgactgacagaggcagtgggaaaaa

SEQ ID NO: 558769 - DNA, 1080 bp, Homo sapiens
tgccgccagacacacaggtgtcgtgaaaactaccccgtaaaagccacataatgggaaacggcaaaagactcatatcaaccacttgtcgtcattgtgacacgtagattcgggccaattcctaccacatactggccatctgcatctatcacatgcggtgtgcatctgacaaaagaaccattgaaaaactttgagcaaggaggctgctgacgcatgcggacacgggctccttcaaagtatgcctggagtcttgcgactaaacctgcaaacgactgaggcgtgacacgtggtatcacacatcggatatctcccttgtggcacacaatctgagaccatgcacagtactatgtgcactatcattgatgcccccaggacaacagcaggactctcatcaaacaccatgattacagggaacatctcaggcctgactgtgctgtactgactgttgcctagactggcgtcggctgcactttgaacctgcgaatatccaagaatgagcaagacccgagagcaatgccctctctgggctatacaccacattgggtgtgacaacaagctaacttcgacagagcgtcaacacaaacagtggcttcccactgagccaccttacaagccagcacgagatactgaggacacacgtaacgagactcagcacctatacacttcaacacacacatgggataacaaaccccgatacacacacaacctttgttgccaactccactggtgtgaaacgtgcgacacacatgtctgtagacagatgatataaaatatgctattgcctccagggacctggcaagagacgcctgtacgactaggccatgccacgcgcacaccaagctggtgacagcccaggataaggcaaccgatacaacaatgcatgtccaactaatcaaaccatcgtgacgctgctcatcaaggtatgtatactcaatggggtccccggcacgtttccgtaacgaaaggaccaatggagaataacacagatatgtactaccagtaagaggacgatgagaagccataagttcgtaaacgcatgatgctgacccacgcgaatataaccattcatacagcgataggatg

SEQ ID NO: 558770 - DNA, 395 bp, Homo sapiens
gtattgcgcatgagctgtatctagagtatcccctgctatcgtcatatcgaagcgatcagatgaccagcaggcggtacaggtcgcccttcttgatcttctccggcttgagcggcttggttaggtcctggttggtcagcatgaggatgcctgcgccaccgtacagacgagcccagcttgtggcttcgctcaccatggccggcagttgcaggcggtcttcctcggcgcggatcacgtccgcgtcatcgcacttgagggtgcgccactcgcgggtcatgtcctcggccgggtagtcaacgatcgccctggcaagccagctggtttgatacgcagcatccaactgctggaagtcgttcaggaacccgtactggaactggttgtgtgagcgcttggccttc

SEQ ID NO: 558771 - DNA, 381 bp, Homo sapiens
  misc_feature (25)..(25): n is a, c, g, or t
  misc_feature (112)..(112): n is a, c, g, or t
tactgaggtatactatttttactgngattttgaaactccaagataatttcctgaagaaagttttttgacaattttaccttttgaaaattccccattgatctgttagttatcnttcaaaacgtctggagaaaagtcaggatatatatataacagccaaatgggcaatttctactgttttcattactttggttttagaattgccactactgcttgcttaatatttaaaatttgctggtcttaaagcaacagtctattttccaatcttggggaagattatggtcgtataatataccagatggacgcattagtactgttaaaaaaaaaagactagttgcctatatgaattgcaaacttaataaagaaaatgaactaggaagaatg

SEQ ID NO: 558772 - DNA, 398 bp, Homo sapiens
cttagtagtctatgttggggtggacgtgggaggaaagaatgagtccttcgacgcaggaagggcgatagcaggggaaaggttctgtgcctgtgacctatgggcggtcactcacgttgctccatttatactaatacggtggtctcaggaaggtccgatttttcttctctttcttccccttcgtattggcttggaagtaacagacagatgtccaaacgaccatctcgactttcctcaaaaggtttttctgccactctctttcccgtttgaatcaatcttgagcttcaatctcttcttcccttagtcgtaaccttacatgcatctcttaggctactcctctctttacttttaattaccagctctgcaaagagtatcaattgtctgtatatatacagcttgtc

SEQ ID NO: 558773 - DNA, 486 bp, Homo sapiens
ttcaccgtgaccaggtgattgaccagtgcaccttatgatccggtacagcaaaatagtccctcatactcactgtatctggcaacacagagaatacctgcagctcccacataacagatctccatccaacacagacagacccaggtagattggtgatcgataatcaattgatgagcataccagctgtatatgactaatggctaaccagagaagtctgtacattctacactgacttctctgtatttctctgaccacctcattatttgtgtgtaatatattcataacttgcattatgggtatttaaagtcctttggaaggtgctttaacttattgaggcttttctttactcttccggtgtattgtagcagaaatgcttatgctaaagcatggtgttaaggaaactgcacacctttaaaaatactggaacagagtctcgctctgttgcccacactggagtgcagtggaatgatctcagctaactgcaagctc

SEQ ID NO: 558774 - DNA, 449 bp, Homo sapiens
ttacaggcatgcaccaccatgcccaggcaaagagacatactttaaatgtaaagacaaaataggttgaaagtaaaagaataagaatggaaatagatatactatgcaaatagtaacagagctggagtggttatgttaatattgagcaagcagactttaagacacgtgactgggcactgcggctcatgcctgtatcccactttgggaggctgaggtgggaggatcacttgagactgtaagttccagaccagcctcggtaacataatgagatcccgtctccacaaaaaataaaaaaatgaggcaagcgtggttatatgtacctgtagtcctagctacttgggaggctgaggtgggaggatcatttgagctgaggaatttgaggttatagtgagctatgacaatgccactgcactccagcctgggtgacagagtgagacgctgtccctttaaaa

SEQ ID NO: 558775 - DNA, 416 bp, Homo sapiens
ctaactctgcttctacaagagtttccttatcacttactgaataccgattgtgtcttcttccctcaatcacctgggaggaaacatctatcatcctgtcctgaagggagttcctcctaggtctggtcggacctttgtgtagtaattaagatttagatcccctgctaggaaacctgctgggttaagggaatttttagtggttaatgttgaatctttttttttttttttttttaacagaattgcctcatactttcttctgttagcaaagcagttgtcgctacagattgaatgtatttgggccatctacgggttattgggttaaggatttttgataggaagggtacgggttgtcagtgtcctcagtgaaaattggttttgggttcttctcaaagcccccagacaggatgccaccggacgcg

SEQ ID NO: 558776 - DNA, 447 bp, Homo sapiens
  misc_feature (409)..(409): n is a, c, g, or t
  misc_feature (443)..(443): n is a, c, g, or t
ggagctagtgaaggaaacatagggtttatttggggaatcttacagggtggtccagtggccgcggctggacagaactgcaaccacttataaaaagcatgcagtttacatagcactttcactcagcaccctcccctcagcagcctccacgtggcaaccctcacttcttaagttattgctgtcagatgcatctgccatacagggtcattctcaggggatgcttaagttatttctgtcaggtacatcttccatacactttactaccttgggagtaaagtagtaaggaatacagctttttccttaacctttaccagcttaactcagtgcttagggggccttgggaatgcctgctgtccagcaggtgttcacagggccttgactgggggggctgggcctttattccaacagtgtntggaagggtcacatatggggttccctgaggtganttac

SEQ ID NO: 558777 - DNA, 839 bp, Homo sapiens
gcagtgagctgagatcgcgccagtgcactccagcctgggtgatagagcaagactctgtctcaaaaaaaaaaaaaaaaaaaaattaggcttgggggtgtgtccctgttttcccagttattctggaggctgaggcaggaaaatcgcttgaactggggagctggaggttgcagtgagccaaaatcgccccattgcactccagcctgggcaacagagggagactccgttattcaaaaaaacaaaacaaaacaaaacaaaacaaaaaaacattgccgggttgcgttgggcttcacaccgttgtaatcccagcactttggggaggccgaggcgggcagattcacctgaggtcaggagtttcgaccttggccaacgttgggtgaacaccctgtggttctctactaaaaatacaaaaatttagtggggcattgggggcagatgcctgtaatcccagctactggggagactgagcacaggagaatcatttgaacccggggggcggaggttgcagtgagctgagatcgtaccatggcactccagcctggggaacaagagcgagatttcgtctcaggacaaaaacaaaagaatttcccgggctgggtgaaccaattgttttattggtcccaaaaacccgggaaggcatgaggcgaggaaatttcctttgaaaccggggaagcgtggaggttggcgtgacgcgaaaccgggcattggcacttccagccggggccacaggagtagaactcatctaaaaacacaaaatttgccaacgtggttggtgtcacgtggtccacaactggggcgaagaggagaactggagctgggaaaagatgcggtaccagcagggc

SEQ ID NO: 558778 - DNA, 237 bp, Homo sapiens
tgtaggaacagattcaagagatatacaggtggcaaagtccatagactccatttgatggattgaatatgagggggaaagaaggcattgacaaaagcactctccaactttctcagcttacagcagctagcatacaaggtcaaatcccattccactgtggccaggcaaatcactggcagtccccagcatttcaaagcagcatcaccaggttccaattaggcaggcagctataacacagct

SEQ ID NO: 558779 - DNA, 1166 bp, Homo sapiens
  misc_feature (201)..(201): n is a, c, g, or t
gtgtacccccgtcggacaaagtccaaataggcggggtcatatccttttgatacctgcgtataggccctctgcaaaatgggttataaaaaacatgtggatttttttatgggcaagaagcttctggaacaccggtttttaccagccctagtttcccagatcctcaactctttttccagggggtaattttaaaaattcttcgcntgagagtttctattactggaaaacaacgcatgttccaagaaagggagttacccgggggatccacccaatggtttcaaactcggggacgcccccggggattgaaccgggtggtgacatttgtatactgtccaccgtgggaccccaccccaactcccgtggtaaaagggccccacacgagaaggtttaaaaaagtggggttttttcaaaaattccaaaaaggagtgcaactgttttggggattaaaactgtggccccttgtgtgcccccccacgaaaattgtaaccttctccacggcaaaagcacttgtgtctttataaaggcttaattaaaaaggggaggtataaatacatttggagtaccttaaattggaaattggcacaccttaaataagcgcaaaatgggtttcttaataaatgcttaccctgagattttttaatgaaaaaaggtggtttgaccaagccccagaaattttatggaatgtaagaaatattcgggaaagtttcacttttcccgggatattcacactttcttcccgggatattttttaaaagtgtaaatttgggaaaatattaccaccccgtttcaccctttatttgtggagttcttttgccaccacatttgaactgaaattgaagctgtcacatttggaacacatttataaagcacagcctgtttttggggtctgtgaagaagtaacacatgtaattaataataacacagcgaccaacacacgggcttgcacactaaaagcaattgtcacttgtaataacacctaacttggtaccctaaacttcaataataatgtaatttttaaattgcaccacaaaagtcacaataaatttgtcacccttggggttttgaaatgtttgctttaaagtgttggctatttttatgttttataaacccaaaccaaatttcccaaaacaatgaagggaacccaccactcaatatttttgcatttccca

SEQ ID NO: 558780 - DNA, 196 bp, Homo sapiens
  misc_feature (88)..(88): n is a, c, g, or t
  misc_feature (133)..(133): n is a, c, g, or t
  misc_feature (139)..(139): n is a, c, g, or t
  misc_feature (167)..(167): n is a, c, g, or t
gtaaggaagtgattgtgggttagaattttaagtttctattcctgataaggatttcatttgacctgaaaaaatggagagacaaaggatngggggcaaaagagtagctaactctttgatgaggctagtattaatngggtcntactatgccaaagagatggatccagaantaagaaagatcaaagaaaatctcctcaga

SEQ ID NO: 558781 - DNA, 150 bp, Homo sapiens
cggcacacacacgcacacacatgcacacacagcacacacacaaacgcacagcacacacaaacgcacagcacacagcgcacagcacgagcacactacacgatgcacacagtcacacagaacgcacagtcacacgcacacacatagcacaca

SEQ ID NO: 558782 - DNA, 690 bp, Homo sapiens
aatgagagtttgcaactccgtgtccaacagctggtggccaaggaattggggccagacagggacacggctcactccagctgtcaaagcagagcacatgaagcgacaaagacatccatgattgcgcccacagtcagcccagtcttctttccctccctcccctggtccatctcctgatgtgcaactggcaactctggctcagagagtcaaggaagttttgccccatgtgccattgggtgtcatacagagagatctggccaagactggctgtgtagacttgactatcactaatctgcttgagggggcggtagctttcatgccgaagacatcacaagggaatcagtccctaccccagcctctgcctcaagtttcccagctatggcccagccagggggggggttttgtaacacccatcagccaacagccataacatttgccaagtcttcctgggcccggcaggagagcctgcaggagcgcaagcaagcactatatgaatacgcaaaaaggagattcacagagagacgagcccaggaggctgagtgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaagg

SEQ ID NO: 558783 - DNA, 1537 bp, Homo sapiens
ctttttaaagcaattgtcctcacagagaccacatatttcagtatattacatgtggtctctgtgaggacaattgctttaaaaagcgtgaggcgtagtgcttagagagatatccacgggcgaattgtgggtcacgagtagaccagagtgtaatgatagcgtgaaatatgtacgatgttggtaataggatttaggtgaaaatgaaatggaaatgcatgaaaaaaaattattagacttgtcaggatggagggagagggagcacaatgataatagttagtagcagttagcttaaagcgcgtgataaagagttggataggaagttagtggagcgatcagagttaatatcaagtcagtgtgatagcaaacgacaagacgaaactagagaaaataattgtgaggtcaacgcgcaaagggatataccaaatcagcgattcatgtggacagatgagtctcttttaaaatgtcgaaaaagtaagagtgggtactgaacatcaattaatacgattaggagacgtcaagaacgatgcaaagaaacaatggtgaattgaaacccgttaagagaacaccaacgcggaccacgcccgatcgggaatgcgaatggcttcaacacaaaactaccagacccagacgcatcacggaacgaaacacggcaacttaaaggcatcaccttatagaatggcggagccaatgtagcacaaacttaggtccaagcgtggacaagagcacgtcacagatccgctcatacaattgggccacacaacaccagggaccgagagcaaagataacaacacaaaaaaggaggcgaggaccatagaacgacgacgaacccccaagacacctaggaaacaagcgacacaagcaacggtcgcgcaaccgcagacaacaccagtaacacggcacaagagggcagaccaagacacggaccacgaggcaaaaaactcaacaacgcacacacctaagacacaaatgaaagcgccacaaaaaaaacaaagagggacgaaaaacacaagaacgcaaaagccaaaaaagcaaaccaggcaaccacaaggaagctgaaacagcaaaacagaaacaaagagagacagaagagaacaccacaacacatttcgacagacagactcgaccacaagaagcgcacaccacacagaactcacgaagtacccacacacgaaaaaacacacaacgaacaccaacacgagcagaagacacacgtacaaacgaaccgaagaacaaaacagaaactagacaaccacaaagaagcaaaggaccaaacaacaactgagagcgaacagcaacagaccgacaacacgcaatacgcgatagagaaagagacaaagacaggggaaaacacataaatagaaaaaggtgccagaaaaacacaaaaaataggagcaacacaaagacagaccaagagaaaacaacaagagcaagacagaaagcacagagaacgcagcacaaaaaagatggggacaaaaacgaaccaagcaaacagacgagaagtaacgaaccaaagcgaggagacgaacagagcaaatcagaa

SEQ ID NO: 558784 - DNA, 98 bp, Homo sapiens
ccaattgaagaaactgccattactgtgatgtttttggggactgccccccagccaaacatgtatccaaccaaaagatttattaaattgtggccattttg

SEQ ID NO: 558785 - DNA, 363 bp, Homo sapiens
tcatgcaccgcgggatcaaatcagcatacaaaaatcacgtaggcatgaccaggtgcagtggctcatgcgtataatcccagcactttgggaggccaaggtgggcaggatcacttgaggtcaagagttcgatgaccagcttggccacatggtgaaacctcgtctctaaaaaaagtacaaaaattagccaggtgtggtggtgtgcacctgtagtcccagctactcgagacgctgaagtatgagaatcacttgaagcggggagggggaggtttcagtaagccaagatcgagccactgtactccagcctgggcaacagagcgagatcctgtctcaaaatatcagtagcatttatatatgccaatagtg

SEQ ID NO: 558786 - DNA, 854 bp, Homo sapiens
ggctacaagttccagcccacagtgaacaacccgtacctgcagctcccccaggaggacgaggaggatgttcacgatggacggcaagtacatgacaagctacaagatggcagcatcaaaatgaagcctctgatgggggtgatatacgtgcctttaacagatatatgaaaagcatgtggtccaggtgcacacgtgattttatcttctgctcttccttcttccacacatgcaaggggatgcattgtaaaatgcaacatcagcttgaccagtataaaactccactagtggattgctcagtctcagtcctcaaaagctttttgaaaaaccaacaccatcacagcttgttttggactttgtttgacactgttcacttttcacgcatgaacatgtgttgtccgacactaggggcttctgattcttcaagaggaggcacatgaggccaagattggtagagtgaaggatgcaaccgtataaattgtgtgtaatattacttgtaacatgcccatattttacttgcgaatctcttaacacgaacacgggttctgtaaaattggaaaacttaggtgtgaattgctttgaggagtgggtcccctattcttggacacataagtctgggcctgagtggtcattgatcagattgcttgtgtgcgtggaatagcaccaccattcccaagctacgctcctgcgctgggaatactggtagaagctacgtaggagatgaagatgaccttcctttttaaagctttgatggggggcaagaagagctggtgggacatcaccaggggtggtaccctaactaagcttgggagttaccaaaaaggaggggagccgctaacacgcggcgaggaaagcagagc

SEQ ID NO: 558787 - DNA, 339 bp, Homo sapiens
ccccccccccccccgggggggttgggagggggcccagttttttttaacaaaaccaccctttttccaccccccctaccaaaaagttttttttgggaaaaaaaaccccccggggtttcaagggttttaggaaaggttccccccccaattaaaaagccttaaaaatccctggggaaagggatggcccaaaaagaagggatttgggcccttttttcccccaaacccccctgggggccggtttaagttttttttgggggccccccattttttaattttttttttaaggggggggggggggggaaaaccccctttttaaaaaaataaagggggggggggggggga

SEQ ID NO: 558788 - DNA, 387 bp, Homo sapiens
ggcactacgagttatctagaggatcccttggagagggggtctcaggttatgtatcataaacagagaccatagctactagctaaggagaatttaaaaccaaataacccaattaaaaactggggcaaaagacttaaacaggatgggcacggtggctcatgcttgcaatcccagcacttgggaaggcagaggcgggcggatcatgaggtcagaagacagagatcatcctggctaacatggtgaaatcccgtctctactaaaaatacaaaatattagccaggcatgggggagggcgcctgtagtcccagctactcgggaggctgagacaggagaatggtgtgaccccgggaggtgaagctattgcgccactgcactccagccggggcgaca

SEQ ID NO: 558789 - DNA, 579 bp, Homo sapiens
atggcagtaacttggtagggagcagaaagggtcttggtgtttaaaagtcttgttagaatgactctcattctcacctgtgaacccagtttagcatttatgtacttaaggaaggacaaagaggtgagctggactgtgctgctgccatctcagtcactgcaacctccctgcctgattctacctgcctcagcctgcgagtgcctgctattgcagagcgccgcacacggccacgacctgactggtttacagatataaaaatggtagagacggggtttcagcatgtgtaggccgggctgcatcatccagctcctaaaccgcgagtgaccctgacagaccttggacatcccccgacggatgcccaggcgactttgcaagaacggaagtcatcgagcttccacctcaagatgctccaaatggataggccccaaggctgggaggcttgcacacgtaggacgcataaatcatcaggagcatacgctaatcaaccccttccacacttcccacaccggcacttgccatctgtgcccttacccaacaggtggccgaggattagcgaggcccacttgccccggccagcaaccg

SEQ ID NO: 558790 - DNA, 1046 bp, Homo sapiens
  misc_feature (330)..(330): n is a, c, g, or t
  misc_feature (348)..(348): n is a, c, g, or t
agcggagattgcccggagattgcgctgtgactggcagcctggctgtcttgcctatgagggttcccagcaccatgtacggccaggatcttcttcctccttcggcctgggccgggcaggcgaccgttgggcagcctcacatactaacacaagaagcctccctgcgcgtgatggagcacaggaagggtaggctgagaaatgataatatgtagagcatgaagcgtagactagacgtgtatgcttggagtgcgagctgaaatctctggtctcgacgggtgggaaagctaggagagaaacttctagaattgattgggtggcacgaagcgaaatgtnccgaaatcacgtgagtgntgtgtcgcgtcagtgaacaatcctctgaggagcaaccaacacgatgtggcaaacacaacggggcaaatgtgtagttgtcgtacactagtcagtgaatgaaagcaaaacaaccccccacaatggtagccggtggatgctcgaaggtactcgccagcacattattgacgcacaggctctgcgcattaggggtgatggtggtagatggaaagggtagtagcaaggcccacaatggaccaaacgataggacaccttgcggatattctgtcacctgtcgcgtctctactgtatgctcgaacaaaacgtggtcagctcctgggaaggagtcaacacaacgaaacgggtcgccaacagagcttcacgaccctgggaactgacaaatcgcgggaacttgcctgaagttacgttgcgcctactttgacgcctgggacatcttgcatgcttgaacacgaattttgcccccgttggtgcattgcgtgggactagaggctcgatggaacgttccgtgtgtcaggcccatgcaattgaagacggggatcgccgtgactgggcagacccttgctgaactggagaatacagaaaggctgggtgggagaaccgaagaatccaattgggcaaatgaggaaggccggcctggggaaggcaggcagaacgaggacccgggggaggcaggtggggcccgggaacttccgagaacgaac

SEQ ID NO: 558791 - DNA, 431 bp, Homo sapiens
  misc_feature (372)..(372): n is a, c, g, or t
ggctcatcctatgacgcgaaagtaaccgagactatcaggatccggagacggaacatgtcctgaatggccggcagtacctttgaacccccttggtttactttttcttggggggaagcttcgaaccggaggaactggaaacctgaaaggtggaaactcagtgaaacatggtaactggacagaagaaaaagcaactgaaaaaggaaaaaaacgaaagctttggcaaccacaaaaacaccgaaaaaacccgggggagtttcccaaaaccccggaaacggcttttaaaaaaccccaaaggggggtttgcccttttgcacgataattggctaacggcaaaggtggacccttctagggtttatgagagagattgcaaanagtcgtttcaccaacgcggactacggaacttatccttttccgaagaaaccacggactta

SEQ ID NO: 558792 - DNA, 130 bp, Homo sapiens
  misc_feature (101)..(101): n is a, c, g, or t
ttgtatggatgggcttctatggtcctgaaagtaaaagaaagttcccaagtcaatgtgtgaaagctccagtgcccagtgtcaccctgtcaaatgcccagctnaaaagcattcaaagcatgaggagaagtgc

SEQ ID NO: 558793 - DNA, 203 bp, Homo sapiens
taccccattatgtgcgtgatcataggcatgagccaccatgcctggcttccacatgaaatttaaagtcagcttctcaatttctattgtttggttctaaaatagatgtaagggttttaaatgtgagcaacaatctctatggagccagcattttttgagttttctcatcccaatagctgctttttccgcctcagtcttctcctggg

SEQ ID NO: 558794 - DNA, 141 bp, Homo sapiens
  misc_feature (122)..(122): n is a, c, g, or t
tcaaaccggaacagataggaagggataaaggcaaaggagctggccctaggccctggcaatgaaccgggcacccttacttatccccaacccgcgggttaatgccccataagggagcgtcttangcgagatttctcctaccat

SEQ ID NO: 558795 - DNA, 508 bp, Homo sapiens
aaccagaaaagtccctggtctgtcccttcttatggggaggcagtgcctcgacagctccagctcccttgacctaccttcctcgccgtcacaccgcccaacctacgccgcccctgattatcgacgcccaggagaactaataatctaggatgatactagtgtactgacactgaacacacgaactcgaaaccttaaataacgcattgatccaatgatagtaataactgacatacctctacttcatacacaatccaccaaacatactatgaacaacatcaatatacaattcaacaccaaatctaaataacatacaatatacataccacaaaataataaaacttataacaactcactaaaacaaacacaatcccaagtgaactaataatataacacaaatcatcactcaatcatctatatacacatatatcaactaacacatctacatcaatctaacacacaataacacatccataatacaaaccacactacctataccaccaaacatacaaaa

SEQ ID NO: 558796 - DNA, 830 bp, Homo sapiens
acccgaggcggaccgaggcagtcccgccgcatgcgcagtccgaagccagtgcggggcctgagagggacgcgcgccccggggcccccgccgcgggcaccatgggtcgctgccacgtccgtcgtctgaggaggtgcgggagctcgagggcaagaacgggttctcatcggatcaggatcgcgcagctccatcggggatttacggcatgctgagtggagatcagcctaccattgcgcataggagaacttcatcaatgtgcccggacctggagctcaaccccatccgatccaaaattgttcgtgccttcttcgacaacaggaacctgcgcaagggacccagtggcctggctgatgagatcagtttcgaggacttccctgaccatcatgtctctacttcctggcccatctgactactcaccatggactgaggaacaggtggagctgtgcccggtaatggagtaagctgagtatttctgtatccacatgtacgactcggacagacgacggtcgcttcactctggacagaatatcgaactgtggtcgaggagctgctgtcgggaaaccctcacatcgagcaaggagtccgctcgctccatcgccgacggggcatgattggaggcggcagctgtgtgcatggggcagatggaagcctgatcaggtgtgcgacgggatcagcttcgaggacttcctgaagatctgccaggggatcgaccttgaggacaacgatgcagtcggttcccttaacatggaaaccatggcctttggcactgacccacgcacctccgggagaaactggctttgcatgggggcggctcccggtagtgaggagcaggc

SEQ ID NO: 558797 - DNA, 841 bp, Homo sapiens
tccctccttttgtgctctggacctttcatggtaatatattcacacatctagtgttccctaacaatctgagaccctctgtattcaaagcatactttttcctgtatacaattaatgattaactccatttgctccctaaccaaaattgttttacttcttttatttgagcagatttgtgtgatgccatgttgatatacttaagttgtcctggggttaaatatattcgtatattcaatcatccgatcattcatctatttactcagtcattcaacagatttgccaagcattgtgccaagtaatgagtgtgcaattgtgagccagaaaagacaaagtccacatcttctcagaatgtacagtcttacacatgtaaatgttcatagtattgagtgataagtatcactggaaaaataaaagatactaagggcatcagaggagcctctgaactgaatataggccagaaagaaataaggtaaggtcactcaagaatgactgaagttaccagggattattttagctccatgagggtaggaccatgtttttctcaacacccccaacccttaagtctctaaggtcctatatttttactttgtaattaacttttaaatctgttaaaaaaagtcatccctagattcatattcatgatatgtgaaacagtatgatcaagagagggtatcagtgaaggtaataatgaataaatcagaattgatgaattacagagataaaacattcagataaaattctgtagaagataactgttatcatgaaatgaacaagtccattatgtgtgggatctcaaatttaataaacatggtatgtcttctcctgattaagttttatagaatat

SEQ ID NO: 558798 - DNA, 580 bp, Homo sapiens
ctaaaaaaaaaacaaacaacaaacaaaacagatttctcacagttctggagactggaagtgcaagatcaaagtgtggcaaattgtgtatataaaagagggcctgcttcctagcatggaaatggctatcttctctcggtatcctcacatggtagggagaaaagcagctctagtgtctcttcttataaaggaagtaatgccaccataggggctctattctcatgacctcatctaaacctaattctctcctaaaggccacgcctcccagtatcctcaccttgggggtgagggcttcatcatatgaatttttttttttttttttttcttttttttggaaacagagtctcgctctgtctgccacccaggcgggattgcggggacacaatcccggctctcaacaagccccgcctccggggtcacaggccgtactccggcgtcagccccctcagtagcgggaactagggcgcccgcaacggcgccggagaaatatttggtataaccagaaaagagggggttaaccaggtcagccaggatgaccccgatcccgtgactcatgaccaccgcccggcaccaaagggtggat

SEQ ID NO: 558799 - DNA, 554 bp, Homo sapiens
tacccaggaaacagctatacacagtggttgcaacactggagactcgtggcacataccatatgatgaagacttggtagaaagatgttcctgttgaatgtacctaaccaatctggatattgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctgg

SEQ ID NO: 558800 - DNA, 160 bp, Homo sapiens
aggtgatacctgcttctgcccctcacaagacctgttcaactacagcactctactctacagtttactggctaaatccaccttcgacccttaagtttcagtacgggctatcgtagttttcttggggcagaagcagtgaagcggggatccatctagaacgtcg

SEQ ID NO: 558801 - DNA, 436 bp, Homo sapiens
agtatgcaaatgcacatagcagcattattcattgtagccaaaatttgaaaacaacccaaatgtccatcagctggtgaatagatccattgtggtacatctatactgtgggatactactcagcagtaaagggaatgaactattgatacacaaacattatagatgattttcaacacattatgctaagtgaaaggaatcaaatacaaaagactacattctgtatgactaaatttatatgaatttttagaaaaggcaatatacagggaaaggaaagcagatcagcatatccctgaggctactaagccaggtgaagggcaggttccaaaggggtataaaaggctttagccaagtaatgaatgtgttctgtatctttattgtggtgccatttacatgcctgtatccaattacccaaagtcattaaattatccaattaaaatat

SEQ ID NO: 558802 - DNA, 767 bp, Homo sapiens
tgaggcccatttgagatatttggtttcaattagggagatagttggaattaggattaggattgttgtgaagtatagtacggatgctacttgtccatgatggtcaaagggtaccttacgggtgagtcctgccgattcaggttagaatgaggaggtctgcggctaggagtcaataaagtgattaggcttagtgggcgaaatataatgcttggttgttgggatatatggaggatggggattatggctaggatgaggatggatagtaatagggcaaggatgcctcctagttggttagggacggatcggagaatggtgtaggcgaataggcaaattatcattcgggcttgatcgtgagggcagggcgttgtactacaggggtagggctagggtataattggtctggagtcgccaaggaggtccggtgagcaatacgtgtgacatatcattaacggagacgaatgcgacagcagaagtaagccgaggggcgtcttcgactggtggtcagcacagggtggacaggtgattacatccggaaggggaagtgaatcccaaagcgggcgttgttggagaacccccggttgtcggtgcccaccaagtaggcggtgcgatttggctgcttagggctgtcacataactgaacgcgccaagtattgaacctggaaatcggtaacagaaattcgtgtcgaaaggctgggacaggtcttactgaggtagctccctcagaaattcgtcgacaccaagttcttgcccccaattgttggacgggcgca

SEQ ID NO: 558803 - DNA, 1756 bp, Homo sapiens
attgacttctagagatttaattctttactaggtatgatctcttgtgtggttttcaacttcctgctggaaactagcaggtggggcaaccgacgacaccaccccaccactacgcagtgatgtccttgcgcgatgtggaccagccctctcatcactgcgacacgcagagagctgaagatagtgagccaccaaggcacaaaccaacatgaacgccgcacgcacacacaagacagcatacccctcacactagggcagatacacactcggacgacgaacgcaagcagacccaagacgacaagaagagagacacgacaaggcctaccgagccccagcacacacaactgaccagatgcggcccacaaacacaatatggagcacaccagaccagaacaatcgcggatagaccaccccactgaaggcacaagatgccccagacaagacagaataagagaaaatgggaaacataaagaacacacataaaccacggcacagctcgcacacacaaccgaccacacaacacgaagcaaaacaggagacaaagcgagcatgaagaagacaacaccgaactgccgctcggcacaaccccaacggcgacgaccggcgagcagaccataacaatacaaatcagatccacaacaacataatgacaaaatagcaatgcagcaaaagaccagcagaatcacagtccactagcaacgcacagctaacccccagcataccgaagcagaccatatcaacaccggcagacgaacatcgtcccgatagtgcatctcaccaataacactcgcaatcccggtgccgtaaagcgaacaatatcgagatcataaccattctcacatcgacacacgacaacgctggatcgcacacgagcccaacggcgttaacctagaaccatgagcaggaatgggcgtacaaaacacatatacgtaagcgacaatcacgatctgctacggcgacaacacagacgcaggagcacaccggaactgacaccatgacaccaacacaacactcagagcgcgcacacgaaggcctcacatgcatcaagcatgacagacaccttccaactcacggcgacggtacaagtcacaagcacaacacaagtggacaaaccgacaacacaaacgagaaccagtgacccactgtggaccacacagcgcaacacacgcaagcagcaacatgaccacacccatggaaccaccacacacccacgacgagcctctcaataagacgaagtacaacatacatcagcacaccacccacgagaaatagcaggacagaggccccacagaccagcgtggacgacgaagtagataaataagtgaccagaaaaatgataataacaacaggactacagacgaccgtaaagtaaacgatacggaacacaacattatacagaaacagtataacgaacatatacgaacacaaccaacgataccacaacaacgaagcagattaccacagcgtaacaggatagatgtagacatccgcaactccactaactgaacacgaactggcacaaggcagtgacatacggacgagcaaacagaacacacaacgagaacagatgaactcccaacagcaccacgcaatggacgatctcagcgctcacgcacgaagagggaactgctacaactcacgcatcacgtgagcgctcacaacgtaactgactatgacacaagaacagaaggatcaacagcagtaaacgcacagcgaactacgcagaccgcgcacacacgggcaccacaagagacacagagta

SEQ ID NO: 558804 - DNA, 117 bp, Homo sapiens
ggtccagtatcaggtgagagatgaggatggctaatgcataaaggggtagtgagatagagaaagtgaacagatcctcggggatggattggggcttggaagtaacactcagaagtcaac

SEQ ID NO: 558805 - DNA, 110 bp, Homo sapiens
tcgagctcggctcccgactttatcgatcgcggagaagggtactcaagggaaaattgtggatttggtcatgagcttgacagagacacagtatttgctctggtgaattacat

SEQ ID NO: 558806 - DNA, 321 bp, Homo sapiens
tgaagtgtggtaggctggttcatatgtggaggtgggtgtgtgaagctagacaccaaggtccttaaggttctgaagagacttgaactgtggaaatgctcttagcatgcattccctaacccctgcttctgtgctgttttgaggagtaggatcttggagttcacaccaactatgactatcatttcctttactatctttaaaaacgcttttcttctttggaagagaatacgcgtttatttcaagtcttcctgacagtaacttggtagttcaaggttagctaatgtgcttttatggacatatattaagtggcccctcttatatgat

SEQ ID NO: 558807 - DNA, 673 bp, Homo sapiens
gtcggacttctacatccgactccagacaggagaggggcacgtacctggcgctactgagcttcctgcaaggactgcctccgtgatagtccccagagagcttgttcctgatagctaatgcaccctgctagacctagcagatccagccctcccctggaccctaggtcacggcaatcaatccccctgctgtggttcccgaaccccaatggccccgatgggtccctgctgggggctcgcggcgatctgccagtggcgctttattcggcgtctaccttgctctacttgcctgaatcccccggtaccggggccgcgttctacgtggggttcactgtcaacactgctctgtcgtggtccatcagcacaatggggtgccgcaaaaaattgcggtgcctggcggaccagcgggcgagggccctggtgagagggggaggccttctgtgcctgggaggaaggcgtcccacgagtgatggcggaccccgctgggggcacatgccttgttgataaggacctggcaggactgtgacagaggctggggcgatctgtgtgtggggactgttggcctgtcgcacggggaggcgcggtgacggggaggcggtgcccggggcatctccgctggcggaactcacgggcaaggaggctatctggggcgtgggtgcatgctccaggctgggttcca

SEQ ID NO: 558808 - DNA, 263 bp, Homo sapiens
  misc_feature (233)..(233): n is a, c, g, or t
tgcgggtctcttgctgagacatggggaagtgcaggaacgactctggcctctcagtcccacagaagggagtggtctcacactttacaagcggtgagggacacatcagagccctgggcactgtcactgcttgcaggcctgagtgtaactccctccttttctatctgagctcttcctcctccacatcacggcagtgaccacagctccagtgatcacagctccaaggagaaccaggncagtattgatgcccacgatggggatggtgg

SEQ ID NO: 558809 - DNA, 916 bp, Homo sapiens
  misc_feature (23)..(23): n is a, c, g, or t
  misc_feature (178)..(178): n is a, c, g, or t
  misc_feature (188)..(188): n is a, c, g, or t
  misc_feature (199)..(199): n is a, c, g, or t
  misc_feature (204)..(204): n is a, c, g, or t
  misc_feature (223)..(223): n is a, c, g, or t
  misc_feature (236)..(236): n is a, c, g, or t
  misc_feature (246)..(246): n is a, c, g, or t
  misc_feature (321)..(321): n is a, c, g, or t
  misc_feature (329)..(329): n is a, c, g, or t
  misc_feature (436)..(436): n is a, c, g, or t
  misc_feature (439)..(439): n is a, c, g, or t
  misc_feature (467)..(467): n is a, c, g, or t
  misc_feature (490)..(490): n is a, c, g, or t
tacgtcctcagcatatggttgtnagggagaaaattcttgatttggttatcagctgctttaaacgtcatggagcaaaggggatggacaccgcctatgtcatttgagctgaaggaaatctcctcgactgagtaagtacttgcgtagagtgcacgtctgggtctcatgtactgatctgaangatcaaggtngagagctgttntcccnccgctatgaccttactgtnccctttgctcgtnatctggccangaataaggtgaagaagatgaaacgttatcatgttggaaaggtgtggcggcgagagagcccaaccatagtccaagnccgccccngggagttctgcgcagtgtgattttgacattgctcgcgtcagtttgaccctatgatccccgatgcagagtgtttgtaagatcatgtgtgaaatgcgctaagtgggttngcnagttgggggacttgtctcattaaggttnatgccatggctttataacttttnttataagtctggatttggcctaatactgtttatgcaagtcccaaacttgggtgactccaacccttaagcctgcaactgtaggactttcctagtaaagctgttgtatttcctatatgtctgtactcttcctgtgaaatttccatcctttttgtgtgtcaggaaagtaggtactgccattgttttgagtggaagggcattgacaagcacttgggtcactgacattgagttctcaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggctggctcctgaggtggctgatcgaattggggatatgtcagtgtcatggtg

SEQ ID NO: 558810 - DNA, 804 bp, Homo sapiens
cgcggtggctcacgcctgtaatcccgcactttgggaggcagaggcgggcggatcacgaggtcaggagatcgagaccatcgtggctaacacagtgaaaccccgtctctactaaaaatacaaaaaattagccgggcgtggtggcgggcgcctgtagtcccagatactcgggaggctgaggcaggagaatggcatgaacccgggaggcggagcttgcagtgagccgagattgtgccactgcactccagcctgggtgacagagtgagactgtctcaaaaaaaaaaaaaaaaaaattcagaaaaccctaaactagcaattttttttaaaattataaaacaccttgttggagataaaggcttatgccagggattttcaagggagggagggtgtacctttagacattttttccattaaaatttatccatccggagagattttaaaaaaccctatgcccttaattagacttaaattccaccacgccacttgtgacctaaaaggagaattcctggtaaattagattccctgattaaacagatttctagaaagaggcctatatatttagggcgggacacattaaagtcctcccctttaaaatttgggaaagactatgatccctaattatgaagtcttctagttaattgtggagaaattagccgtcaacctgtgcggaagtccctttcattaccgaaatggggaacggctcaagagttcccagaaaggctctttaaagggtaaccctatgtttaatacgacgaatttcttaaccaggaccgtgccaaaatgtgccgttttgagcgcatggtccta

SEQ ID NO: 558811 - DNA, 355 bp, Homo sapiens
ttatccgtacagctgtactgccaagccaaaggtctgtggatagcaactggatcgtgtgtagcacgtaggagaagaagctccgccctgccctgacactggccttggggcctcctgaaatcacttccccatccctggtcagtccaccttgccccgtccacttccccatctcctcggtataactcatgtacactaagttatggaagaaccgggacattttacagaaaaaaaaccaaaaagcaacaaaaaatatacgtggggaaaaacaaaggatacaccatgcttaatctagggattataagcactccctgtcaataagttgcatatattgccaaatggaggggcaccgacctaggga

SEQ ID NO: 558812 - DNA, 2939 bp, Homo sapiens
gaatgctggggcgtttcgaagcagaagcactagagtttatagaaacggaggaagatgtcaccagcctaagagaagctaaagaagtcttgaaaggagaaaagccaggtaaagaggataggtacaggagtatattgaagacgaagttctggcaaatgtggaaaacctggcctggagacctcaaagtggtccatattatggctcagagatacaagatgctgatcccgttcagcaaccccagggtgcttcccgggccctgcccacacacggtggtgctgcatggtcctgcgggccttgggaaaaccacgctggccaagaaattaatgctggactgggcagaggacaacctcagccagaaatttagataggctttctacctcacctgcaaggagctcatctgcctgggcccgtgcagttttgcagagctggtcttcaggaactggcctgaattgcaggatgacattccaaacatcctagcccaagcacagaaaatcctgttcgtggtcgacggctttgatgagctgggagccccacctggggcactgatctaggacatctgtggggaatgggagaagcagaagccggtgccggtcttcttggggaggttactgaagaggaagattttacccagggccgccgtgctggtcaccacgtggcctgcgggccctgagagacctccggctgttggtggagcggccgatctatgtaagggtggaggagttcctggagaaggacaggagggcatatttcctgagacactttggagacgaggaccaagccatgtgtgcctttgagctgatgagaagaaacgcggccctgttccagcctgtctcggcacccatggtgtgctggatcatgtgcatgagtctgaagctgcagaggttagaaggggaaggacccgccccacccgcacggggctgttcctgcgcttcctttgcggccggttcccgcagggcgcacagctctggggcgtgctgcgggcgctgagcctcctggcggcacagggcctgtgggcgcagatgtcagtgttccgtggagaggacttggcgaggctcggggtgcaggagttcaacatccgcccgtccctggacagagacatcctccgccaggacatagtctctaaaggctgctattcctacatccacctcagcttccagcagtttttcactgtgctgttccacgccctggagaaggaggaggaggaggaggaggaggacaaggacggccacgcctgggacaatggagacgtgcagaagctgttttctagagaagaaagactcaagaaccccgacctgatccaagcaagacacttcttattcggcttcgccaacgagaagaaagccaaggagttggagaccactttgggctgcctgatgtcaccaatatccctgcacttaaatgcagtagacattatgctgttttcaatctgcctcaagcattgtcgaaacttgcagaaaatgccactgcaggcagcaaaggcaaagctcccagagaatgtcactgtgtctgaatcagatgctgaagttgagagatcccaggatgatcaacacatgcttcctttctggaccgacctttgttccatatttggctcaaataaggatctgatcattctagaaatcaataatagctttcttggtgccacattagtaaggatcctgtgtgaacaaatagcttctgacacctgtcgtctccagagagtgatgttcaaaaacatttcaccagctgatgcttatcggaacctctgcctagctctttgaggtcacaagactgtaagatatctgacccttcaaggcaatgaccagaatgatatgcttcctgcattgtgtaaggtcttgagacactcaaaatgtaacctgcaatatctcgggttggtgtctttttccaccaccacttagcaatgggctgatctctccttggcccttgaagtcaaccagtccctgacatgtgtaaacctctctcacaatgagctcttggatgagggtgccaagttgctgtacacaactttgagacacccaaaatgcttcctgccgaggttgttgttggaaaactgtcactttatagaaggcaattgcaagaactttgctgctgttttggttgtcagcggggagctgacacacctgtgcttggccaagaaccccccactcggggatacatgggtgatgtttctgtgtaagggtttgagttacccccattgtaaactacagaccctggtgctgtgggactgcgacataactagcaatggctgctgttatctcgcagagcttctccaagaaaaatcaagcctaatgtgcttggatctgggactgaatcacataggagttactggagtgaagctcctatgtgaggctttgaagaaaccactgtgtaacttgagatgtctgtggttgtgggggtgttccatccctctgttcagttgtgaggacctctgctctgtgctcagctgcaaccacagcctcgtcgttctggacctgagccagaatcccttggggtctagtggagtaaagatgctgtttgaaaccttgacacatccaaattgcaccctccagacactcaggttgaaaatagatgactttaatgttgaactcgataagctgctggaagaaatagaagaaaacaacccacaactgcctgctgataactgagaaacatgatcctttgggggggaaaaaaggctttcttttcattacttcattatctgaatccccccagagtcattcattctcaatgaagtcatggattttccaggtgttggtgaacagcctgtgactcttcccctcccctatccccacttctcagggataatgagttgattgctgggctaggtgttttagccatggttctgcctctgttttacatagaatgtgcgcatgtccttaaccttgttatgtatgaaatatacgtatcacgggtatattgagagaaataaaggtgagagcattcac

SEQ ID NO: 558813 - DNA, 622 bp, Homo sapiens
  misc_feature (141)..(141): n is a, c, g, or t
ccagaaatgcattccagctcaaggaggacttaatttatggacccgtgtgtgccacggctgagctgggcaaggatctttctcaggacaaactctgccatgcagctaaagagcctggtataactagaaggcagttgtcattgntagataaactagtcttccaacccctgtaggacatcgatgaaccacaggcagcaggtttcagaaggctcaaattaaaaagggggccaaggagaagtaagcctctaaagccttaacagggcttacagttctgacagaacgctgggggttttttcccaaagggttttcctttggggtcttcatcacttagttattgtagactatcgggcacaggggccaaaaattttttggggaaaaacccttttccccccccccagggtgggaaagggccccccctttcccaaagggttggaaaggggcccccctttttcccaaaagggttttttaaagccattttcccaataacgttgttagaactgcaacgtaagtaacgtattcttaacttttccaaacaaaaaggggggccccttttggggattttggggaacaaaaggggaacttttacaaattgggagaatgggtgtaaaagccttagtgcagtgcg

SEQ ID NO: 558814 - DNA, 941 bp, Homo sapiens
tacagggtcagatctcacggaggtgtagtttagatttcagctcttgcttatggctatcttcagggctccaaccccttagtgcttaggggctcaaaggttgggggtaattaagcccttctgagcagtggggagtctgctggttgtttatggagctgccctctgctgttctgagcccaaggtaggagtttcagatagtaagtatgctgtcctgcatggttgagttgctttggatgtctgctaggcttccagtaccctgtcccctcctcatgctggagagtcacaatggcctgtgcttattcacagcaataatatatagggagcgtctgtgagtcccctttgtcctgctccatcactcttcatggatctcccaggagactgctgagtgggtcagttacgtggaaatctatttatgaagctctgggctgtgcaaagtcttgtcgtaggaggcaggtgagcagcccagccctgaagtatgaggaaggccatgggagtgccttccaccctgaagccacccttacctggaggagctgtaggccccagctttgtagcagggcctatgaagtggttaggactgtcttccaactggacagctcttgagaaaggtacatgaccagtttgtaagcccgttgctgctatgtctcgttagtctgtctctcccttttcattactgtgcacataaatataccggtgttgtgttctgggaaaaaaaaaaaaaaaaaaaagggggggggttaaattactcgagggccaagtttggtgtcccgtttttgaaagggccctaagggggtaaaagaggcagggggttaagttggtggaacgggctgggttggagaccctctgtgggcattggaaccccagataaggccggaaaatagttgtggacgcttgggatgttgttattatcgtacaaaaaaggagtaaaaagagcagattgagacatc

SEQ ID NO: 558815 - DNA, 339 bp, Homo sapiens
  misc_feature (139)..(139): n is a, c, g, or t
gaatgtgactgcctggctgatcttccaaggtccccttgcatctatgtgtggccttatgaatcaatccttgccaatggaaagtgaatggaagtgatgtgtgtcggtcccaggactgaccatagacctcctgcatgtgctnctttatgctatttcttcagttcagggtgggaatgggaatgcccagagcaactttggaagctatatgctgaggatgctagaactgccatcagcctgggaccctgaacaactgtatgaaaccaggtacctgtgggtgggaaaaaaactggctggaactattagatgaaagaaaaataaacatgtttttggtcattgcaaaaa

SEQ ID NO: 558816 - DNA, 106 bp, Homo sapiens
ttttcaaatcctcaacttgagacaggtttattagttaacttagtgatgtgtcacagtatcctttcgaggccgatccccactccaaccgtccctcagcaacccaggg

SEQ ID NO: 558817 - DNA, 349 bp, Homo sapiens
tgtgcagccgtggcgtaacgtccaagtggaaggtggtggcggggattatggtgctgacagggttggctacgtccagctggggtatgggacgtatgctgtattcgttgggggaatacggattgtcggagatgcagttaatgccttagaggtatatcaccgaagctgcgctgcgcattacaaatgcgtcctttctacctgtcaaattcgaggaatggcaagaacgcattggtgtgttggaaatgttaaaggacgccagcaccatcgccgcagaagtgtggagccagatatgaatgaaacacccgaggtctttagacccggggcttataatgtgagcccacttgcgacgcgc

SEQ ID NO: 558818 - DNA, 162 bp, Homo sapiens
cattactgtatttactcttaaggcaagatctaattcaggtctttttttttagacagtctcactctagcacccagcctggaatgagatcaggcggaggttgcagtgagctgagatcacaccactgcactccagcgtggttgacagagtgagactccatctcag

SEQ ID NO: 558819 - DNA, 404 bp, Homo sapiens
  misc_feature (5)..(5): n is a, c, g, or t
  misc_feature (15)..(15): n is a, c, g, or t
  misc_feature (238)..(238): n is a, c, g, or t
aaaanaaaaaaaaanaaaagaaacactactctggactgagcagcatcggcaagtcaagtctgctgctggaattttaaaagaaaaggaaaaagaaagaaaaagaaacactactctggactgagcagcatcggcaagtcaagtctgctgctggaattttaaaagaaaaggaaaaagaaagaaaaagaaacactactctggactgagcagcatcggcaagtcaagtctgctgctggaattntaaaagaaaaggaaaaagaaagaaaaagaaacactactctggactgagcagcatcggcaagtcaagtctgctgctggaattttaaaagaaaaggaaaaagaaagaaaaagaaacactactctggactgagcagcatcggcaagtcaagtctgctgctggaatttta

SEQ ID NO: 558820 - DNA, 488 bp, Homo sapiens
tcttcaatcagccactatcagccctcgtagtaacagcaatactcataccaaaacccctgtaagctatcacgcggcgcagatcattctcactacatcgcccacggcacttacatcctacattactcattctgcctcagcaaactccaacactacgcaacgcactccacagtcgccatccatcactcctactctccaaggacttcaaaactctcactccccactacatcagcttttgagatgcacttctcagcaagcctcgctcacacctagccttcacccccactcattcaacctcactgggcagcacactctctgtgctagtaaccacgttctcctgatctaatcacactctcctacttacaggactcaacatcctagtcacagccctatactccctctacatatttcccacaacacaatggggctcactcacccaccaaatttaacaacataaaagcctcatacacaagagaaaacaccctcatgtg

SEQ ID NO: 558821 - DNA, 398 bp, Homo sapiens
  misc_feature (106)..(106): n is a, c, g, or t
cgcggcccgcatacggtgcgagaagacacagaaggggggagccggcaggggcggcttccattcctccagcaacccatcccaccgtctgggcttgtgaaaaacctgnccgggcgcatggcgcacactgtagtcccagcattggggaggccaggcagtcgtatcacttgaggccaggagttcagaccagccaacatagtgagaccccatcttgacaaaaaaatagaaaaattagccgggtgtggtggtgcgtgcctgtagtcagctactggggaggctgaggtgggaggattgcttgagcctaggaggccgtggctatagtgagccaagattgcgccacagcactcccacctgggtgacagggtgatcctctctctaaaaaataaaaacgtaaaaatgtt

SEQ ID NO: 558822 - DNA, 227 bp, Homo sapiens
gagccgccagcatggatggacatctacaaggctgccggtagagcagctgaacagaaggaggcagaaaaatgaggttcaagggcaggccttcgacatcttcgtgctgggcgctgagggatggctgcatcagcacccaaggagctgggcaaggtgataaggatgctgggccagaccccaccccttaggagcttcaggagatgatcgatgaggtggacgaggacggcacg

SEQ ID NO: 558823 - DNA, 311 bp, Homo sapiens
aaggatccctctgtggctccattcaggtgggcctcggtgaagcaggttggggtgctcctctgggagccacgcgaagctcgttgtaggggtgtggggccagatcttctccatgtcatcccagttggtgatgatgccgtgctcgatagggtacttcagggtcaggatacctctcttggtctgagcctcgtcgcccacgtaggagaagagttccgcgaaggacgaggaacctgcgggcggtcatggggctcagaggctccaggttgctctgtttgcaatgtccagggcgtacttccacaagcgggatgccgcgc

SEQ ID NO: 558824 - DNA, 133 bp, Homo sapiens
tcaagcttctaacgatgtacggggacatgagtttctagtcccacctacttgggaggctgaggtgggaggattgctttagcccaggaggtcgaggcttctgtgagctgtgattgtgccactgtctcaacgaaaa

SEQ ID NO: 558825 - DNA, 233 bp, Homo sapiens
gtcaggtagactaacgttgatctcttatacgtagactgtgcattctttcacacgcttgcattggcggcgaatgtatgtctttgtcggtgattgtccatccagctgacgatgcctctgtttaaaaacaaattgcttttgtgtccctgaagtatttaataagaagcattttgcactctagaaagtatgtttgtgtttggttttttaagaagtctaaatgaagttagtctacctgg

SEQ ID NO: 558826 - DNA, 265 bp, Homo sapiens
ttaactgaaattttttttccccttggacccttgccaggtgaaaaaaaaccacatgggagtaataatgggtccaaattttgccaaataaaggcctgttttggggtgggagttgtcatgaggctgtgttgaagtgacttatctatgtgggatattgagtatcccttgaaatggatttgttcccccctttccattaatgggcctttaaatgccccagatatcatttcaggtgacttaacatgaatgaataaaagtcaatgcttttgga

SEQ ID NO: 558827 - DNA, 399 bp, Homo sapiens
aataccctgtttctacaaaaaaaaattttttaattagccacacattgtggtgtgagcctgtagtcccagctacttagggggctgtgatgggaggatcacttaggccaaggaggtcgaagctgcagtgagctgtgatcaagccactgcactccaagcctgggggacagaacgagatcctatttcaaacaaaacaaaacacaacttattaggaatctaggcctagtaatctgaacttttagtctcctaacaagtgttgaaattgtaaactaaaacactatcaaccatttgggacaccaactcttttagactgactacattaggaagactacagagtcttacaaacaaagagccacgctgttttaccttttttttttttgagacaaagtctcaaaaaaaaaa

SEQ ID NO: 558828 - DNA, 82 bp, Homo sapiens
aaacccggccttttttttgggaaccccctgccccaaaatttttccccaaatttttggccccccttaaaaagtttttttggga

SEQ ID NO: 558829 - DNA, 239 bp, Homo sapiens
ccatgtggacaagcatcatcccatcagacacaaacaccgtccttcccgtggatcagacccgttgtcgtgtacgcgggggacaggaagcatgcgggagcttgtggaggtcgagccacgtgccatcccagacatcaagaggccccaatgggtttttaccatctgtacactcgccagtctgaagagggacagaccatagaaacctcccagcgccccttggcataacaaaggcgatgccccag

SEQ ID NO: 558830 - DNA, 211 bp, Homo sapiens
tgtcttaaaaaaaaaaaaaattagtcggtccggcaggattatggccaaaaataaacactggagtggtatcatactctaaagggtatgggtgacagcgggcaaattagagtattggtaagtgggccttataaataggagtaacagggacctcctgccccatttttggagttcctggtacattggagacaacaaatttggggaatgggctttc

SEQ ID NO: 558831 - DNA, 302 bp, Homo sapiens
gtctggagcaagggtgaaggaaaaaaaaaaaaggacaaatgtctgtctgtatttagccagttcttgttttttctttccacgcagctacaaggccaccagctatgcaaagccacaagttatgccaagtcatcagttatgctatagattatgtgacctgtcattatatgattaactgcctgttttgcttctgtaagcctgcttataaaaatcctgctcagtctttgttcaatgctcagctttttggatgtgaatccactgagctaatgcctaccttaaaataaacatcgtcctgtttttccaaa

SEQ ID NO: 558832 - DNA, 152 bp, Homo sapiens
  misc_feature (58)..(59): n is a, c, g, or t
gccaaggtgcaacttccttcggtcgtcccgaatccgggataatccgacaccagccganncaccaatgcgacgagttcgacccgaacgagataaagttgttatacctgaggtgcaccgagttaagtcggtgccattctgcatgtacccagtat

SEQ ID NO: 558833 - DNA, 327 bp, Homo sapiens
tcagtcggtccggtgtatccctttgtctcagagaacacaagttagtcggacgaggtagtgcacgcctgtaatcccacccacccgggtggctgaggcaggagaaccgcctgaacccaagaagcggaagttgcagtaagatgagattgtgccactgcactccagcctgggggacaaagtaaaactctgtctccaaaaaaaaaaaaaattacacacacacacacagacacacacacacacacacactttccgttatttgctaagtactcaatgaggtgggggagatgataatcaagaaatttccagaaggaaggagacaatctttgcaac

SEQ ID NO: 558834 - DNA, 154 bp, Homo sapiens
ccggtccgcatctgctccatcaggtctgcatgccagtgtgctcctctagttaaagtcagtcacctccccagtaagggccacactccaggaggagtgttagagagtcatttgagtgtagtcttgccacctgttttccctgatgggagaagatgcg

SEQ ID NO: 558835 - DNA, 318 bp, Homo sapiens
  misc_feature (6)..(6): n is a, c, g, or t
  misc_feature (122)..(122): n is a, c, g, or t
agcccncccgagtagccggggcttaaaaagcgcacacgccactcccaggctttttttttttggcagaaacggggtgtcagcatgttagccaggctggtctccaacgcgtgatctcaggtganccgcccgcctcggcctcccgaagttctgggattacaggcgtgagccactgcacccggcccttctatttttttaaatagcgacggggtttcaccatgttggccaggctgctcctgaacacctgagttcaggtgatccgcccgcctcggcctcccgaagttctgggattacaggagtgagccaccgcgcccgactgag

SEQ ID NO: 558836 - DNA, 378 bp, Homo sapiens
ggtcaacatggtgaaaccccgtctctgctaaaaatacaaaaaaattagctgggcatggtggcaggtgcctgtaacagctattttttaggttgaggcaggaggatcgcttgaacctgggaggtagaggttgcagtgagccgagattgcaccattgcactccagcctgggcaacaagagtgaaactctgtctcaaaaaatatatatatatatattgtataaaattactttcaagctatgtatatgaaacattaatggtatatgaaacataaaggtataagaaacattaatgaattttgtgtttagacttgggtcccatccagaatatctcattatgtgtatgcaaatattccaaaatctaaaaaaaaaatcccaaatcca

SEQ ID NO: 558837 - DNA, 117 bp, Homo sapiens
gtggtagatgtatcatctgcaggtgcggtctcgatctcactcattgcatacgtgcttcacggctgcgcacaggtgaactctgactctccagctgttcttgagctaggcatctctcgc

SEQ ID NO: 558838 - DNA, 1124 bp, Homo sapiens
ttgctagaccattgcgttcggcgcgcggggccggttaggtgagatgaagcatggctcataggtctgtgtcctgaggtagcatctctggatcatgagctacgtgcttcggattctcacgcgaataataaagactgcgccggtgggacaatgcagacgcgttcgtgagacaacatcacagaatggtagttcgtgagggttcaattaacatgggatcgtaatcacagcagtgagttccataagacggagtgtcgtaatattgaatgaattaagtgcagccgaccacggaaattctttaaaaggagaaagagaataaggaaataaagaagagagggatgagatgagaaaagggaaatgaaggatttggaaaagatagattggaaaggaaagaaggaaaaagtggaaattctaacagaaaaggagcgaggtcgcagagtaataaaaagataaagcgaagtagagatcaaaacgtatatgcagaacgatagctcaatggattacaaggaacaagaacgagggatatataccccaatatgagagggggacatataaggaagagcataaaaggagcgtaaacacaggaatggggatagttataaacggggattaggaacggatgatggagatgagcaaggagcgccaccaagaatggaacacttaattataaagatagagacaaccaggacaaacattattaacgataatgcggcatggatgacgacacgacgaaaagaaacatagacaaaggaaaaggttccaagcggaaaacgacagtggaaacaggaaacgagcaagagcagagcgaacagactgaagacagccgtccatgaacagaataatgtcaaatcagatgggaaacaaaagacagggaaaacatggcgccacaacatgagacaacaggtggagtacaggacaaagaggaaaccaacaacaaagagaaaaacaaaacgagaaaaaacaagattaggaacagggatagaaaatgcaacagcaatggaaactggacacacgaactcgaacagaaaagtcgcacgagaaagaggcacaggaaaggaaataagaaaggaacaagtaaaggacaaacgaacaagcaagaagaagaacgaaaagaaaaagaacaaggaaga

SEQ ID NO: 558839 - DNA, 103 bp, Homo sapiens
  misc_feature (103)..(103): n is a, c, g, or t
gggttacacgcgggttcaacatgcggtatcggaaaaggttgttatttcctgtttcggggcccattctataccttggacacggccatgatggttccgtctcccn

SEQ ID NO: 558840 - DNA, 772 bp, Homo sapiens
  misc_feature (644)..(644): n is a, c, g, or t
ggcattgccaaagcatggcatcaggcatattttggggaagggtctggcccagttatgttggatgaagtacgctgcactgggaatgagctttcaattgagccgtgtccaaagagctcctggggagagcataactgtggccataaagaaaatgctggagtgtcctgtacccctctaacagatggggtcatcagacttgcaggtgggaaaggcagccatgagggtcgctttggaggtatattacagaggccagtggggaactgtctgtgatgatggctggactgaactgaatacatacgtggtttgttgacagttgggatttaaatatggtaaacaagcatctgcctaccattttgaagaaagcacacggcccatatggatggatgacgtcagctgctcaggaaaggaaaccatatttcttcagtgttacaggctacagtggtgaaggcatgactcgcaccaccgacaatatgttagcattgcctgctaccctggcggcaagggacacaagctctctctgggtgaggactggctgcagctctcaagtttccataattcaatgtccattgcccctctaacactgaccttgaatatgaaggggttctaatctttgagtatattcgggggctatcccccataactcgctnatttttcaggagctcttatagcaataaaaataatcttttgaacctgtgcgccaacattttgaaaattcaccccctaactgtttttcttacataagaaaataagctacccactacaaggttgaccatat

SEQ ID NO: 558841 - DNA, 214 bp, Homo sapiens
cgcagcgcaggcggccgcggcggaggcgtgtggcgccggagagcagcagccagcagtgcgggctcgtggcgcgccgcacacgccgagaccccgggccagcccggagctggcccgccacccccggcactggcgggggacaatgggccaggtcccgcccggttcgggccagagccagaagacacatcgagtgcgtggtgtgctgtgggacacagtc

SEQ ID NO: 558842 - DNA, 462 bp, Homo sapiens
  misc_feature (2)..(2): n is a, c, g, or t
  misc_feature (7)..(7): n is a, c, g, or t
  misc_feature (303)..(303): n is a, c, g, or t
  misc_feature (336)..(336): n is a, c, g, or t
gnagacnaggctgagcacggagaatgtcccagaatcaacttcggccctttgatggctggtggccccactggttctggtggccccctggcctgcttagaagctacagcgtacatggccacgatctgcgcacaggcctggctattaagcccttccaacttggtcctcttccaaggtggtggcaattcaaaaaataattactggaatggcaagtgggcctgtgctcccgaaagttaaccctgagagaaagcacagaaaccatgattaaagaggggatggagtctgggtgctaaagcaatcccaaanccaaaaactgtaaaagcaaccccttcagatgtncagactaccctctcatgtccagagaggaagagggctttctccaaggtccccaagggagtctgtaaccagccaggggctagaagccctatttctgcccccagcttcacctcatggaatccagcctac

SEQ ID NO: 558843 - DNA, 245 bp, Homo sapiens
gatgtggtgactgggacgacagtgatactgactgactcctgaccctgtgttggtctaggctactgtatgtgttagactcttagtttgtcacacaaagttcaacaatgtctattcaaaatacgcttatagactaaggatataacgaaaatatttatgtagagctgtacactgcattcgtgtttacagctaccgtgttacttaccacacgacgtaacgacgttaacacaaacatacacaacaactac

SEQ ID NO: 558844 - DNA, 571 bp, Homo sapiens
  misc_feature (48)..(51): n is a, c, g, or t
  misc_feature (59)..(60): n is a, c, g, or t
  misc_feature (64)..(66): n is a, c, g, or t
  misc_feature (101)..(101): n is a, c, g, or t
  misc_feature (118)..(118): n is a, c, g, or t
  misc_feature (121)..(121): n is a, c, g, or t
  misc_feature (177)..(177): n is a, c, g, or t
  misc_feature (179)..(179): n is a, c, g, or t
  misc_feature (181)..(181): n is a, c, g, or t
  misc_feature (206)..(206): n is a, c, g, or t
  misc_feature (235)..(235): n is a, c, g, or t
  misc_feature (242)..(242): n is a, c, g, or t
  misc_feature (249)..(249): n is a, c, g, or t
  misc_feature (255)..(255): n is a, c, g, or t
  misc_feature (295)..(295): n is a, c, g, or t
  misc_feature (299)..(299): n is a, c, g, or t
  misc_feature (307)..(307): n is a, c, g, or t
  misc_feature (337)..(337): n is a, c, g, or t
  misc_feature (347)..(347): n is a, c, g, or t
  misc_feature (349)..(349): n is a, c, g, or t
  misc_feature (352)..(352): n is a, c, g, or t
  misc_feature (361)..(361): n is a, c, g, or t
  misc_feature (436)..(436): n is a, c, g, or t
  misc_feature (568)..(568): n is a, c, g, or t
tgacagtcactggagctaccagaagcatcatggggccctggggagaannnnagctcctnntgtnnngccccgaggcggtacttcagagcctccattgcctntggggctggaggtgaanttnggggccctggtgctgctgctggtgctcaccctcctctgcagcctggtgcccatctntntnctgcgccggccaggagctaaccatnaaggctcagcttcccgccagaaagccctnagcctantaagctntttcgnggggggcgtctttttggccacttttctcctggacctgctncctnactacctngctgccatagatgaggccctggcagccttncacgtgacgntncanttcccactncaagagttcatcctggccatgggcttcttcctggtcctggtgatggagcagatcacactggcttacaaggagcantcagggccgtcacctctggaggaaacaagggctctgctgggaacagtgaatggtgggccgcagcattggcatgatgggccaggggtcccacaggcgagtggagccccagcaaccccctcaggccttggcgtncct

SEQ ID NO: 558845 - DNA, 427 bp, Homo sapiens
  misc_feature (21)..(21): n is a, c, g, or t
  misc_feature (30)..(30): n is a, c, g, or t
  misc_feature (48)..(48): n is a, c, g, or t
  misc_feature (61)..(61): n is a, c, g, or t
  misc_feature (90)..(90): n is a, c, g, or t
  misc_feature (143)..(143): n is a, c, g, or t
  misc_feature (147)..(147): n is a, c, g, or t
ctgtaaatgtttccctaaccntcctttacnttgttccctattataacnattttccccctcnagagcacccagaattgccagaattccacngaacaaaattaataagaaataaagatttccttatactggatatgaccttttancccnggattcctcctaaaaacccaacttatactctgcctcctatatccttaatatgtaaaattaagaaatatccaggctgggcatgcctggctcatgccctataattccagcattttcgaaggccgaggtgggaggatcatttgagctccgaagttcaagaccagactgggcaacatagggagactgtctctacaaataaaggaaagacagagagagagatcgagagagagagaaatcaagagagagacagatctaacaattagcaataaagagaatacctatt

SEQ ID NO: 558846 - DNA, 330 bp, Homo sapiens
attcgcgggcgcgtcgacctttgggaggctgaagcaggtggatcacttgaggttaggagttcaagaccaaactggccaacgcggtgaaaccccatctctactaaagtgctgggactacaggcgtgcaccaccgtgcctggctccaatttttcatagttcttgcttttgttaactgttttatcaactgattagaacttctagaacaatgttagataacaaaggaaatggcaggcttgtggacattcttactttgtttctgacttaataggactgtgtctaggagcttacagttaaatatcagtcgacgcggccgcgaatttagtagtagta

SEQ ID NO: 558847 - DNA, 654 bp, Homo sapiens
ctttgtgttatgtgaagaaaatgtgtatccccaatgggggtgtacgcttttaaatcaaaatcctgatcacagatgtccaattaggcttaatcagaaagcctctccagagaagtttggtttctttgctgcaagaggaatgaggctctgtacccttatctaagaacttggaagccgtcagccaagtcgccacatttctctgcaaaatgtcatagcttatataaatgcacagtattcaattgtaaggcaggccttcggttgtaagtagccagatccctctccagtgacattggaacatgctactttttaattggccctgcacagtttgcttatttataaattcattaaaaaccctacaggtgttgaatggttaaaatgtaggcccccagttcattttcagttattttttgagtgggcagacagctatttcgccctgtattaaatgtaacttatttaatgaaatcagaaccagtagacagatgttggtgcaatacaaatattgtgaggcattttttttaataaaatgctaaatgtcaatttatcccggggcatgtttgactttagactgtaaaaaaagatcagtttgtttctttttgggctggtaccaatgagcgtcgcccaaacatggtttcaggtaaataaattttttttatgata

SEQ ID NO: 558848 - DNA, 127 bp, Homo sapiens
  misc_feature (22)..(22): n is a, c, g, or t
gggcagccgtctgcaagccaanaagaggggcctcagaggaaaccaatgctcctggcaccttgatcttggacttcgagactccagaactctgaaaaaatacattgctgttgtttaagcgccccagttc

SEQ ID NO: 558849 - DNA, 207 bp, Homo sapiens
ctctacttctgtgttctaatactataatctttctttcttgttctttctagtaatcacctcgttcagcctccatagactatatgcttctgtagttgttgcttattagtagtatttctctatagttccttcagctagattatatgaaaatatcaatctcctagtagttttagatctaagtttcttatctccactatcatccagtattgt

SEQ ID NO: 558850 - DNA, 1184 bp, Homo sapiens
  misc_feature (382)..(382): n is a, c, g, or t
  misc_feature (832)..(832): n is a, c, g, or t
ttggcgcgtgcgcgaggccgtacataccttgcctgctgtgtaatgttaattgttcgtcggcttcttattaagtcgcctcttgtttcgccggtattttactccgcctcatttgtcttttggctccgcatcttgtcacaacgctggttgcccgctatcccagtttcgacaccccccgcggggattttttttccccagtatgcgccgccctgttccgcttgtgccgttgctcgcaccgcccccgcaatcttaagtggtacaccaaaggcccccatttcccacatgaggacttacataagggttaagttttggagagtttagtggatccacgggataaccatgtggcccggaagccgaagtgcccccttctcccccccctggaagnggccgacaagaacacccaggagtgcacaggtgtgactcccgtgcgtggactgtttcctgggtaccaccaggtcccttttgtctctcatgggcctagcataggtatgagccagggatcctttcctggtccctaaggtccttaccccctggagccgcccgcgtttgatgcccccccccccctgtactctggagagactttgctgggacactggtacccctgagcctgagatgggcgattaggcccgagagaaggggaggccccctcttgcccctccgttgttcctaactcacgaactgttgcacctctataaacctatgggaggttgttaagaaatgaggacccctctataggttttaaccccgcagatcctcgaacacccacccacttctatatatagggtgcccacacacttgtggttatattgtatggcacacctcttcctttcttctncctctggttgtaagaagacacgttcccccacgccccgcagatagatagtttataactaccacgctgtgttgtccgtcttggccacccggcagttccccactccccctatgtctctattcccgggcgagaaggagcttatactttgggaacccttttttactagatattcctggccccctgggcttgtgacaccctcctatgccaccactcacgctatcacgtatcacgtgaggtgagcccccgcctcctgcctatcccccacgagtgcccctcccccaccctggaccctgcttactgtgtgtacatatatattctacatatatgtatatttacactgccctgccctgtccca

SEQ ID NO: 558851 - DNA, 92 bp, Homo sapiens
ggaagacagaagtacgggaaggcgaagaaaagaatagagaagatagggaaaagaagataaaaacatacagaagaaaaaagataaaaaacctc

SEQ ID NO: 558852 - DNA, 1180 bp, Homo sapiens
gtgtcgtgaaaactacccctaaaagccaaaatgggaactggacaagaactccatatccacaccattgtcagtcgatcggcaccacgtcagcattccggagcaagtcccaccgactcactggcccatctgcatctcatcaacatgcggtggcatcgaccacaacagcacacccattgcaacaaatcttgcagcaaggcaggctgctgcagcatgggcacacagggctccattcaacgtcatgcctagggtccttggatcaacactgacaagctagagcgtgcaacgatggtaatcacccatttgcatcatctccttgctggcacaattctgcagacccagccaacgtactcatgtgactatcatatgctgccaccaggacacagaagactttatcacaaaacatgcattacaggagacatctcacggctgcactgtgctgtcctgactagtagcatgctggtgttggtgacatctgaacgctgcgtctctccaacgcatggtgcagacccgacgagcatgcccttctggcttcacacactgggtgtgaaacaactcaatgtcggacgtcaacacacaatggcattccacctgagccaccctacagccagcaacagcatatgcaggcaaatagctccagggcacagtccgcaccccacctcacgaacacattggcctcacaacccggcacacagcacgccccgcgccaaataccaggatagggaacgcgtgcacaacaactgcctgcgacagccaacgtgctaaacatgccctgcgcccacgcggcctggcaagtcacccgacaggatgccacatgcccagcgaccccacgcagcatcaaggcactggccggcaaccaacaccaacacgtccaaatgaaccacgcccacagtagcctgaccaccacacccgaacgtcaaaaaacaacagcgccacgtggagcaccgccccagcacgaccgacagaccagaatcagcgaccaacaacagcacagcacagcaacccacgccaaccaccgctcacacgcaaaccaaacagtgacacaccgaccaccacaacaaccccaccaaacgaacacaacggacacccacaaacagcatgcaacaaacaaccacacgatcgagacaaacccacccactcaccaaacacaacaaaacacacaagcccaaccgaaaccacaaac

SEQ ID NO: 558853 - DNA, 373 bp, Homo sapiens
  misc_feature (64)..(64): n is a, c, g, or t
  misc_feature (347)..(347): n is a, c, g, or t
tttgaagacctggtagcccaaggaaaaaatttacaatttaagccccaaatttgtagaaaatagnaaaaattgaaaaacattaggcaagatgagaatcctaacaataggtgtactataattttggaaacataagttttatctctccagtttcctatttttgctaaagacaaatcatggtagaattgtcttgctttattccacttggcctaattgtttgtatacagtgcagcaagagtaattattttttacataggcttttaaattggctttgctgggactttgtttcatagaaggaatcttgggtaacacttttttaaagctgagccaagccatggatgtgtgccatnaaactacctgtgagttgggtgattct

SEQ ID NO: 558854 - DNA, 136 bp, Homo sapiens
  misc_feature (65)..(65): n is a, c, g, or t
  misc_feature (73)..(73): n is a, c, g, or t
catgggtctgtaggaagaatcacgtttctacagactgcagcactgcggccagcaggtgggcaggncacacccnacagcagccgtggtgacggagaagccagtagatactggagaaggcagcaccttcaggatgtcc

SEQ ID NO: 558855 - DNA, 240 bp, Homo sapiens
attcgtccggtcaacatctagattcatgacactggtctttgtactggggtaagccactatcatcaaggccaccttgtcacccaaatgtggtctagacagtgcagacttctcctcctgtatggttgttgatggctttcactgtgtaatgacaatgcttcttctctgtggagttgggtgcttaattccatcgctcacttttccatgatcctgatggggtggcttgtcaattagaggtgtgga

SEQ ID NO: 558856 - DNA, 172 bp, Homo sapiens
cttagaggactcggtgtcatccccttcgtgttcataccccttcgtgtgtcatccccttcgtgtgtcatcccccttcgtgtcgggctctggagggtgggaaagccttcctgagcctgcggacagcgcatgcacctcagcctgccgcgtcaggaacaccaggatgccacctgtg

SEQ ID NO: 558857 - DNA, 310 bp, Homo sapiens
cacacaggcctgagcctggccagcctcggcttgccagaaggtgcctttgctagtgcccggagccgttggcccgggcggcttgccctattcctctcctcctcctcctcctgggtccccccagggtggcttgggcttgggctatgtgggtggtggtggcggggggtctttgggggcctctcagctacccgcccatgcctccctgatgggtgggccagggcggcctctctctgaggagaacctcaccccaactcctcgctccagttttgacccactggtaagtgccctgcactctgtattctattaataaact

SEQ ID NO: 558858 - DNA, 220 bp, Homo sapiens
cccaaagaagggtgcgagaagaaaagggccgttcttgccatcaaccgaagggttaaccccgaggattacaccattcaaccattcacaggcgcattccattggagttgggctttcaaggaaggcgtgccaccttgggccacttcaaaggagattccgggaaattttccattaagggagattgggaacctccagatgttccgcattgacaccaggctcaaca

SEQ ID NO: 558859 - DNA, 950 bp, Homo sapiens
atggcacatgcagcgcaggtaggtctacaagacgctacttcccctatcgatagagtgagcttatcagctttcatgatcacgccctcataatcattgccttatcgtgctccctagtcctgttctgtccctttggcctaagcactcacagacaagaatgtaatcatagtacgtagcatcgtcagatgctcaggaaatagaaccccatctggaaaatatcctgcccgaacatcattcctagtgcgctcatccgccctcccaatccactaagaaatcactttacagtgacagacgaggtcagacgagttccctcccttacctttcattattcaatttggccaccaatggtatatgaacctacgaggaccaccgaaatacggcgggataagtcttcaacttcctacatagttttcccccctttattcctagaaacctaggggaacgctgcagacttccaattgagtgtagcacaatcgaagtacgtactcccggtggaacgcccccattcgtataataatttacatccgcaagggagtctgtgcactcaatgagctgtccccacgttaggctgacacaacggatcgtatggcacgggacgtctatacccaaaacagttgaactgtacacggacgggggtatacatgaaggccagtgcgctgaaatcttggggttgcgaccacagtgcatgcccatcgtcctagaattaagttccctagaaatcttgaagtagggccggtatttaacctatagtgccctctaccctttaggatcaaagcgaagcacgtcacaaaaaattgcgtgggtcggccgaaaattcaaacattcgtgcgccggcccggagaacgactccggccagaacggcgatgtcggtccaacaggcgggcgcggtaacaggtcgggcggtaacagtaccacccggcgtctagccgggcgtggcgaaccgagctacaacc

SEQ ID NO: 558860 - DNA, 133 bp, Homo sapiens
ttttcaaaaattccccccccttttaaggggccctttaaaaccccacttttgggttccgggccaaaattttttttccccccgccccttttaaaaatttttttgaaaaaccccggggataaaattttgggttcca

SEQ ID NO: 558861 - DNA, 116 bp, Homo sapiens
  misc_feature (66)..(66): n is a, c, g, or t
  misc_feature (73)..(74): n is a, c, g, or t
taagcgtggagaggccccgttcgctcagcgtatcgacccgactcgggagaagctgacacccgcacnaactccnnagatctgcaagcgagaatctaacacagctcaagagcaacatg

SEQ ID NO: 558862 - DNA, 111 bp, Homo sapiens
gtgagaatccatctctacacaaaatttaaaaattacgcccagtatgtcccatgctactcaggaggctgagcgaagaggatcacatgatgcccacggatggtcgacggctgc

SEQ ID NO: 558863 - DNA, 690 bp, Homo sapiens
ttctagtaatgtggcaatcaagatttcctttcttaagacggccagtggcgcacggcattggtccggcttcgggcccttataggccaccctggcttccccagtgttggcccgggttgcaatctgctgtggactttggccctaggatagttctcctcacaatacatctagatccatatttgtctatgccatagttcatcttatccatcttagttaaaactaagggtacccagttgcgaggggttccttagactgggtctatcaatggggttctcgaaatgggcatggtctctcacttcaaacatttatccccaccccgtgtacatcatatcaaggtgtccagggtatccaaggtccttgtcatggcgctttctaagggcaagtgtaacagcgtgcgagtggaattgaggagatctcagagtggctccttcatttcaagtgtataaggctccgtgaaggtgggcttcgtgatcacccattttgatttataacgataataccgagcgtttagataaaattgatagttcgctgggtcttgaatgttgggagcgggccctggtttccatgggactgtcatgaatcagtgtgatcctgttttgggcccagcacgggtgtggggactgccccctgaaatcacacctttttgttacaatgagattgaggtttccctttgggttatgcgtttaagaccag

SEQ ID NO: 558864 - DNA, 494 bp, Homo sapiens
  misc_feature (294)..(294): n is a, c, g, or t
gtgggtgagtaggggttgggagtctgaactgaatctaaacaaataaatggatggagaattatgggagccaagtttttcactgttggtgtggaagtgtgcagatgaacaaggacataaggctataatccatctattcacacagaatgctccacctggtaatggattacagctgaagacattagtataaacaaatgtttagcttaatctggatatagaatgtttcataaaaatatttatagatatctatattttcatggtttttatatatattatatataaatatatatataattntcttgctctgtcaactaagaggatgtagaagaacaatgacattccagtagcaatgagcatatctagtaccagatcttgattttcaatatcctccagtgaaaggaagcagggttccctgaagaaatagctgattctaggacaaaggcaggaaatatacatgagtctgggtcttgtagttccagaaagtaaggaagtaaaaa

SEQ ID NO: 558865 - DNA, 253 bp, Homo sapiens
ccgaattacacctcatctgcataaccacggcacactatataagcacgactaaaacatgagttccctaataccccacatcctataccagcacatacgataaacactaacaaaaaaactcatacccccattatgtaaaatccattgtacgcatccaccttatataatcagtctcttccccacaacaatattcatgtgcctagaaccaagaagttattatctcgcaaactgacactagagaccacaacccaaaaca

SEQ ID NO: 558866 - DNA, 479 bp, Homo sapiens
acatggtggttatcacgtgaaggttaatgccgtgtggcctcaatgtcggggtaaagacttcgttataatcttacttcaatcgacaaggtccacattctttgggcgaagaggtagacagctgtgctcctataatagagcgcacatacttggcaaagatgctgtaatggtattcttggatgtgccaagtacctagtcctagggctcctatagggctgacatgttagtcgcacatatgtacgcatgtgcccgtgtacaaagtacaatgctgtagcgtagcaccagagtgggttcttccgtggtgttcagtgcaataggtgtcacacggggagtgcggtgtggcctcacatatgtcctcagagctcttcgggtgcgcaagcaacgcgtgtcaccgtaaaggggttgagtattgagagatactgcaagtagcgacacatttaatgcatatgacggggtatatgattgtgtcgttgagcggaagt

SEQ ID NO: 558867 - DNA, 510 bp, Homo sapiens
cagtagaggatccctgcagctctctctgatgtatctccatcgacgcactcatcgtcatcaactgggacgacatggagaaaatctggcaccacaccttctacaatgagctgcgtgtggctcccgagtagcaccccgtgctgctgaccgaggcccccctgaaccccaaggccaaccgcgagaagatgacccagatcatgtttgagaccttcaacaccccagccatgtacgttgctatccaggctgtgttatccctgtacgcctctggccgtaccactggcatcgtgatggactccggtgacgggtcacccaaattgtgcccatctacgaggggtatgccctcccccatgccatcctgcgtctggaccctggttggccgggaccttgaattgaccacctcatgaagatccttcaccgagcgcggttaaagcttcaccaccacggccgagcgggaaatcgtgcgtgcgattaaggagaagctgtgcaacgttggcccttggactttcgagcaag

SEQ ID NO: 558868 - DNA, 111 bp, Homo sapiens
atggtgttctgctaatgaatggagcagacatctaatatattctatgccttaagagcagtgtaactaaatattgggatacttaacaattggttttattatgtatttgataaa

SEQ ID NO: 558869 - DNA, 533 bp, Homo sapiens
  misc_feature (114)..(114): n is a, c, g, or t
  misc_feature (154)..(155): n is a, c, g, or t
cagtgatccgcccgccttgcctcccaaagtgctgggattacaggcatgagccaccacgcccggcctggagtagatgctttctaaaggaacttccacctttaaaatctgtgatgnttgtgttctattataaagtggcaccattggagtctaaggnngcttgattgcccttacactaaatggtcccaagtgtttatgtggttctgacactgccgtccagtgtgagttgtccccgataccattgtcaatatgcctgagaaaaaaagtaatttcctgccttattctacacacagcattttatacctagtctgagcgagaatctgagagtgatctttcctatagtatagagtagggtacatggatcttttcacaataagctgctgctcggaggcatttgtcacttctgagtttgcaactgtgtcagaggcccccagaaggctgcttccagtgaagtgaggtattaacactgaatagatttggatatactcctggtcacagtccgttcatcctgagccagaatcaaaaaaaaaaagctt

SEQ ID NO: 558870 - DNA, 627 bp, Homo sapiens
  misc_feature (114)..(114): n is a, c, g, or t
  misc_feature (154)..(155): n is a, c, g, or t
cagtgatccgcccgccttgcctcccaaagtgctgggattacaggcatgagccaccacgcccggcctggagtagatgctttctaaaggaacttccacctttaaaatctgtgatgnttgtgttctattataaagtggcaccattggagtctaaggnngcttgattgcccttacactaaatggtcccaagtgtttatgtggttctgacactgccgtccagtgtgagttgtccccgataccattgtcaatatgcctgagaaaaaaagtaatttcctgccttattctacacacagcattttatacctagtctgagcgagaatctgagagtgatctttcctatagtatagagtagggtacatggatcttttcacaataagctgctgctcggaggcatttgtcacttctgagtttgcaactgtgtcagaggcccccagaaggctgcttccagtgaagtgaggtattaacactgaatagatttggatatactcctggtcacagtccgttcacttaagagagaagtatttgtgggggaaaaaagttgcctataaagcatatttcccagttctactctcttacttaagttttcaattactaaactgccgtctaggagcgtaatcggtaccgagctca

SEQ ID NO: 558871 - DNA, 299 bp, Homo sapiens
gtgacgataaccagagatcatatcggattgctccacacgtataccaaaatgcccatggcattggacatggaccgcgaagaccgggtatattcagctcggatgccggtgtccaggtaacccgaagccttcatctccatcgcgacaaagcacagtgaacgaatagttgaccaccacgagtttgaccggcaattgcagctgcgccagtgtaaatgcaatcccacatcaagatggtgacaccaccgtacccgagacatcgcgatcacctgtcgtccagggaacgccgcctgagcgccgatcag

SEQ ID NO: 558872 - DNA, 1004 bp, Homo sapiens
  misc_feature (44)..(44): n is a, c, g, or t
  misc_feature (714)..(714): n is a, c, g, or t
catacaggaaaaagaccaccttttttaaacccccggcccccttncgggaagttttttaggcgagagggattttcttggccaattaattttttctttttccgggggaaggtgtttttttttttttttaatttttccccgaaaacccaatggggttttttgtgcgctttttcccttttttttagaaaaaggttttttccgggcctctcccttttcttaaacggttttacacaccattttagggggttttttttaatttgacattgtgttttggggaacccccccaccttggtttttttttggcaaagaggtttttttgtgtttgtttccttttggcaaaatttccttttcaaaagactgggaaaaggggttccttgggttttgggtttttcttaaaaaacccttccagttagtttttctgagtattcctctttgtatttgaagaaaagtttgatttaaatgaaccaccagaaggggaccgtttttttttatcaaatgtgattataaatggataatccccagttattcattgtgaggtgttgagactatgaaagaccattgtctttgattcagctcttaaatagtgtaactatttccccccctcggcttgctttctttccctcccctccaatgataaagaaaatgataaattttttgttgggccttccatttttattttaaataagactaaggataggccttggccccgcccttgcnacgtttttaccagtgtttcaatttaaaggggtagtgtttaaaaacattttcaagggataaggccttttgtcctttgctttttttaaaaatcagtggtaggaccagtgaagttaattttttgggggcccttttttaaaacccccctttttgaaatcataaataagttttttcaggttttaacccttttttgtacccaaacagacaaaaatgcttttttttcataaattaaaaaaagcttttttgtttatggggcatgcttttttaatccttttaaaaccctccccctttta

SEQ ID NO: 558873 - DNA, 150 bp, Homo sapiens
ctaaaggaaacgctatgtgaggactacatcaagaaggtggccatctgcaagccgggaagtgaggcctcaccagacgccagccctgctgactcctgatcttggactttcagcctccaggacagaaataaatttctattgtttaagccaaaa

SEQ ID NO: 558874 - DNA, 416 bp, Homo sapiens
aattattatcgtttgtttttttgagggggagtcttgctttgtcacccatgctggagtgcagtgacatgatctctgcccgctgcaacctccacctcccaggttcaagtgattctcctgcctcagcctccggcacagctggaattataggcatcaggcatctgccaacacgcccggttaatttttgtatttttagttgagatggggtttcgccatgttggccaggctggtctcaaattgctgacctcaggtgatccgcccactttggcctccccaagtgctgggattataggcgtgagccaccgtacccagccagttattgcttatattaactaagatacaggttgcatcctatggcttaagaagtatttattcttatcttcttatttgaccctcacaccaagtctgtgaggaataat

SEQ ID NO: 558875 - DNA, 154 bp, Homo sapiens
  misc_feature (127)..(127): n is a, c, g, or t
gattttcagcaagtttcaatcagccacatgctgccgtggggcagggggtgcatctcaacacaccatctttcacgccggtttctcatagcactgggttcaatcgtgtgcacgcggtggggggcatccntctcagcagtcgcacctgccaggccat

SEQ ID NO: 558876 - DNA, 144 bp, Homo sapiens
atctaacacatacctgatcactacttcggcactatgtttctcatgtactagtgcatattgtccacagtatcaaagaagaatgatagcattgaaggactcggggtatgggtaccgatgcctcgaacttctgtaatctatggctca

SEQ ID NO: 558877 - DNA, 245 bp, Homo sapiens
ccgcattccctcggcacccatctgcgctcccttgcaagcttgaactaatcacatggtggctaccctttccctggagctggtcggcttcgtgatgtgcaccatgtgcatcggtctgacctcctgcccccattcttttgcccgcttccccttggcagcgcatagccagcagagatggctcgggccatgccaggtctcccagcgagcgcttctgttgggtcaggttgttctcgcccaaacgctactgg

SEQ ID NO: 558878 - DNA, 194 bp, Homo sapiens
  misc_feature (39)..(39): n is a, c, g, or t
  misc_feature (61)..(62): n is a, c, g, or t
  misc_feature (190)..(190): n is a, c, g, or t
ggaaagggtgcctcatcccagcaacctatccttgtgggngatgatcactgtgctgcttgcnnctcatggcagagcattcatgccacgatttaggtgaatcgctgcatatgtgactgtcatgagatcctactagatgatcctgactagaatgataattaaaagtatttacttcgaagcaccatttgaatgntcat

SEQ ID NO: 558879 - DNA, 173 bp, Homo sapiens
ctgatatcgagcggatcaacctacacctaagccttagccgcctgattttaggccgaattttttccatcagttacggtcagattcgtgaatttttatgttgacgaagtaagttggtaccgttacgaaattttggcccccaaccggttgtctcaccacccgggaactttactttt

SEQ ID NO: 558880 - DNA, 402 bp, Homo sapiens
attgcggagccatcgcagctaataatgcaaggccacacaatggtggatcgaatagttgtggaaccaaagagagctgtctccagtagaagattctcaaagaccaggtgcccacttaactgttaaaaagatattcgtcgtggcattaaagaacacactgaacaacatcacctaagagattattttgaacagtatggatcaattgaagtgattgaaatcatgactgaccgatgcagtggcaagaaaaggggctttgcctttgtaacctttgacgaccataactccgtggataagattgtcattcagaaataccatactgtgaatggccacaactgtgaatttagaacagccctgtcgaagcgagagatggctactgcttcatccagccgaagaggtcgaagtggt

SEQ ID NO: 558881 - DNA, 334 bp, Homo sapiens
  misc_feature (8)..(8): n is a, c, g, or t
  misc_feature (51)..(51): n is a, c, g, or t
  misc_feature (72)..(72): n is a, c, g, or t
  misc_feature (259)..(259): n is a, c, g, or t
  misc_feature (305)..(305): n is a, c, g, or t
gctggagncccaacccgggtaaccatagcaagaccctgtcctataaaaaantgtttttttgcccgggtgcgngtgtcacgcctctaatctgagcactttgggaggccgaggcgggcgggtcacaaggtcagtagttcgagaccagcctggccaacatggtgaaaccccgtctctactaaaaatacaaaaaataataataataattagccgggcatggtggtgcacgcctgtagtcccagctactcgggaggctgaggcnggagaattgcttgaacccaggaggcggaggttacagtgagccaagntcaagccactgcactccagcctgggcgac

SEQ ID NO: 558882 - DNA, 352 bp, Homo sapiens
attctagagtgatccctgtggattggcgaccagtttcatacatgaggggacccactgtacagtacttgtccggtataaatacacgtatacaatacaccgtaaaggagctttctcaaagatggatgagaatttcgtgctaacaggtcacatctgttcttcagactaagggcaaacctggaaattagctatgccagaggacttcagtaaactgtcaagcgtgctgcacaaagcattacagaacacgagaaaaagttgtgttagcagtgcctgggcctgggcctcagagggaatgaaatccacagcggacctgcatcaaaaacttggcaaagcaattgaaatggtcgccaatccg

SEQ ID NO: 558883 - DNA, 164 bp, Homo sapiens
  misc_feature (75)..(75): n is a, c, g, or t
  misc_feature (105)..(105): n is a, c, g, or t
gtaataaacatttatttcaagtgttatttgttaaacatttaattgttgagatttgaaaacgaacattaccattcntttacacaggttagtaggcccatccaaaanccttatcttttgagttcctgctttcttcacagcagtgcactcactactttctggtatac

SEQ ID NO: 558884 - DNA, 192 bp, Homo sapiens
cctctgtcatactccgacacctgaaccagctgaggtggagactcgcaagggtggtgctagatgcagtgcaacattgagtcggtggatggagggagtcaaatcaccaccatgacacttcatgctgaagtaaggaggacaaactagaaccggaaccatgagctgtgacctgactgccaacatgagaactatccc

SEQ ID NO: 558885 - DNA, 291 bp, Homo sapiens
cctcgtggatgtccctgccttatgacgggccgcgcggtgacatcaccacatcagaccgcgaccgccatacgtatggactgctggcgcgcttggcactggaggccggctttgactggttgtcttacgagacaaaggcccacgtgtattgctccgtctcgtccgagcactcggccgcagccaagacgggcggctgcttccctgccggaccccaggtacgcctggagagtgcggcgcgtgtggtcttatccgccgtgaggtcggaagaccgtgtgctgaccatgggccatcggg

SEQ ID NO: 558886 - DNA, 531 bp, Homo sapiens
cgatctagaggatccctgggagtgcaggtcaggagggagcatgttccagacaaagagaatggcatgtgcagaggtgcagaggcataaaactgcaggctgtttccagaatgttatacatttctcagtctggttgcaaggaggggtggagactggtgggaaagaggccaactgggtccagtcatgaattcagggccatggctacaggacctgagccgttcctggcatgtcatggggaactgccttaagggtcttaaggggcctctgacagactgtttttagcacattctctccagcagctggaggcaggaatgccagtaaggagtagggtcagggtctggacagtggtgacgttcgatggcttggaaggacagtggtgacgttcgatggcttggaaggacagtggtgacgttgtaaagcggctttgatggcacgatggtgccagaactacaactgtagtgggctgagaagggatgggtcagtgaggagacagagactcctggaagggtcagcttcacaaacgaaatctggctt

SEQ ID NO: 558887 - DNA, 401 bp, Homo sapiens
aagaggatccgtgatgtatcccaacacacacgggttgcttagcagctattgagaatcttttgtggcatggaagaggtacagaggacgtctacaaaaattgtgagcagatagtgctttttggtttgtttgttgagaacaagagttcttgctctgtcccccaggctggagtacagtggcgctgtctcagctcactgcaaacaccacctcccggttcaagcaattctcctgcatcaacatcctgagtacttgggattacaggttcccactaccacgcccagctaatttttgtattttttgtagagatagggtttcaccatgtttggtcagggctggtctctaactcctgaccctcagggtgatctgcccaccctcggcccccacagtgttgggcgataacatca

SEQ ID NO: 558888 - DNA, 374 bp, Homo sapiens
cggacgaaaggtgacgctcgatggctcggaggacagtggtgacgctcgatggctcggaaggacactggtgacgctcgatggctcgggaggacactggtgacgctcgatggctcggaaggacagtggtgacgctcgatgacttggaaggacagtggtgacgttcgatggcttggaaggacagtggtgacgttcgatggcttggaaggacagtggtgacgttgtaaagcggctttgatggcacgatggtgccagaactacaactgtagtgggctgagaagggatgggtcagtgaggagacagagactgcaaaggagaccaaatggaatgatgcacaattaaaatacctgtaaacatttagattagctttccttgca

SEQ ID NO: 558889 - DNA, 847 bp, Homo sapiens
gattccatatttcggctgttgtgaatagtgctacaataaacatgggagtgcagataccaattgcattgccttcggaatacatacccagcaagtgggatggctggatcatatggtagttctatttttaactttttgaggaatctctatatcgtgttccatagtggctgtactaatttataatcccatcaacagggtgtaagtgtgcccttttgctccacagttcttgagcaagcacttgtttgtcttgttatgcttgttatgagtgactagccattccaactggaactaaggtgataactcattgtggttgggatttctatgttctctgatgaagtagcaatgtagaagcattcttttgcatcaaacctgttggccatgtgtatgtcttctttctgagaaatgcctattgaaggtctcttggcccattgttagaaatcaggtgatcttgtgttactcgggtcgctcaagctcccgccattttacaaatcttatttccacaaaatctctgcccagacctgatgttccagcatttcctgctacattattcttctagtaggttcagtagtctagggtaggacatctaagtcctcgtaatccatgtggcagctagatcttgcgcatatggtgcagaggtaggaatctagtctcatctcctggtatgtggctgttcaagtccactccaggccacatttatcgaacgagactttttcccaaatgtgtgttccttgtcaccctttatggagaactcagtgggctatcagtggcacacatttgcgagggggcctacatttcgcgcccatcggtttatgtcgtcatctctatgccataccatgctattggtctacaa

SEQ ID NO: 558890 - DNA, 1295 bp, Homo sapiens
  misc_feature (13)..(14): n is a, c, g, or t
tggtccggaattnntgagactcgtggccctgcctggcggtccgcgctgagagtcgccgattagtcggcatcgggcctcgggcgcccccggggcgggttgggttgcagcccagcgggcggctggaccgccgcggtggggcggggacaatggggtacaaggacaacgacggcgaggaggaggagcgggagggcggcgccgcgggcccgcgggggtctagactgccccccatcacaggcggcgcctccgagctggccaaacggaaggtgaagaagaaaaaaaggaagaagaagaccaaggggtctggcaagggggacgataaacatcagagtcagagcctgaagagccagccgctttcttcctcctttcatgacatcttaagtccttgcaaagagcgtggcccgaaaccagagcacagacagagcaaagtggaaaagaagcacctcccttctgactcctccaccgtcagcctccccgactttgccgaaatagagaaccttgcgaatcggatcaacgaaagtctgcgttgggatggaattcttgctgacccggaggcagagaaggaaaggattcgcatctataaactgaatcggagaaaacggtaccggtgcttggccctcaagggcttccaccccgaccccgaggccctcaagggcttccacactgaccccaatgccgaggaggcccctgagaacttaccctacctctcggacaaagatggcagctccagccacaggcagcccacgtcgaaagccgagtgccccaatctctgttttgaaggaaaccttaccccaaagcttctacactctgacttagctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcaccaagctgccctcggttgcccaggagagccacagtgccttgagaacataagcaatttagtgaacagagttcttttcagaatttcctttttcttaagtaagcatctctgttacttaatttctcaccacagctagatgtctataatctgccccaaaaagaaaagaaagcgtgtagatgatttacctcttaagtctcaatctcatggtgaaactcctcacacggtacctgcttctgttggccggaggacgatgccctgaacctcttggagcctttttctgttttaattaaatgcatggcctgcctttatatggcctcaaata

SEQ ID NO: 558891 - DNA, 386 bp, Homo sapiens
cggaggacacatagtaaagaagcacaaagacacgggacatcaaaacattaaacccagatggaactgccatatagataacaaatgggtctcccacaccacagaattcatatacaaaagccctatcggtatgtagctattcctgaacaaatacattaatacacttttagtttatatacatttgtaaaaattcaaggttttaataacatttctttgcaagacatttggtctaaggtggttactcaatattaggaaacaaacactgtaccaaaatggatatgacttgtgaataaaccctaaataaagtggcttttggaagaactggattttgcagcaaccaactttataaagaggtccatccgctctcaatggaaaacacccaagcatac

SEQ ID NO: 558892 - DNA, 1386 bp, Homo sapiens
  misc_feature (13)..(14): n is a, c, g, or t
tggtccggaattnntgagactcgtggccctgcctggcggtccgcgctgagagtcgccgattagtcggcatcgggcctcgggcgcccccggggcgggttgggttgcagcccagcgggcggctggaccgccgcggtggggcggggacaatggggtacaaggacaacgacggcgaggaggaggagcgggagggcggcgccgcgggcccgcgggggtctagactgccccccatcacaggcggcgcctccgagctggccaaacggaaggtgaagaagaaaaaaaggaagaagaagaccaaggggtctggcaagggggacgataaacatcagagtcagagcctgaagagccagccgctttcttcctcctttcatgacatcttaagtccttgcaaagagcgtggcccgaaaccagagcacagacagagcaaagtggaaaagaagcacctcccttctgactcctccaccgtcagcctccccgactttgccgaaatagagaaccttgcgaatcggatcaacgaaagtctgcgttgggatggaattcttgctgacccggaggcagagaaggaaaggattcgcatctataaactgaatcggagaaaacggtaccggtgcttggccctcaagggcttccaccccgaccccgaggccctcaagggcttccacactgaccccaatgccgaggaggcccctgagaacttaccctacctctcggacaaagatggcagctccagccacaggcagcccacgtcgaaagccgagtgccccaatctctgttttgaaggaaaccttaccccaaagcttctacactctgacttagctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcaccaagctgccctcggttgcccaggagagccacagtgccttgagaacataagcaatttagtgaacagagttcttttcagaatttcctttttcttaagtaagcatctctgttacttaatttctcaccacagctagatgtctataatctgccccaaaaagaaaagaaagcgtgtagatgatttacctcttaagtctcaatctcatggtgaaactcctcacacggtacctgcttctgttggccggaggacgatgccctgaacctcttggagcctttttctgttttaattaaatgcatggcctgcctttatatggcctcaaataagtgggttccagaactccatccctgggaagttaccatgggaagtcccaagaggaatactgcttctttcataaacatggtcctctcctaaaa

SEQ ID NO: 558893 - DNA, 523 bp, Homo sapiens
attcaaaacccagcgtgccagttagtattccaaaaaggagtttctaatgaaagtgtacctgatcaaagaaagacaataaaaaaaagaagaaaaaaagagggggggggccggacggatccaaggaatccaggcatgaggagcgtaccgaacatcgcgataagcatagtgtccaatcgcagagggagtgcgtcatagtagacggacacgccaccatacatagtagagagaagacaaagttagttgtgattagagaatgattgtaatgtgatggagaaggcaggatcataaatattttagtatgggagtgagggaagatgattatatttggtagaaaaaaacaactaactactgaaacagaatcatatttaaaagggggtgatagtagagaagaatcaataataaaaaaatacaagtgagtagaaaaaaatagtagaaaacaagaagatcataaagttaatatgacggtgagagagaagaaaaaaaaataaacacaaaataattttaatatataaaaaaatatatt

SEQ ID NO: 558894 - DNA, 221 bp, Homo sapiens
atgcagtatgagtactaagggaaccaactgtcttggttctgacgggcagagctgggaattctcccagatgatttgattctcatttcttttattatttagggaaaactgacttttcgcccttttttgcccaggctgagagcgcatgggcaaaattccggctcaccacaacctccacctcccaggttacaagcaattcctccgtgcctcagcggggttaccga

SEQ ID NO: 558895 - DNA, 1573 bp, Homo sapiens
  misc_feature (13)..(14): n is a, c, g, or t
  misc_feature (721)..(721): n is a, c, g, or t
tggtccggaattnntgagactcgtggccctgcctggcggtccgcgctgagagtcgccgattagtcggcatcgggcctcgggcgcccccggggcgggttgggttgcagcccagcgggcggctggaccgccgcggtggggcggggacaatggggtacaaggacaacgacggcgaggaggaggagcgggagggcggcgccgcgggcccgcgggggtctagactgccccccatcacaggcggcgcctccgagctggccaaacggaaggtgaagaagaaaaaaaggaagaagaagaccaaggggtctggcaagggggacgataaacatcagagtcagagcctgaagagccagccgctttcttcctcctttcatgacatcttaagtccttgcaaagagcgtggcccgaaaccagagcacagacagagcaaagtggaaaagaagcacctcccttctgactcctccaccgtcagcctccccgactttgccgaaatagagaaccttgcgaatcggatcaacgaaagtctgcgttgggatggaattcttgctgacccggaggcagagaaggaaaggattcgcatctataaactgaatcggagaggtaccggtgcttggccctcaaggcttccaccccgaccccgaggccctcaaggcttccaccccgaccccgacgccctcaaggcttccaccccgaccccgaggccctcaaggcttccaccccgaccccnaggccctcaaggcttccaccccgaccccaaggccctcaagggtttccacactgaccccgaggccctcaagggtttccaccccgaccccaaggccctcaagggcttccaccccgaccccgaggccctcaagggcttccaccccgaccccgaaaacggtaccggtgcttggccctcaagggcttccaccccgaccccgaggccctcaagggcttccacactgaccccaatgccgaggaggcccctgagaacttaccctacctctcggacaaagatggcagctccagccacaggcagcccacgtcgaaagccgagtgccccaatctctgttttgaaggaaaccttaccccaaagcttctacactctgacttagctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcaccaagctgccctcggttgcccaggagagccacagtgccttgagaacataagcaatttagtgaacagagttcttttcagaatttcctttttcttaagtaagcatctctgttacttaatttctcaccacagctagatgtctataatctgccccaaaaagaaaagaaagcgtgtagatgatttacctcttaagtctcaatctcatggtgaaactcctcacacggtacctgcttctgttggccggaggacgatgccctgaacctcttggagcctttttctgttttaattaaatgcatggcctgcctttatatggcctcaaata

SEQ ID NO: 558896 - DNA, 238 bp, Homo sapiens
  misc_feature (230)..(230): n is a, c, g, or t
ggtagtgtactgtgaaaagggtctggtacatgaaacattatatacttgaggacagcattcagaactgttaagacaaaagacaaactatgattttaagactcgagtcttgatttaagggaaaggctataattattggctgaaaagtattcagcgtgaactcagattctatattagcatgaaagagtacaaaagatgttggagtccagtaagccctattaccttaatttaanctgtaaag

SEQ ID NO: 558897 - DNA, 1319 bp, Homo sapiens
  misc_feature (13)..(14): n is a, c, g, or t
tggtccggaattnntgagactcgtggccctgcctggcggtccgcgctgagagtcgccgattagtcggcatcgggcctcgggcgcccccggggcgggttgggttgcagcccagcgggcggctggaccgccgcggtggggcggggacaatggggtacaaggacaacgacggcgaggaggaggagcgggagggcggcgccgcgggcccgcgggggtctagactgccccccatcacaggcggcgcctccgagctggccaaacggaaggtgaagaagaaaaaaaggaagaagaagaccaaggggtctggcaagggggacgataaacatcagagtcagagcctgaagagccagccgctttcttcctcctttcatgacatcttaagtccttgcaaagagcgtggcccgaaaccagagcacagacagagcaaagtggaaaagaagcacctcccttctgactcctccaccgtcagcctccccgactttgccgaaatagagaaccttgcgaatcggatcaacgaaagtctgcgttgggatggaattcttgctgacccggaggcagagaaggaaaggattcgcatctataaactgaatcggagaaaacggtaccggtgcttggccctcaagggcttccaccccgaccccgaggccctcaagggcttccacactgaccccaatgccgaggaggcccctgagaacttaccctacctctcggacaaagatggcagctccagccacaggcagcccacgtcgaaagccgagtgccccaatctctgttttgaaggaaaccttaccccaaagcttctacactctgacttagctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcaccaagctgccctcggttgcccaggagagccacagtgccttgagaacataagcaatttagtgaacagagttcttttcagaatttcctttttcttaagatgaatagccttggaagatagagatcgtgtctccctccagagcaaagggcagattagcttcaatgatgacagaagatctcggttcccgggctcagagtccgctgctgtaacgtaagcccttctgtcctcatgtcacctagagcctcttcctgtcaccctgtgggaagtgattctgaggaaaccaggacaattgcaaacactctggctactgctttgctgtgactaataaacatcctttgtcttgtca

SEQ ID NO: 558898 - DNA, 500 bp, Homo sapiens
gagctcggttccctccgcgttcgcggttgggctgggggtggtggctcacgcctgtaatcccagcactttgggaggacgaggcgggtgaatcatgaggtcaggagttcaagacaagcctggccaacatggtgaaaccctgactctacggacgtctgtaatcccagctacttgggaggctgaggttgcagtgagccgacattgcaccactgcactctagcctgggcgacagaggaagactccgtttccaaaaaaagacttttggtactaagctttctcgtatgatttttctgtaatcttatattaatagacgtgggatgacgattatgaaaaataactttttagtcattcggtaggttgtcatgtagtcagagttaagtctctctttactttgaagatttagagttctgaatagttgatttgtgcctgcagtatctcttagtgtttaccacaagtcatttctcagagtgtctgtagatgtttaggctgtacttaagtactgc

SEQ ID NO: 558899 - DNA, 1175 bp, Homo sapiens
  misc_feature (13)..(14): n is a, c, g, or t
tggtccggaattnntgagactcgtggccctgcctggcggtccgcgctgagagtcgccgattagtcggcatcgggcctcgggcgcccccggggcgggttgggttgcagcccagcgggcggctggaccgccgcggtggggcggggacaatggggtacaaggacaacgacggcgaggaggaggagcgggagggcggcgccgcgggcccgcgggggtctagactgccccccatcacaggcggcgcctccgagctggccaaacggaaggtgaagaagaaaaaaaggaagaagaagaccaaggggtctggcaagggggacgataaacatcagagtcagagcctgaagagccagccgctttcttcctcctttcatgacatcttaagtccttgcaaagagcgtggcccgaaaccagagcacagacagagcaaagtggaaaagaagcacctcccttctgactcctccaccgtcagcctccccgactttgccgaaatagagaaccttgcgaatcggatcaacgaaagtctgcgttgggatggaattcttgctgacccggaggcagagaaggaaaggattcgcatctataaactgaatcggagagatggcagctccagccacaggcagcccacgtcgaaagccgagtgccccaatctctgttttgaaggaaaccttaccccaaagcttctacactctgacttagctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcaccaagctgccctcggttgcccaggagagccacagtgccttgagaacataagcaatttagtgaacagagttcttttcagaatttcctttttcttaagtaagcatctctgttacttaatttctcaccacagctagatgtctataatctgccccaaaaagaaaagaaagcgtgtagatgatttacctcttaagtctcaatctcatggtgaaactcctcacacggtacctgcttctgttggccggaggacgatgccctgaacctcttggagcctttttctgttttaattaaatgcatggcctgcctttatatggcctcaaata

SEQ ID NO: 558900 - DNA, 431 bp, Homo sapiens
gccatcatgaacgacccgtgaactatccgcactagaaagttcatggccaaccgcctacttcagaggaaacaaatggtcattgatgtccttcaccccgggaaggcggcagtgcctaagacagaaattcgggaaaaactagccaaaatgtcacaggccacaccggatgtcatctttgtatttggattcagaactcattttggtggtggcaaaacaactggctttggcatgatttatgattccctggattatgcaaaaaaaaatgaaccccaacatagccttgcaagacatggcctgtatgagaaaaaaaagccctcaagaaagccccgaaagggacgcaagacccgaattaagaaagtccggggggctgccaaggccaatgttggtgctggcaaaaagtgagctggagattggatcccaacccaaggagtaaa

SEQ ID NO: 558901 - DNA, 1149 bp, Homo sapiens
cggacgaaaggtgacgctcgatggctcggaggacagtggtgacgctcgatggctcggaaggacactggtgacgctcgatggctcgggaggacactggtgacgctcgatggctcggaaggacagtggtgacgctcgatgacttggaaggacagtggtgacgttcgatggcttggaaggacagtggtgacgttcgatggcttggaaggacagtggtgacgttgtaaagcggctttgatggcacgatggtgccagaactacaactgtagtgggctgagaagggatgggtcagataaacatcagagtcagagcctgaagagccagccgctttcttcctcctttcatgacatcttaagtccttgcaaagagcgtggcccgaaaccagagcacagacagagcaaagtggaaaagaagcacctcccttctgactcctccaccgtcagcctccccgactttgccgaaatagagaaccttgcgaatcggatcaacgaaagtctgcgttgggatggaattcttgctgacccggaggcagagaaggaaaggattcgcatctataaactgaatcggagagatggcagctccagccacaggcagcccacgtcgaaagccgagtgccccaatctctgttttgaaggaaaccttaccccaaagcttctacactctgacttagctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcaccaagctgccctcggttgcccaggagagccacagtgccttgagaacataagcaatttagtgaacagagttcttttcagaatttcctttttcttaagtaagcatctctgttacttaatttctcaccacagctagatgtctataatctgccccaaaaagaaaagaaagcgtgtagatgatttacctcttaagtctcaatctcatggtgaaactcctcacacggtacctgcttctgttggccggaggacgatgccctgaacctcttggagcctttttctgttttaattaaatgcatggcctgcctttatatggcctcaaata

SEQ ID NO: 558902 - DNA, 1474 bp, Homo sapiens
tggtttttccaaaaccccggaaattttgtgcttcaccttgtgcaaaccagggttctccacaacccacaatgtgggagaacaccgaagaccaagaaggaggtgggcgacacggggaggggccgaagaggggcccgttgcgttcgcggagaacacgggagagggcgaaacgggagacaacggggggagaccgggaccatatctcccgcgggacatacaatcacaacagaggcacagagagggtggagagaggcccgtgtgtggcgaaaccgcggcgaggtgtgtgcgcgggaggaagcgcgggtgtgggccgccgtgaagaagcccgcggggaggtctccgccgcgtgccccgcgggacccccgcgagagagccgcagagagacacatatgcgaggcacttgtgggccccccagacacacagcggatcacgtggagtgtggggacaccaagagcgcggtgtgggtgtgggccccccccgcggtctcccaacaagagagagaaagggagaggaacaatcgcggctccccatagaaaagtgtgagcgccaagggagacaaagggggagaacaaagtgtgggggggcgccgagtacacgcgccacggacactctcactccggctcgctgtaggggccaaggccccctgacacacacactgtgcccggcccctcccaacaccccccgggcgcaataaaccccatgggtgaggaacccccgaataatctccaccagcgggtgtctcaccagtcaaaccccaccggggggcactctacaacagcttattttcccccgggcgaaagagaaccgaggggataaaaccactggagcacaccagtgagccactaacccgggatggccccccggtgcccgcgcacacgacgccaaaaaaaccccacacgtgggaaaagcgaccgtgaaaacccaagccgccactccacagcaaaggggacccacaagaggataaagcgacccccaaaaggaaaaaacccggagaaggaagaagcacaagagccgcacacacatgcgtcccaccacccgccggcaggatcgacgaaacacccaacaagatccaccaccacacaactccagcacccacacacgtccacacacagagaaaggcggccaattcacacaccccccaagaaagaagacagcggaacacagtatgtaccccccacagagcaagtcccccggggaacaacaccgagagaacagccacggcgacaaaacagacaccgaaaacagcagccgcgaaaaacctccgtcagaagccacgcagaagccccacacacaaaacaaaaccacacgcagacaccaaacaacaaacaacaatccatagacaagacgcccaccaagaggccacaccgcaggaagaccactactcctccacccaaaaaaaaaagattagcgaaacacacgacagccacccaatgcagacgacacacgacaccccaccaaacgacaagcagccccacat

SEQ ID NO: 558903 - DNA, 687 bp, Homo sapiens
tgacgacaagaactcaacaaaactagctaggtacgaggctgggtgttagttggagctctggatttgcctgggggtgacgaggatgagactgaggcagtgggacagccaggaggtcccagaggggacactgtttcagcctctccctgcagtgctcccctggcccgagcaagcaggcttggcagacctactgttgaaggaagcgtcctacagcgtgtatccaccccagaggccccagagcctccatctcagtgagcagatgggccatccctgttggacgcctacctcgccctgtcgtgtgatttcatatcggacctcattaccgctcagtccagcgcttcctagatgggcattttgagccatgatgtgtttcaggaaacaggtcctatcctgcactttggaatcggcatgactctgtctattgtcgcagctcacacattctgcaggacaaaagcagattgtggctgaatgccattgccctggcccagaaacacatgacacgcaccatctacacttcgcccatcgaaggccctgtagcaaccagaagttccggtgacttccgaaacacattcgtgggatgtggggctgctcaccggggatgtacagctgcatccggaggcctcctgtctcatcatgaccacagagatccttcgctccatgctgtacagtggctcatatgttattcgggac

SEQ ID NO: 558904 - DNA, 433 bp, Homo sapiens
  misc_feature (170)..(170): n is a, c, g, or t
  misc_feature (217)..(217): n is a, c, g, or t
taggcatatctgtcttgtggatgttaggcatgatgtctggtcagtcctggcgtgaatcgtgagcgtgtgtgtgcatatggaccgctgatctgctagacccgacctgctatctttgcatgttcgtgctggtcggtgtgccacacagggcgcgcgtgtgcgcgcatgtgtgngcatacatgcatcaggtagtgtgtgtgtctgtgtgtgtgtgtcaggngctatgcctcacacacagactgcctggggtgctggccattcctcctcgccatgggtcccctgccttcgtctgcagctccgtcctccatcctcccagtctagctgtctggccaggccccccgtgcccactgcagatacggtgccgtctagcactgatagtggatgtgctggtggaccttgccctccacgtgtgagtgtgtgtgagagtgtgtgtgtg

SEQ ID NO: 558905 - DNA, 208 bp, Homo sapiens
attttaacctcaacttttttttctacatttttggacccactcagtactttcacctcctgtgctagttctttctactctacctagaatataactatcggatttctttaattgctcagtcctcttcccttatcttttccattataagtttcctgctatatcacacctcatatctcctttttgttcccaaaattgtttcttgtgccttttc

SEQ ID NO: 558906 - DNA, 2120 bp, Homo sapiens
  misc_feature (1117)..(1117): n is a, c, g, or t
  misc_feature (1662)..(1662): n is a, c, g, or t
  misc_feature (1779)..(1779): n is a, c, g, or t
ttgtgtggtagatctgtttgtgtgtggttggatctgccgtgtaggatgcttgtgactgctgtggcggtcgtgtggttgtgtgtcgttgtgggcttgctgtcgtgcctctagtgtctgtgtgtgtgtcgggtgttgctgtctgtgttgttgtgtctgtgccctctcgtgtgggttgtcgtctgctctctgctcgaatttgtgtgtcacctgcatggctggctcggagtgcatgcacagggggggtggcgagcggggccgggcaggtggtggtgttgggccggcgacgaggtgtgggcgtcccgcttctcctcttgttggagcacacacggggggggtgagatgcgctgctgtaatcgttcttttttttgatggtttcgtgccgtcgggttcatcgagtcgtgtggtagtttgttggggttatggtgttgggtgcctaccagcgggctagctgtcggtgacccactctctttatgtggtggcgagctaagaacgacttgtcgccgacacacccatcgtgactctacgttggtgtagtgtggtcgacgatggaactgttacggtgggacaccaccaccaatggtgtgcatgacagatgttctggggtccacctcaatagacttaaaagtggccactgatagtttgtcatgattgtgataggtgcaagcaaatgactgttggtttgtagagatggacgcacctgctgctgtttggtgtggttatagaagagtgcgaaagtactgtgtggcgagtgaggatcgattgctgatgatagatgtcgtccgcttgtgggtggggcaccagaccgtgtgagataagtaatgcgtgtgctcctcgcgcgcttgtgtcgtgcgcaacgacggtgtgtctggtgtgagacgttgatgttgggtaggacaaacacgctgttggagtgtgttttctgcattagggtgggaagtggggtgcgtatgattgtgtgtcatacccactcaagtatggtggcccgcaagtgtggggtacgccactcacacagcagtgctcggggggtccgccacgaggagtgggtgagaaccacccacagagtaggtgtgggctgcgtgtttggtgtgtgtgtgtgttctattttagaatgggtgancatgagtgttgagaccacagacacacaaaatgggggggtaattgtgcttcgctggagcacacctcaggtaacacacatcgttgtggtgaggcacaccacgatggtgttgtcgtatggttgacagtctcatcgtgtgtgaagaatagcccaggaggtctgttaagactctgtaatagttgtgtggctgcgcgcagttgactgtggggcttactcataggaagaggacagtggtggagaatacccccgcaggacaccacagagggtgtgtgtgtggccacgcaggtgcactgtgtctcgctcttcgttggaagaggtttctcgaggagaaagtttctgctataagatgtgtgaagtagtgtctcacaccgcgggtgtgtgtggggacacagacacagtctcgcgggatagagttgtgtgtctcgcagctcagtggtacacgtgtgtagatgagttgtgtgtgtgtgagtgtaatggtctcacaaatgtgtgtatgatgggacaaagagggctctccacattagttatgccactgtatggcgccaacncagaggtgtgtgtgggtgtgtatatgtgtgtggcgcagatataaaagatgtgtgtgatacacactcaacacaccctagaacacaatatggggatagtctcagtgttgtggagaatanagaccctgttagtggtggtggtttgtaacaccttagttatagagttgtatgtagaagaagaaatagggtagtagagatagcacgaaacaataataagacgagggtcaagagggtagagtgcaatcttgttgtggtagtttctaagcgctggcgtttttctcagatggactcctaactggcctatgtccaggttttgtacattgaccgtagcctctacattttgtttccaaatggctcccaatgatttttgtactgcccaaattatatcccaattttggaagaaaaggtaaaatatactcgagcattaactcgggccgagaagagtatcagccccctggctg

SEQ ID NO: 558907 - DNA, 446 bp, Homo sapiens
aacaaggatcattgatgttgtctacaatgcatccaacaacgagcttgtccgcaccaagaccctggtgaagaactgcatcgtgcttattgacagcacgccgtaccgacagtggtacgagtcccactatgcacttcccctgggccgcaagaagggggccaagctgactcctgaggaggaagagattttaaacaaaaaacgatcaaagaaaattcaaaagaaatacgatgaaaggaaaaagaatgccaaaatcagcagcctcctggaggagcagttccagcagggcaagcttctagcctgtattgcctcacgaccaggccagtgtggcagagcagacggctatgtgctcgaaggcaaggagctggagttctatctgcggaagatcaaagcccggaaaggcaaatgagcctcatgtgtagtgtaataaaggtgtctgctgttctatctgt

SEQ ID NO: 558908 - DNA, 713 bp, Homo sapiens
  misc_feature (3)..(3): n is a, c, g, or t
  misc_feature (64)..(64): n is a, c, g, or t
  misc_feature (117)..(117): n is a, c, g, or t
  misc_feature (179)..(179): n is a, c, g, or t
  misc_feature (189)..(189): n is a, c, g, or t
  misc_feature (212)..(212): n is a, c, g, or t
  misc_feature (214)..(214): n is a, c, g, or t
  misc_feature (216)..(216): n is a, c, g, or t
  misc_feature (236)..(236): n is a, c, g, or t
  misc_feature (421)..(421): n is a, c, g, or t
  misc_feature (428)..(428): n is a, c, g, or t
  misc_feature (613)..(613): n is a, c, g, or t
  misc_feature (629)..(629): n is a, c, g, or t
  misc_feature (676)..(676): n is a, c, g, or t
gtntaaatttttttacactatagcatttatgcaatggtttacagaattcatggagttatttttntcagtttgggatttatttaaaaccttgaatctttgttttgtctgcttctctgngcacaagcctggtcagctggtccctgcgggtccttccagccagcttctctgttgggctctcngccgcgtccncctctgctctccccccccaaggncncnaactcccccgccgtcctggntccccccgccgctgctctgggggcttggctctgggcgtctcgtggccccggtgctcccggttgggggtttctgtgggcctcgtgttgggggtgccgtgctgggtgtgccaccctttctgccttttgttctcctttgtgggttctttttgtgccttcctgccgttttcccgggtctccaccccccngctgtcngggcctccctcccgctgggtgggttcattttcttctggggtctttaagtagccagcatcctcaaaaagtgtcctcagcaacttctcatggccctggggggtgatcagctcatcggccaggtcctgctctacctggtcccactgccgctgcagggcctctggcagggttgggtacactagcaaagngtgggggtggcagacnaggggggtctcggacgtcagcgcgtagacgcaggtgctcggctcggncacatgggccagccggttgctttttccacacgccagc

SEQ ID NO: 558909 - DNA, 126 bp, Homo sapiens
  misc_feature (47)..(47): n is a, c, g, or t
cccgcctccctacggacgacggagggtgcactggaattaagggtgtncgctcatgccagctcgtgcaggtgcgagatagtagtagggtcgtggtgctggagtttaagttgagtagtaggaatgcgg

SEQ ID NO: 558910 - DNA, 666 bp, Homo sapiens
gcgtggagagcagcatgccatgtccgtacgcggtaccctatgccgtgggcctcaacaagggccacaaatgtgatcaagaacgtgagcaagcccaggcagcaccgacgtccgctgggcgtctgacaaacacaccaagttcgtgcgggacatgattcgtggaggtgtgtggctttgccccgtactgatgcggagcgcctatggagttactgaaggtctccaagggatccaatgcagggtgccctcacaatttagtctatggaaaagggtgtgtggaccgctaccatcgcgcctaccgaggaagcgtcgcagtgagcgtgaagctattgtttcttggccgccgtgaggaacgtgtgctgcaccaaggaaagacttaggcccctcgccgtgcctctccttcgcgtgaaaacttagaggaactagcttgaacgatgagtcagtcaatccttgggtccatttgccttactatcctcatggaggcagtaacccactttcttcaggtacggtgccaagagcctgtgatccggcaattcgtccagtggcgctgtaactggatgctggccccctggcttgtctgtgaggacccgtgggtaatggtcctgaggggtgcgattggaggaaggaggctacatgttgtggatgaggcgaggaaccctggggttttataag

SEQ ID NO: 558911 - DNA, 1129 bp, Homo sapiens
  misc_feature (499)..(499): n is a, c, g, or t
  misc_feature (557)..(557): n is a, c, g, or t
  misc_feature (570)..(571): n is a, c, g, or t
  misc_feature (595)..(595): n is a, c, g, or t
  misc_feature (616)..(616): n is a, c, g, or t
gacggggcgaaggcgacaggggtctgtggacgagactgtcggcggagagcggtcacgttttcctggagaaagacgaggccccaggcaggagcgcgggctgcgctgggcctttacttcgccgcccgttggcggggagacggccccgtacccgaggggacgaggggacgagggggccatgcccagtcattttaagccgaggcctggaggggcttccgggagcaggtgctggagctcctctgccaggcagggaggctggaccagacacccggcagagggaggcggcgagggcccccagcaaggattctccccagcccctgtgcctgcgtctcctgcggcttctgtgcgcggaccgtgtcctgtgctgtgtagggaacgctgctctctgctcgggacgtggattcctttcccctcctcctcgcctggtactgctgacgcaggtcgtcggactccgcttgggtgtcacccgtgcaggaagcctcccttagtcagggccctcggnacccgccccatatgtgactagcagccctcctgtgtatttcatcgcgcccccgtatgtntatatcagccatnnccactcaccacccttctgggcaanccctttatctcccggtctganatcccatcgctgagggctgggacccctcctcagtgcttatccctgtttccccgcgcgagtctggcgccgtggcgtgtggaaggcgctcagtaaacgttgtggagcgaagaaacgacgcaaaggtgatgagcacgacgcagttaggaggctattggcccggcgcgggggaacacagggggaaggtcgggctcggggtggcaggacccagagggcaggggtggctgccgggatgcactaggggcaaggggggcgtcaaggccccagcaaggtcgggataaacgtttgctcgtccgaggcacagacgtgcgcctgcgggctcaggattacctctcccataactcctgtcctaaacgcagcttcagcggagggggctgagggctctactgggcattacctggaaaaacttatttgcactcccacggcctaacgaaggtggggcttatctattagccacggccagggatagggtgagggcactcctccaggcagaaattcagggaggtgccaaccccg

SEQ ID NO: 558912 - DNA, 448 bp, Homo sapiens
cccgatctctctgtgggggaccaccgaaaatcgttactgtcatctcacctggagcactccagagctcatggaactctggcccaaggctctctgactgactccttaccagatacttctatggcttagcggctgaagaatgacactacctgatcgcctcggaagccccctggaccatcacggatgccgagcttccggtaaactctcaaagtggaaggtaagaccgtcccctacttaatcaatatggaggctaaccaatccacattaacttcttttcaaaggactgtttaacttgactccataactgtatgtgggtattgagacgctctctctgtgggggcaacagtaactcccatttgacccaaaccatgactcacctgggcatacagcacgggcatgggcctgggcccaagctatgatgcaccaggacttcattcacctctcagacacc

SEQ ID NO: 558913 - DNA, 255 bp, Homo sapiens
accccgcagtctttccgcgccgctactacaagagcgcgagagcattttgaaaggtttgcgattataaacaggggttttggccttcaatattaagtcaggccaggatctgggggacaatgactctggcttcggaggaccatcaatgtcacgacggagacacagtaatcagataacgggcgcttgttcctgacgatctcagacgtagggggaggcatttctttttgccagctggctgggcagctggggccggctgac

SEQ ID NO: 558914 - DNA, 457 bp, Homo sapiens
cgcggtgtatctagaggatcccgcgacactcttgggtagaccaagaagacgctccaaggcacttcccaaagccaaacttgcacccaaaaaaggttatggtcactatttggtggtcgtcggctcgtctgatccactgcagctttctgaatgccagtgaaaccattgcctctgaggagtgtgctcagcaaattgatgacatgcactgaaaactccagcgcctgcaggcagcattgatcaacagaaaagcccaattcttcttcatgacagcacctgaccacatgtcacacaactcatgctttaaaagttgaacaaattgggctacgaagtttcacctcatctgccgtattcacctgatctctcgccaactgactactacttattcgagcatcttgacaactctttgcagggaaaatgctttcaggaccagcaggatgcagaaaatgcaaccaaggtgtcg

SEQ ID NO: 558915 - DNA, 131 bp, Homo sapiens
attagctcttagtaagattacacatgcaggcatccccgttccagtaagttaaccctctaaataaccacgataaaaagggaaaggcatcaaggaacgcagcaatgacagcttcaaaacggttaggcctaggc

SEQ ID NO: 558916 - DNA, 279 bp, Homo sapiens
tagcttctttaagatgttctatgtccttatattttcttctaacatggttcctctatttgatttttccccttcctataaataataagttacttctatggcacaaatggcacgtaccctaggatatagattatatgaggaaggtctttgatatttactaactttatcttattctattttttttactttctgaatttcttaaaacttatacttaatgtctgtacagctagaattacttttttgcatgtacatgttgtttcacctttgtttacgtacatttgt

SEQ ID NO: 558917 - DNA, 106 bp, Homo sapiens
acacatggtgtgtatccacgcatgggtaaacactccacgcatttgtggcacatgaatggtgtgtatctaaataaatatttatataacctgataaataaatgaaata

SEQ ID NO: 558918 - DNA, 521 bp, Homo sapiens
cagactccgaataatggcctgcgctttgcgctaccattttggtcctccataatgatgggcaattgcatgacctgtaaacttccctgtagctagagttcttcccactgtgctcttattatgaattaacaagatgtgtcaccttgcacttacctacaatgaccctatctgagatatatattctgaaaatcgtcatcggtaaataggccatcagtagggcattccgccattgggatatccttctcgtagtcacaaaaagacatgcttatagctcattcgaacatgtatacggctgtaggtacactgtgtgaaacaatagttacagcaagtgcgtatgtgtttataaattctatcccctagactttcggccacgagttcaagtgcacctctctctttgttttccaaatgtattgaactgtacaccacgtctcccctattcaatgttcaatgggtgttgtaaatgcccaagtattgtccactcgctcctcaaccccaaccttccatccctagaaaccaccctgaaa

SEQ ID NO: 558919 - DNA, 343 bp, Homo sapiens
  misc_feature (265)..(265): n is a, c, g, or t
  misc_feature (271)..(271): n is a, c, g, or t
  misc_feature (290)..(290): n is a, c, g, or t
atctagaggacccatattgcttggacgaaggatgggaatgactgcttaatcagcatggggtttcattttggggtgatggaaatgttatggaactagatagatgtgatgaatgtacaacactggtgaatgtactagaacgctacttaacttgtttgctttaaagtggttaatttatgttatatagaatttaaactcacattaaaaacaaaaaatcagggctcccttgagcccaggaagttggaggccagccagacgcaacatagtngatacncctatcgctcgaaaaagtnccagtgtccaatctggagctggggcagcaggatagagaggatgctctagcttc

SEQ ID NO: 558920 - DNA, 552 bp, Homo sapiens
aacttcagccatctgttctgtcctttgaatttcatgtttgcaaggctcctatgttcatgtatgtataaatatatttgtgtgcccttctcctgttaatctgtctattttaagtttggtttatagaataaagttatcaaaccttcagaaaagggagggaaggaaattccttttgctcctacagtttaatattagtctttttgtaataaaaaaaatcctaatttttttttattgtaagcagaccttccctgtctgcttacaattttaatatttcaaggtggattttctcagactagaggtagaagcagcacagagctattatgctgatgattcacgtttttgactcttgggttacacatttatttaattatcatgatcaaatatttacttttgtggaagttccctgacgagaaggcttagttcttgccctctgagagctagagaaaaatctaacaaatctgatacaggttactttcccagatcctgtgtttgaatgctgtggaaagaaactactaggtatacccaaatattctagatgattaaaaaaaaagttca

SEQ ID NO: 558921 - DNA, 341 bp, Homo sapiens
tcagacagggcttccctttgttgcccaggctgaagtgcagtggtacaatcatagctcactgcagcctccagctcctgggctcaagcatcctcccacctcagcctcctgagtagttgggactacaggtatgtgtcaccacatctggctaatttgtaaatttttttgtagaggcaggggtctccctgttgctcagtcttgtctcgaacttctggcctcaagtgatcctcctgcctcaatcttccaaagtgctgaaattacagtcataagccaccttgcctggccttagttttttttttcttttcctttctttctttgtttctttgtttctttgtttctttctt

SEQ ID NO: 558922 - DNA, 242 bp, Homo sapiens
tctcgtcagataaaagcttcgctccacttaaagtggatgatttttaaatttgtttgtaaaacctttgatatttgactactaagaaattataagatccctatggacaggcaactaattttctacatttcctggttctttaaaaataaataattgtcataggtccttattaaagctctcagaattgtacttttgatttctaataaatgccaaaatatatcttatcaaatattaaaaaaaaaaaa

SEQ ID NO: 558923 - DNA, 170 bp, Homo sapiens
acttctattttactggttctgagagggaggatcacccagtggatcttttccctacactctccccaccaggctggtctcaaactcctggacttaagtgatcctccctcctcagctcccaaagtgttaggattgcaggcatgagccactgtgcctggcctcagctttgagtg

SEQ ID NO: 558924 - DNA, 336 bp, Homo sapiens
aggtgggccaggctggtctgaactccggacatcaaggggatcggccggcctgggcctctagaatttattttatttttatgatatagtgtaaagtcaggatctaacttttttccccaataaatagttttttaacacggtgtatggaaaattggtcctttcccggctaatggaaaaggcggcttttactatatgcggcattcttatgtatccctgatctgtttggggaagctggggagtcttctcgctggtctcattgcttctggtgatatcctaattgagtctcttagatcacagtcatggtcctgaaacacagatcatatcatacccctctccaga

SEQ ID NO: 558925 - DNA, 883 bp, Homo sapiens
gatgtggtgtcgcgcgccgattggggcagactgaaagagacgttggggtgtagaaaaagcggtgtttttacagcttagatggtggggagagtttgtttatgcgcaagccccctatttttggagtgaagagcgttgctttgaattagcggagaaagaaggtccatcgtaatgtagggccccccccgcgagtcttgtattttgcccaccccccccgtgcgtgcgcattcgatgtgcgtcctctccaagggggtttacagcccaccgacccttggaagagcaggcgttgaagacttgggccgccatgacaccatgagcggtgaaaacacttccccgtttgccaccaaggacgccactttttaatctcgcccccggccatgtccttccagcaacatgtttggaacagatcaagtgtgtcaacctccctcgtttttgaaaacaaaatatagttttctcattacgagaccattcctgaacaacctcattgttctgtcaaaaagttgagtaaaaactttgtactcgcggtctttcacacgattagtcggctctctcagcgtgcgaccccctcagattattaaacatcaccctcagatactaacccctttctcagccagactttggcagggaccccgaatcaagatggctctgtggcatcgacgaaagaacgacaattgtatagaagaggtgtacctccctggcgacggcaaagagtcaagccaggtccgcattcgcagcagggagggacccattttttactgtacccatatggatggagatatagtctgtgaccgtcgtctcgggacctggtacacccccccctgggtctttgccacaacaacatccacccggtaaggttaagtcccaaaaccatttttcagcagcccac

SEQ ID NO: 558926 - DNA, 162 bp, Homo sapiens
tatagagtcttctctgccttgactccagagcatgcttctatcctgagacttatatcttactgcagctgagctgaccctatcttacttacagtccccttcaatttgagagttttttttttttttttttttttttttttttctaaaaggggtgggtttaaagaa

SEQ ID NO: 558927 - DNA, 144 bp, Homo sapiens
gaatgaattcaggtttctatgtccagatttctcctgggctctggagagcatctcagtgcctgctgagagattcaattgaaggagttttgtttgtcttcctattggctccaggaatgaagtacagagtactaggtccactttatg

SEQ ID NO: 558928 - DNA, 90 bp, Homo sapiens
gacagcagcttctacatctgcagtgctagacaccctagccccggggtcggggagacccagtacttcgggccaggcacgcggctcctggtg

SEQ ID NO: 558929 - DNA, 220 bp, Homo sapiens
gaggatccgggtaccatggctctctctttcttttttttctttttcttggcggatgtgagagctgcctgagattcaaggtcatccggcagctcagtccccaccacctctgtctctggctccactgtggcatcttgctgtttttctttctcagtcttctcttagggagctgccagagctgcctggacctgagaattcattccttctggctgttgagaccccg

SEQ ID NO: 558930 - DNA, 325 bp, Homo sapiens
tcctgatctgctgtctcagaaaaaaacaaaaaagtatggcagtagccctgattgagggggtatggacttagagtaggattctaaaaggggagaaacagtgtaacttggtggattccagaaatattggtaagtggtaaaaagataagccttagggaactagggtggatctctaagttgggggcttacgtaccgggggggtggatagtccattttataagaagtgcggaaagacggggttaaaagcacaatttattttttttccctgaaggaggagatagtgtaaagtgaaagacaaccaaatgtgtgacaaatgtgtaccaatggg

SEQ ID NO: 558931 - DNA, 288 bp, Homo sapiens
gtttgcaattacagttgtctctaggtatccatgggggattggttccagaactccctgctgataacaaaattcatggatgctcaagcgccttacataacttggtgtagtatttgcgaataacctatgcacatcctcaagtatactttatatcatctctaaacatataatacttaatatgtaaatgctatgtaattagttgttattactgtatttagtgaataatgacaggaaaaaaaaaggcaaataaatgaattagggccataattatttctgttataataatcatga

SEQ ID NO: 558932 - DNA, 175 bp, Homo sapiens
cacaagcacgcaggtgtagttatatcagataaagtagactttaagcaacaatagtaaaaaaaaaaccaaagaaagtcattacataataattaaaggatcaatccaacaagaggatattacaatcctaaatttacatgccccataactctgagagctcccagaattcatcaaaaca

SEQ ID NO: 558933 - DNA, 81 bp, Homo sapiens
ggcagtttttgcttttattggtcaagaattctttacaaaacccacacacacatccacacacacacacacacatgatgcctg

SEQ ID NO: 558934 - DNA, 175 bp, Homo sapiens
tggttgatctagaggatcccattatggacgtaggatcattccaattacaggacctcgaaagagtcctgtatatgtaataaatacgtcactacctccccgggtcgggagtgggtaattatgcgcgcctgctgcctataccttaggatagtggtagcctgtttactcagtgctccct

SEQ ID NO: 558935 - DNA, 278 bp, Homo sapiens
gggggctgtaaaaacctaaattaatgggggtttggcctggtggttcctgttttggccataacttttcgaggggggcaggttccacccccctaaaggggaagcttcccgggccaaattggggggggggggggggaattttttcctttcccttttctcctttaatgggtttttagacatatcgggtccaggggtgggttctggggccttggattttgttttacaaaattattgggggtttttttttgttattacaccggtgggaggggcgggacccccca

SEQ ID NO: 558936 - DNA, 308 bp, Homo sapiens
tcccactaaaatataatgtgagaggattgcctgaggccaggagtttgagactagcctaggcaacatagtgagaacctgtcgctacaaataataataataataatcaaagctctcacctcaataacctaggaaaaaaatagcaaaataaatccaaagcaagcagaaggaaggaaataataaagataagaacagaaatccatgaaattagaaaccgaaaaacaatagagcaagccaatgaaacaaagggctggttctttgaaaagatcaataaaattacaaacctctagcaagactgacaaaaaaaaaaa

SEQ ID NO: 558937 - DNA, 201 bp, Homo sapiens
ctagaggatccacccaccgccagttgtactcgcttgcctttggagcactctagagacgcttaagtatcaggtggtgtccttttaaaatgttctagaatgactttactctgcatagaccggctaagtggattataacaccacatgtattttgtcttatgattctgcagatatgcagtacttttctctatctgattcagccat

SEQ ID NO: 558938 - DNA, 181 bp, Homo sapiens
atctggcatggctacctgtgagatgtgtgggaccgttggcgtccgagatgctttttactctaaacaaagcgtttctggagcgtttcatgttcaagaattactcgtaaaactccaagaaggcaagcatttctgccagacttcagggtaagcctccacaaagaagcaaaagttcttcagaaca

SEQ ID NO: 558939 - DNA, 190 bp, Homo sapiens
  misc_feature (61)..(61): n is a, c, g, or t
  misc_feature (70)..(70): n is a, c, g, or t
  misc_feature (85)..(85): n is a, c, g, or t
ttagaagttcaatagcaacggagtatgtgttcaaaggaatctccttccttttttgtgtgtntttcctttngtcccaatggggaanctaaatctgttttaattgcacagacacatggacaaaaagtcatttgtatctgccaagtgtggtaccttcctttgtttatttgctattgaaacttctaaaactagg

SEQ ID NO: 558940 - DNA, 1124 bp, Homo sapiens
  misc_feature (1124)..(1124): n is a, c, g, or t
ggggcgacggcggctgcggtggcctgaggaggccgacgcggcggcggtggctggcgatagtgccgaggcggattcttctcatcggcagtgctccaggtagccactaccaatcgatggagttagcctgtgaggaaactggcagaggcagtgtgcatggaccatgatcatcccctcgcgatgatgagcaaggcttcactccttccccacaaatcaaccgttgtcgcactctacagcccatgaatcggtcactttagccactggaccctcagggcgcacatggtaacaggaggccgagagtccgggaaccagtgtgaccggctgctggcccgtcgtccgaccgtcgatcgccctcgagcccatgtgcccccaaggcccgggcaccaatgaatgctcccgaagactcaggatgggcaatccatcgacatggacttgcgtattcaataggcctaggaactgatgtgtcgcatgcagacatgtgagccctcactgtcatcttctgtagagacgggtctacccgatacgcacacgtgccagctttcctgcagacgtcatggccgtggagctacgtcactggccggtactgcataatggacattctcgagcttgctggagtcggagagccaagcaagtagctagccactcgtcagccagatggcaggcacggagtccaaagagaaaggttggtgtccctcctgcttgtcccaacacttccccctggttcagaccaaggcaacacaggagggcccaaagtcaggagtacactgaagggctactgcagaaaagtgctcgggctactcaattcgcagagccaatgctattcatccggaggaggagtcgccagcgttgacgtttcctagtgcccctcgatccaccccagggctaccacacttggaagggacctggaaccgcaactgggcctactggagctgagtccaccttgggaagagcgggattggctagtcggcttccggatccccggcgagaagccgtccttaccattcacgttcaggctccagatgatcgaggggggccctgaaagagctaagcacctaggaaaggcagagacaggcttggcaggaaaaggctgcccccggacaattggaccgtgtcttccaaccattccn

SEQ ID NO: 558941 - DNA, 123 bp, Homo sapiens
ctcgaaaagctagagcggagaagtcgcttaggccgaagaatccgaactacgatagaccttagtaccgtagccgaaccgctacgctccgacctaaacggcgcgacggagccctatctcgggggg

SEQ ID NO: 558942 - DNA, 134 bp, Homo sapiens
ttgccacgctgtctagatggtctcaactcctggcgtattaacgcagtccgcccacctcgtcccttccaaagtgctgcgattaccgggatgaaccactgtgcccggccctccctaatttttgtatttcttgtaga

SEQ ID NO: 558943 - DNA, 340 bp, Homo sapiens
aggccggaatcccagcactttgggaggacgaggtaggatgatcacttgagggcaggagtttaagaccagcctggggagcatagctagaccctgtttctgccaaaaaagaaaaacattcatttgtaactgctgctaatcggagtgtatattcagggcagctccaatcaatgcttccaggtggccattctcaagtttgtggcttaaataaactctgtacttaatcatattttctgaatctcttaaggttagcatacgtatcaaggacagtaactaccatggctcccgaaggtttggccaaaccccggatgcgtggccttctggccaggcgtctgcgaaatca

SEQ ID NO: 558944 - DNA, 708 bp, Homo sapiens
atgtagagctggaacatgataagtatttgtgtgtctaaacatagaaaaggtattgtaaaaatactgggtaaaagattagattaaaaatgatatacctgtatagggcatttaccgtgaatgaatgcaccttacaggactagaagttgctttgggtgagtcagtgagcaagtggtgagtgaaggcctaggacattaccgtacactactatagactattaacactgtgcacttaggctacactaaagttataaaaatgttttttctttcttcaataataaataaccttagcttactataatttttttactttatacgtttttaaaatttaatgttttgacccttttgcagtaatacttagcttaaaacaaacacatacagctgtacaaaaatatttctttatattcttaatctataagcttttatctgtttttttttttaactttaaaactttctggttaaaaactaagacacacacacattagcttaggcctacacagggtcagaatcatcagtatcacggtctttcacttccacatcttatcccatgggaaggtcttcctgcatggagctgtcacttcctatcataacaatgccttcttcggaatatctccgtgaagaacctgtgctgaggcaattttacagttaacgtgtatatataagtagaaggcgaagtacatctaaaataatgatttacaatatagtatggtaa

SEQ ID NO: 558945 - DNA, 275 bp, Homo sapiens
aaaaaaaccccctttttgtgggggcatttggatttttttaggggggggaacccccaatgttggaccccgccgccccggtttgggaattttttttttttaaggggggttttttttttaatgggggtccccttttttgttttttttttttttgggtttttttttttttttgggggggggggggttcccgggttttgaatttttttttttttttccccatgggggggtttggggggggggtaaaaaaccccccctttttttttgggggtttgccccca

SEQ ID NO: 558946 - DNA, 553 bp, Homo sapiens
agcaggtacacggcctggaagccgagtggatttgcgatatatagagggaggctgacaggctggatggacagattctcgctgatgctgattgccgggggaagggaggccatggctgtgtcgagacgatcttcgatggttttgagtgcctcctttgaatcgcagattttctcttccagcaggatcatccaccaatctgaatacggatcatcctgctgggcgccacgtgacattcgattgactacagtgcagaagccagacaatccgatgatgccgaccttgagatcgttttttgggcgtcccatccagatccgtgcagcgtgatgcgtgtgaagggtgagcttcacatcgctgcgtagtgagccaatattgagccgataattgtcagccatggtgcagttattccttggaaagaggattgacatggccatgctgcaattgggctgctacggacgcagcaataaatccatagtcagacggaaggggatttgttgaggcgtctatatacagaaagagcctgggaggaccgactgcctgagttacattgtctttgtcg

SEQ ID NO: 558947 - DNA, 193 bp, Homo sapiens
  misc_feature (26)..(27): n is a, c, g, or t
  misc_feature (37)..(37): n is a, c, g, or t
  misc_feature (144)..(145): n is a, c, g, or t
  misc_feature (151)..(151): n is a, c, g, or t
  misc_feature (160)..(160): n is a, c, g, or t
  misc_feature (174)..(174): n is a, c, g, or t
  misc_feature (178)..(178): n is a, c, g, or t
agtccgtcattgctacgcgatattannccttccacgngcttcagcagtaggttcgttcgctaatcattcaggttgtagcgcttccacatacatcgtcgctgttgattccggcgcatcgtatagtacgttttcagattgttccanntttaangttaggggntttgacttcacgantggnctgcgttaaggcctg

SEQ ID NO: 558948 - DNA, 329 bp, Homo sapiens
ccttgatgtcctgcagaaacccgagcagggttcgtgtatcacgtggatcaatcagcccgtcgtcccacgggtttgcgctgccgtagagggcggtggactggctgtcgagtttctgtgcggtgacctgttcgagcatgtcgagcacattgggatcgggcaccaggccgtctttcagttgcttggaaagaggattgacatggccatgctgcaattgggctgctacggacgcagcaataaatccatagtcagacggaaggggatttgttgaggcgtctatatacagaaagagcctgggaggaccgactgcctgagttacattgtctttgtcg

SEQ ID NO: 558949 - DNA, 189 bp, Homo sapiens
ccaccacatttcatcatggccgcgtcaacaggcaccaagcacagttcaacagtgatttatgctggataagaagagcaggcagaatagacatacaaatggtgcaggcttctcaaaaccatcagtgaacgaggcagtgtggcaccagcacagggactacacaaacagataaagggcggagactggcgaacc

SEQ ID NO: 558950 - DNA, 940 bp, Homo sapiens
  misc_feature (662)..(662): n is a, c, g, or t
gttgaagcggggagcgcggggtcgtgtcccgctagaggctgcgcagtggtatgctcacatgcgttctgccgcgtgggttcctgtggtcccggtgcgacgtccagggacgatcggtcggtctcataggctgttggtcccggtggcaacgcaggcatctcctcgctcaaggtgctggtccctcgccgagtcggctgcggtgtgggcgggccgagagcacccaagtgtcggctcactggctgcggcgcactgagtggcaggaagggaaatcctagcgctcgggcgattctggagccgagaagcacggatgctgtgcattccatggggcacttgggaaggtggtcccatggaaggcttgtgtgcaatagttgcgaccgaagattgcgggtagccgcacccacttgggaagggaaaggggtcgttggactaccacgaccgatccttctcggtaagcgaaaccaggaggacctgactgtccggttgggtctctcgcggtgtaagaggaggacgaacgcacaaggtggcgtagccatggtaactctgaagtgcacacgccgcttgtaaacccactcgacatggtgccacatctacgtacccaagtagatgtactagtagcctactaggtaacttttattgatatctcgcacgggaacacatctaccaanacatgccactcggtgccccaattaggtgtcccgttagggaccaaattcgcggtgaggcacagtcgttcctatggtacgcctttcattaactgtcgtttcattgagaggcagtctaactcaactagaggaaatggagcttcccccttgggtagcatacctagagattgaaatccggagggtgccaatctcaaggcaagcgaggtaggctcgcaactcattagcagtaccgcgttgtttaattggttcccctttgcgcacgccctatggggacgcatgtg

SEQ ID NO: 558951 - DNA, 667 bp, Homo sapiens
tgggccagagcggcaagttaagtggaaatctcctaagggtaagtggggtgccaacgcaaaatcctactatcagagcggggtccagtaccggtaccgagagtggtgggttcacctgtgagatccagagagggccactccaggaggcaattttagaggtcctcaaagagggcagggggcggtcccaaaatctccgggtgagggagacggaggccgtcatccaacaagcaccgctcggccacctacggcgagcagctccgttgcagcagtgtgcaggccgtgccagccaaccagtgaccacgcgggtttcagccaccggaacaccctggtccccacctgagccagagtgtggtgggccttaaaatctcataaacagggcacctctgtgccagacagtgaagactggtgacagcacagattggtcctcctcgggacacctggcccgctcttcccggggactacacagcctcggaggggatccggcaggtaacggtgatggcacggtaacatcgagagggctcccaaacatcggccagcggattggaaactcaaaagtaagtcgaagcacgtcctcccgaagacattacagaacgcatctaagattaaagcgcatcagtgcgccagctggtcaggaacaaaggatgatcacggcaaggggccccacagaaga

SEQ ID NO: 558952 - DNA, 127 bp, Homo sapiens
tcagtgtagagattctgtcaatttctaagcatttccaactattcctgtgaaaattggaaataaacatgggatgggcttgggattctcattgtcttcagtcaggtgaattgaggttaaaactcccatt

SEQ ID NO: 558953 - DNA, 1209 bp, Homo sapiens
  misc_feature (929)..(929): n is a, c, g, or t
cttgaactcctgacctcgtgatctgcccgccttggcctcccaaagtactgggattacaggcgtgagccaccgtgcccaaccatgaaatatttttacttaaaaattgggaataagctcgctttttttttttttgaaatggattcttgctcctgttgtgcaggctgtagtgcagtggcacgatcttggctcactgcaacttccacctcccgggttcaagcaattctccttcttcagcctcccgagtagttgggattacaggcttgcaccaccacacctggctaattttggtgttctgagtaaagacggggtttcgctattttggccgggctggtttcaaactcctgtgacctcagttgatccacccgccttcagcctcccaaagtgttaggattacaggcttgaaccaccgtgcccggccaggaattaagcgttttgacttaccccaattgtcagaatagggcttgaactcttggggggattctactatttctatgtttttgttagaaacagtggaacttgtacgcatcgtgttgtagttccgaggccgtggatagctgccacatgtgggcacgctgtgcttctcacccggatagacctttgtggccctcgcgtgaattcacaaggcatgatgtctctcgcttgtgccagtattagctctttctccacaaaggtgtgccgtggggacactatcaccgagggtgttgtttaaatcccaacgttgttggcccccgtgcccccagaaattaggttgtaggaatctatattagagttggttaacaccacaccgcctaaaaacactatcaatcgttgttcgttattgaggttccaaaggaactatgcgggggttacaaattaaaagcttcttccacaatcttcttcaacaacattatttttgcgtcggaccagtgtggggggatacgcttgcacanacctcgtttggttcacattagcgcccaacataaaccggttggcgcaccccttgtgtgatgccgatttttgcagggacagacgtgtcttttcattacacaccaccggtcggtttcattagggggggcgaggtgttattcaccaccgacgacgcgggccttatgatctccaccaggaaacaagccgcccagatggagaaacaaccacttctgttgggggccaccgatgccttacacaggttgggtctccacgctctgtgtccgtggtatcagcccaacgcag

SEQ ID NO: 558954 - DNA, 223 bp, Homo sapiens
ccaccgaggactcatgaggccgtccactcaaccgtcctagcatcaatcctggatgcatcatacgcctccgtacggttattacctgctccagtgtcttactactttgaccgcgatgatgtggttttgaaaaatgttagccatatactttcttcaccaatctcactgagggagagggaacaggctgagaaactgagaagcttctgtgcggccggggtaccgagct

SEQ ID NO: 558955 - DNA, 515 bp, Homo sapiens
caccaccactctggcgcttctgggagggataggagcgtgacttatgcattccttccttccgaattgcacaggcatcatgggtcagaacaccatctgcgtatatgggggagggggcagataaaccaagcagggcccctgccctcagcagcaaggcacctccaactgccacacatcggtatgaaggcgccttaggccagggctgaatgtggctgggagagaggtgtcaaagaaggctgcaggggagaggcaacagggctgaaccagccagggaagatggcattttctctggccactacagtgtctagttcatccctagacaccaaagagcccgataatctctccatttcaccgatgcgccatcagccacgctccaagttgagtaagtgacaggcgcaggacagaaggcccactctggaatggtacccaggaggcctccttgctgtaattacctcttcgcaggccctgggcttttctggctcttgaatgagcctcgggagccctccccatgtcctcag

SEQ ID NO: 558956 - DNA, 1552 bp, Homo sapiens
  misc_feature (256)..(256): n is a, c, g, or t
  misc_feature (534)..(534): n is a, c, g, or t
  misc_feature (824)..(824): n is a, c, g, or t
  misc_feature (885)..(885): n is a, c, g, or t
  misc_feature (896)..(896): n is a, c, g, or t
  misc_feature (965)..(965): n is a, c, g, or t
  misc_feature (1085)..(1085): n is a, c, g, or t
  misc_feature (1285)..(1285): n is a, c, g, or t
atcgttgttgtgctgatgtgtgaggtgtagctgttggtttcgtgcgatggttggttggttgtttatgttctctgcatgtgtgtcgattgcttgtggctggttgtgctgtggttgttgtgtgctttaagttgtgctgtctgttgttggttttgtcgtgatgcttgtatctgtgtgtgtgtttgttggtgttgtgttcgcgccccctccctcctctcgctgctcgtgtgttttgtctctcccgcgcgcgtcccccagnggtgttatgtatgccccctgcattcgtccccccgctcgtttgtatggggggtgtttggccagcgaaagccgaccccacatcagccgcgcactttttttttaaggggggggcagcccccaccgcctgtgtgtgtagggggaatcctcgtctcggctcaagggggggttcttctcccccaacaccaagaagtggtggggcgcccacaagacaaaatacgccctctgacggccgtctttttgggttgttataaacccgcggtccctggccgctcctccccntgttgtatccttgatttgtttacccccggggggtctgctctaataaaaagggggtaatttccctcgaggaggcgggccccctcttgggggggttttgtgcccgccgagaaagaatttttctccggggccccaccgcggagggcccccccccccccccattatgtgtggtcgcccccggggaaatgtgctgcgcgctcccgaaatgggtcgcggggaccccccccaaaagggggatatagaaaggggatgaagcgcccccccccgcggataaataagtaggtttctctctntaggacgccgccctgttgttaaggaaagacacacatcgggggagatttggtgtgccccccntttggggcgcncacacataaatatatatcgcggattatatcttttatataaggagaaaaagaggttgtatatatatgtgngagacacacatctccaaagagggatataggggtgtacatcggtgtcgcccacaatagagaggataagccccccgccacacagagggtgtgcaccctacggcgccccaacacatctgggangagagagtgtgtcccacccacagaggtgtgtacacccacacacccacaccgtctgtgtggcgccatcattgtgtgggtggaacacccgcacccacgattttatagaggcccacgaatattctctgtcccacagagagagaatattatataggtggcgcttattgggagccccactcttaagccccctctcttaagagacnccgcgagaatatagagctcttcctcgtgaaacactgtgaagagagaaatagactccacggaaaaagaaaagaaagccccaagaagaaaaggtcacaccggggtctcaactaaagcgcgccccgcctgcgctcccacccccgagaagccacaccctttggggggaacacccaagggaagagagacctgagactgctgggacctattccctatggattcctggccataattaggggtttaaaaaaaaaattaaggacctttgggcttac

SEQ ID NO: 558957 - DNA, 144 bp, Homo sapiens
  misc_feature (5)..(5): n is a, c, g, or t
ggatncgctggagcagtacaactaggcttaatagggacatgtctgtacccccccactttagaaggccaaggcagaaggattgcttgaggccaggagttcaagaccagtctaagcaacatagcaagatgctgtctctacacaaaa

SEQ ID NO: 558958 - DNA, 601 bp, Homo sapiens
tcttggtggctcctgccccgggtgtctcgggcttgtgttgtgtccccgccgtggctgtggtgcgagagggccggagtgagttttggtcgtgtcccccgtggcttccgcaattggcttgctgcagtgtgggaggtgcgcgtcgtgtcttcgccgcgcacgccgttgcgtggctgtcgtgtttggtcgcgcaccctcctgtgtggtgaaacgggtggggggcgctgggttctcttctgtcagatatacaatgaccgcccacctctccacgcgttattgttcaataatagacaaatgtcgatcggctctcccgggtgagtatagcagactagtatgttatagtgtgtcgaacaaggaggttcaccccgccacgtctatgtggcggaggtggtgctccctcggcttatgtgtgccaggagtcacaaaacatcaatgtgttctactttcagggccgccgcggcgtatttggctcgtcgagcggagtttcattgctcgttcttacactcctcatcagcaataggaataagttcatcaacatcaaaatacacaggacaggaaagaaaacagtgaaataaaaacaacagcccgacaaagacgcgaagac

SEQ ID NO: 558959 - DNA, 373 bp, Homo sapiens
gcttcttttactggtccaatgaagtagattctctactaccatccagacgctgtgtggctttttcgcgtgtgaactgagcagttattttcttttcctgctcacacctttaaaatcctcttcctccttctgccccctaaatcttgaaggtttgcttttgagatgtacttgtaccgtgagtaattagcctgttaccaagatattaattaacatgttggaaatgttttctttattaatgagaaattcacacattctctttaaattaatttgtatagtttgaaattaatttctcgtggcctttgatgacctccaatctactaagacaaaacccggagtattgtactaacggttaaaccattcattaaacattttatgc

SEQ ID NO: 558960 - DNA, 265 bp, Homo sapiens
cagaggatccggaaaatagcgaggtcctttttcagcaaaaagaaaaaaaggcagtgggagtcaatttggaggagacatgaaagaaaatgttggcagaggctaagtaggtgtgcatatgcaaatgggctggttgaatctaaggtaactggaacatataagtgggacatataaaggaaaaatgaatacatatggcacttaacaagctttcaaacgacaaaaatttcaaacatccctaaggatagtcattttccctcgtccggctaaa

SEQ ID NO: 558961 - DNA, 687 bp, Homo sapiens
agttcttcttcttctggggcctccacgagtctgtggtgagcaccagtcggaggacggagaccggggcagtgcccggaacagcctgtacatgttccaccccatctcctgccgcggcgtgctgcatggagcatggcccagtggttgtcctacccacaatttgttcgccctttgacctgccctgtccgtgttattgacgccagacgctcgctcactgctctgtccctacagtcctttcattgatacatgtgaccccgtgtcaggagtcgtcacagactgtgcgaaccccgagacccgtggtctcttcgatagatgcacgtcacactgtcacacaaccgggtgtcggtgtgaaacccgatttggtgtgccgcgagtggggcaagggcgatagtggtggataggggtgccctgacatcttggtggcgcttgtaggggcggatcgccgtgtccctaagggaacccatgtttggcagtggcggagacgccggccaatttccgtagggggggtgggaccccccggggtggttgtccccttcacgtctcgtcgccgttgggcccggaggcttcactcctctgtggaggggttggccacggggggcggtcgtgtgtggaggggacgggacacgacccccctggcccccgagggagaccctgtggtttgtcgtcgcgtcacgtcaccttcccctggca

SEQ ID NO: 558962 - DNA, 383 bp, Homo sapiens
  misc_feature (116)..(117): n is a, c, g, or t
  misc_feature (221)..(221): n is a, c, g, or t
caatgatggtaagattctggagaaaaaatgtctgggtttgaactccagtgtttctacttattacctgtggactatggacgagttatcctgatgggagcaagatggcgcatcttgcnnccatcaggtctgtattcacattgtatcaactgtccccttaaagtcctttatagctgtttgtgcctttcctgtgccggattgactcttacatcacacgctgcgtncggttttcatgctgcttcactccctttaacctgaaacaatgcccgtgccttgtgtatgtctcaccaccaagccgtttgtgaaaacataagcccttgtttggaaagtctctgaattgagtttggctgatatttccccagcatttgctgatgggagaagatgcg

SEQ ID NO: 558963 - DNA, 158 bp, Homo sapiens
gcggcgtcaataccctgatacaccacaacatgagattgcacagggaggaaaagacaaactttcagctgctttttcttaaagtacttaaaaggaattgttgtattttattacatttatattttgtacatatgtagggtcagcatttttatgatctcgat

SEQ ID NO: 558964 - DNA, 147 bp, Homo sapiens
attagagagacaagagacagcagttggcagacagcaagagacggtgaagcagcctgtgatatgaggatagcggtgaaacttgagtggacagccacgtgtacactagtacacgctgcctacgctgtgggaccccactgctactaaacg

SEQ ID NO: 558965 - DNA, 643 bp, Homo sapiens
tctgcaagtgtccatcttccaaggggccccttgacccggatcgcagggatggccatgtaacagagtggcagtgtggcggtcatggtcagttgcaaaggccttgcctcggggcccccatcacttgataaacaagaaatgccattgcctgtgaattctcccttggggagcgatccaaggaaaatggtctatcaggagagcccgcaagatccttccagttggcccctgggggggatggcctccctccctgaagcaagtggcagtgaagccccatttgtcccaggggggccaaacaacatgccttcccatgtgggctttccccagaatcggttaatgatggcagggccaaaacctgggccttggcccctttcagcaactcaggggggaactccccagcaaccccctgtaaattccctggccagtttttaggggcaccatttcccaaatgtgggggggcccaccccggacttttgggcccaaaaccccaaacagggccggccccaggcccttttttcctcagacccccaacaaccgccctcccgggccagaaccttcagaaatcggtttgtccccagaaaggctcaatgcctccataggggggtttttccctccccggattaattttcctttcccccctttagggcca

SEQ ID NO: 558966 - DNA, 488 bp, Homo sapiens
  misc_feature (150)..(150): n is a, c, g, or t
  misc_feature (174)..(174): n is a, c, g, or t
  misc_feature (185)..(185): n is a, c, g, or t
  misc_feature (195)..(195): n is a, c, g, or t
  misc_feature (199)..(199): n is a, c, g, or t
  misc_feature (246)..(246): n is a, c, g, or t
  misc_feature (253)..(253): n is a, c, g, or t
  misc_feature (255)..(255): n is a, c, g, or t
  misc_feature (280)..(280): n is a, c, g, or t
  misc_feature (445)..(445): n is a, c, g, or t
  misc_feature (448)..(448): n is a, c, g, or t
ggtacctccagaactgcttcaactctcagactcgcttcagactctccagactgcctcagactcctgagtagctgggactacaggtgcgcaccaccacacccagctaattttgatgtggtatttttagtagagacggggtttcaccatatnggcaggcggtctccaatcctgacntcatgatccgnccgcctcganctcncaaagtgctgggattacaggcatgagccaccacacccggcaattttngtatttntngtagagacgggggtcttgctatgtngtccaggctggtctcgaactcctgacctcaagtgatccacccacctcggcctcccaaagtgcagggattacaggcatgagccacctcgcctggcacccctcaccttctgaaaggagacagacatgccaagaggaagtttacaagctcctcgggctgccctgtctngtnttctggaactgtcttggtgtgagtctgaaggcagtctgga

SEQ ID NO: 558967 - DNA, 629 bp, Homo sapiens
tcatgcgagctcatcagtttgaaaaaaagaccctcaaacaatccgtgtatccatattggagtggaactccatacctcacatcctccctgccgttgcccacaaatagctcaagatgagctgagctccttgagcatagaacggcactgacagagcaaaaggcgtactacatgcatcagcacccaacactgacccaacacatcacaaacactacccacacacaaatagcacactagagcacgcaacgagaacgaatcgccacaacacccggcataacccccacaagccgtgctactcacacaggccacgtggcctaacaacgagctcctgacactacaccaacatacgacacccctcaacgctacaccccacagcctcaccacggcaaccaaaccaaccaaatgagctagactaacagctatcactcgaccccccaaaaaatcaccacccaccacacacatccaccattccccaaaaccaaacccaactccaataaccccaaaaaccatatagcaaccatacatagcacacacacaaccatactaccctcaaccaccttctaccaccacacaccacatcccacccattagcaccctaccacaacacctaccacattaacaaacacaatcaag

SEQ ID NO: 558968 - DNA, 711 bp, Homo sapiens
  misc_feature (690)..(690): n is a, c, g, or t
gtggtcagagaaggggttttctcagcaactagactggtccgtgacatgcttaactaggccagacaagcgacttgttacactagtaatgttccatgagaaaaccatagtccatttagtggggaagggtatccccttaatgactcagatctatactggcttaaaattgggtcagcgagttgcgataatacctcaaaaagccgtcctataagccgaaaagactagccggagaagggcctacgtatagtgactaagcaatgctagtactctcactacacctgctacggtagtctgcgccttataacacctcttgcagggagacgtgaactcgtagcaccaaagtacctcggctttattagactctacataggaacttctcaccataattgaagatggtataaacatgggaccactacagcgctaaagcggccaatatgcttgccctgcaagaacgatcaacagtgtgttaagcttgagctttgttacagaaaatgaggtagggtgcggtggctcacatctgtaatctcagcagtttgggaggccaaggcaggcgcatcagtctgtaggtcaagagtttgagaccagcctggtcaataatgatgaaatcccgcatcgtatacccaaaataccaaaattagctgggcattggtggcacacgcccggtatacccaagctactcaggaggtgataacntcgagcactaatcccccgtga

SEQ ID NO: 558969 - DNA, 1425 bp, Homo sapiens
  misc_feature (1140)..(1140): n is a, c, g, or t
  misc_feature (1148)..(1148): n is a, c, g, or t
gacgcatgtgtacgcttcgtgtgtccgtgtattgcttccgttcttcacggtaccgggttggcccgagatcggtctgcgcaggaaggagcgccacgtatgcccatggtcagtacagcgcccacataatgctgacaacacgggtcgacttgcccatatagagtctcaatgaattccgacgtaggcgtgaaacggtccagcacactggagtgtaccaccataccggtggcagcaacgcatgtactcggagcttgagagcagtttgaatgtctgcaaacacaattggacatgtccacgtgcaaatcgactgcgtcatttgcgatgcgtgataacgcagtgggggcaccacgttcatgtaccccagatgtgctgatgcaaacgactgatatgcaattgcgagacctgacgttagacagatccatgtgacaccttgacctgttgattgcgacatgcaagtaagtgaaacccctacaacgatccttcaactttagcaccatctttaactcggagaggttaactgggaggtggaccgtgaatggaacggcatattccaccaagggaatcctcgctaggttaggccaaccttgggcgcgaccaaggatataaacggcggttttgggcaatgtcgcttaggatccccacgccagtccttgttctttagcccggggggcgcgccgaaaatggccgtggttcgttgacctccttaaaggcggatccaattctgttccacattgggggggtatctgccctccggttagggcacactttctgctggaattaaaccctggaggcggtctttcccatttgtcgaacaccgtgtggggcgcgaaaggggtgtttgccagattccttagggccaggaggacaccgtgtgctttgggggaattgggctttgggcgacacggcggaacacacgcgtggcaacggaacgcgagacctctcctttccttaataggagaagttcgccaagcgggcgcgtggcgcaaattagaaacttagagacccccctttatcgatactagaagcgagaataggtatggaataggggtgtgaagcggaacacttgtaaagggaagatggcagatttggtttgggggggctgtgggggaaacggtttaaaatataaggcgcaattatggcaanattccatntgggccaaatctggggcgtggacgatgcggagcatacactttttaagagaaggcccacaggacaggaggcggagaattcgtggaaaccgttgtttcgccgcaaatttggcacattttcgcagcgcaatattgaattttgtatccaattccgttgcgacatttccgggtttcggaaacatgggcctatcggaaatactaggacgggtatgacccaagaaactaattatagcacacttagaagtgtttagaaacccgtggaatggatatctctgcgacg

SEQ ID NO: 558970 - DNA, 193 bp, Homo sapiens
aagtgtacagcatggatccatggagtacttgcagatagatacgagtttaaaacatttaataatttcccctatgaatgtagcttaagatcattattctctctcatatttctatatctttctactttttttgtcatttgagtcatggttgttgcggtcgtcgtcttcttcttttaaaaaagaagatctaactttc

SEQ ID NO: 558971 - DNA, 105 bp, Homo sapiens
agcatcctctgagaatcgggacaaatgggagagggggaagagttggagtgtgatgaagaactaggaggagctcaagagctgagaggtctagttccacttatattg

SEQ ID NO: 558972 - DNA, 453 bp, Homo sapiens
gttagaaagataaatgtttaaggtagcagatatcccagttaccctgattgatcatcacacatgtacgaatgtatcagaatatcagatgtactccaaaatatgtacatctatttggtttcaataaaaaaaacaggccaggcatagtggctcatgcctgtgatctcagcacttggggaggcctaggtgggcagatcacttgagtgcaggaattcaagaccagccggggaaacatggagaaaccccaccgggagtggtgttgcgcacctgtagtcccagctactcaggaggctgaggtgaaagaatcgcttgagctcggaaggcaagggttgcagtgggctgagatctggccagggcactccatccggggagacaagagagagactctccatctcaaataaaaaaaaaaataaaaggttcgggctatgggtctctggcctgtgccccgcgcttttg

SEQ ID NO: 558973 - DNA, 169 bp, Homo sapiens
acctactgtgaggctcacacaaatatagtcaactgactttttgacaggaagcaaacgcaatacaatggagaaaagacagtcttggctggggcagtggctcatgcctgtaatcccagcactttgggaggccaaagaggaaggatcacttaagtccaggagttcgagggag

SEQ ID NO: 558974 - DNA, 161 bp, Homo sapiens
aatacagtttcagtggggcaagcatgcaaaaagtctggcagcatgcactggtggtgttgcttgcacaatgatgtgctgttcttaatgccatagaatgtacacttcgtacatggctagtgcttacttcaggagcacgtgcactaaaattggacatgctacag

SEQ ID NO: 558975 - DNA, 840 bp, Homo sapiens
  misc_feature (135)..(135): n is a, c, g, or t
  misc_feature (143)..(144): n is a, c, g, or t
  misc_feature (157)..(157): n is a, c, g, or t
aggaaaaacatggattcagcttagactgaggaaaactctccattatgttgtaagaaattatagatgttttgagagacactttttgttaaaccagatattgaactccagcacactattgttggttattatttttangttcattnngttctcatttagnatgctaaatatttcctttatatttgctttaatagattttcttttttttctttttttttttataagaacgggagtctcgcctcgtgtttgccaggcttggagggcaggtggccacgatctggggctttcgtgcaacctctggcctcccagggttcaagcggattctcctgggttcagccttccgagtagctggggactacagggcggcttgccaccatggcccagctaattttgggtgattttaagtaaagacgggggtttcaccacgtgggccaggatgggttcagatctcctgacctcgggatcctcctgggctaatcctcccaaaaggcggggattacagggcttaagccaccggtgcctggcctctttaataatttttaaaataccctaaagggctggtgaatttttccaaggtctacggagtaaatcaggtatggccggggacattggatagccatgggtcagataccgggatttaacgcgggggtagacaggcgggaccctagggttgccaggtgtacagggggcatccataggccttcaccagaaataacctggggacgggtgccagaaactagaagtctacaatctctcactgctaagcagagctgtcaacggacatacggggtaatgcataaatagccggatgtacctataaaagcccttaaattaaaccattgg

SEQ ID NO: 558976 - DNA, 230 bp, Homo sapiens
  misc_feature (15)..(17): n is a, c, g, or t
  misc_feature (64)..(64): n is a, c, g, or t
  misc_feature (103)..(103): n is a, c, g, or t
  misc_feature (164)..(164): n is a, c, g, or t
  misc_feature (170)..(170): n is a, c, g, or t
  misc_feature (193)..(193): n is a, c, g, or t
  misc_feature (212)..(212): n is a, c, g, or t
  misc_feature (216)..(216): n is a, c, g, or t
  misc_feature (219)..(219): n is a, c, g, or t
  misc_feature (224)..(224): n is a, c, g, or t
agtgcggggtttggnnnattctgggacttgtaaggttcagggcgtgtgtccctggaccgggagnaccagtccccgaaagatggggagttgagtggcccagatngatacttggaccaaagaagctgaaatgacttcagagcagaaaaacttcctgctgctctctnttctcnataaaaccgtgtttacccatatntttgtgtgccccccatttngcancanggtcnctcaat

SEQ ID NO: 558977 - DNA, 149 bp, Homo sapiens
aaccatagaacagcatcatgtgggaaaagagcatatcgttgagattggaattatggtgctcttacatcagatgaagtgtagagagtactcatcacagggctgacacactgtagtcttctcaatagtatgttcgtttccctactggtgat

SEQ ID NO: 558978 - DNA, 495 bp, Homo sapiens
  misc_feature (8)..(8): n is a, c, g, or t
  misc_feature (61)..(61): n is a, c, g, or t
  misc_feature (93)..(93): n is a, c, g, or t
  misc_feature (98)..(98): n is a, c, g, or t
  misc_feature (146)..(146): n is a, c, g, or t
  misc_feature (152)..(152): n is a, c, g, or t
  misc_feature (159)..(159): n is a, c, g, or t
  misc_feature (165)..(165): n is a, c, g, or t
  misc_feature (175)..(176): n is a, c, g, or t
  misc_feature (187)..(187): n is a, c, g, or t
  misc_feature (203)..(203): n is a, c, g, or t
  misc_feature (207)..(207): n is a, c, g, or t
  misc_feature (213)..(213): n is a, c, g, or t
  misc_feature (217)..(217): n is a, c, g, or t
  misc_feature (278)..(278): n is a, c, g, or t
  misc_feature (282)..(282): n is a, c, g, or t
  misc_feature (285)..(285): n is a, c, g, or t
  misc_feature (294)..(294): n is a, c, g, or t
  misc_feature (326)..(326): n is a, c, g, or t
  misc_feature (328)..(328): n is a, c, g, or t
  misc_feature (348)..(348): n is a, c, g, or t
  misc_feature (369)..(369): n is a, c, g, or t
  misc_feature (387)..(387): n is a, c, g, or t
  misc_feature (420)..(420): n is a, c, g, or t
  misc_feature (426)..(426): n is a, c, g, or t
  misc_feature (492)..(492): n is a, c, g, or t
tgtttttnaacttgacaatcattacactaaaacagatttgataatcttattcacagttgtnattgtttacagaccatttacttcatatttccnctgtntattcctcctctccctccccttgcctggctcacccctctctgtctgtnaccctnccggccncgggcnccttgtctcnntgttgtctggngtcttactcgtctggngggntttggntggntgctgctggtgtctgcgggtgggctggggggggggtcctggctgggggggggggggtctgnctcntcnggtgcttgngccggctcttcttcctgctggctttcggtttntnggcctgcttctggacttatnccttcaggttctgcctccgcngattcttcttctccctcntcacctgttgctgtttcgtttgttgtgggtttngtgccngtgggtgttgtcgccattgggacaggttggggggcgtgttccggagcatcaggggtggtgctctcngtg

SEQ ID NO: 558979 - DNA, 281 bp, Homo sapiens
atttttgactcatttcttttccattgtgtggcttacaaaagttaccgtgaggctgggtaattcataaagaaaagaggtttattgggtttctaaaggctatacaagcacagtgccaacatctgcttctggtgagggcctcaagctacctccactaatagcagaaggaaaaggggagccagtgtgtgcagagatcagatggcgagacaggaaaataaaagagggtgctgccgggctgttttaccagctctcatgggaactaacagagagagaactcactcaca

SEQ ID NO: 558980 - DNA, 171 bp, Homo sapiens
ctagaactcctggactcaagcaatctgcctgcctctgcctcccaaagtgctgggactacaggcatgggccatcatgcttggcttcttttttttttttggaggtttggatggttgtgggtgaagtgggtggagaggggaactaccatttatttatggagtgtagaatttgaa

SEQ ID NO: 558981 - DNA, 422 bp, Homo sapiens
ggacctcactccacagcgtgcgcgcaggtgccacatcgatggggcgtggtgtgtttcctccgaaaacagcagggattctcgcgactcatgatccccatatgggttagtagtcagaggtgctgttacgtgagggatgtcgtcggtgctgtatccgccgttctttcgagcgccgccagtaagggtgccggcaacatctttcccctggcctcggcgcggcgcagtatcccggcgcacgccttcgcgctcaagaagtacctcggtgggatcgaacccgtctcgagcacttgcgacaacgaacacacgacggcgtcgttgggccaggccgaaatattgggcgtccaggacccgccacgcgattgttcttttgggtccatacacacaaccagcgtcctgccatttcttccctggctggtggaagggag

SEQ ID NO: 558982 - DNA, 385 bp, Homo sapiens
cgaccagctcgagcagctcggcgtcgtcaaccatgtcggccttgttcaggaacacgacgatgtacggcacgccgacctgacgcgacagcaggatgtgctcgcgggtctgcggcatcgggccgtcagcggccgagcacaccaggatcgcgccgtccatctgggcagcaccggtgatcatgttcttgacgtagtcagcatggcccgggcaatcgacgtgggcgtagtgacggaccggggattcgtattcgacgtgcgcggtcgagatcgtgatgccacgagccttttcttccggcgcggcgtcgatcgaggagtagtccttgaactcgccaccgaagcgctcggcaccgatcttggtcagtgcggcggtcagcgtggtcttgccgtg

SEQ ID NO: 558983 - DNA, 410 bp, Homo sapiens
  misc_feature (12)..(12): n is a, c, g, or t
gggggggggggntttttttgggtccccctcttgaattgggaaatccggtcctgacagtaatgaggcccctgctctaaagtagtttatacagtttttcagttggataaatagcccagagtagtttttgaaaggttaagaaaaataagtgaaaagacatacccgatatatgaaatggctcccaatgataattggtccaacccttataaaatggggttttggactcttatgctgccaaagggactttttaaaactcttctcgttttgggtttataagccccccccggaggtttgacagatgggcttggttttactacagagccaaagaatttgccccttagctatatgtgaaggatattattttaaccaattcctggttttaataaaggttttttttttcctggaaaaaaaaa

SEQ ID NO: 558984 - DNA, 488 bp, Homo sapiens
agcaaataaaagataaagaggcactccagccaccctggttcacgcgattctcctgctcagcctcccgagtagctgggactacaggcacatgcaaccacgtctggctactgttctcgagttttagtagagactgggtctcgttatgtagtccaggctggtctcgaactcctgtctcacgcgtctgtgtgaagagaccaccaaacatgctttgtgtgagcaacatggctgtgtatttcacctgggtgcaggcgggctgagtccgaaaaaggagtcaacaaagggtggtgtgattatcactggttcttatagatttgggactaggcggtggagttaagagcagtgttttgggggcaggaggtggatctcataaagtacattgtcacaggtgaggagaattacaaagaaacttcttaagggtgggggagatgataaagaaccttcttaagagtggggcagattacaaagtacactgatctatagaagtggtg

SEQ ID NO: 558985 - DNA, 175 bp, Homo sapiens
cactgtacttatgctctccacattgttgagttactgtagctttgtagtacgttttcaacatcgaaagtgtgacttctccagactttattctttttcaagatagttttgactattatgcggctctttgagattccatatgaattttaggatgggttttacctattatatttttttt

SEQ ID NO: 558986 - DNA, 587 bp, Homo sapiens
  misc_feature (501)..(501): n is a, c, g, or t
  misc_feature (506)..(506): n is a, c, g, or t
aaaagaaaaggtcaggctgtttaaaaatgaaaacagtcgcaaaacagaccctggaaacacggaaatggcgtgttctggaggcttaaaagaggaccattggcccataagccatatcgccaaaaggaaataaagcaacaaaggtgcccagatcataggaaaaagctttttacagtctcattgaatcccattaaaaaatatttagctaaagagcaccaatagagtaaaaagggaaataaaaaaaatagggcccatataatatagaatgaaaaatagcctaaatcacaagcacagcgtgggtaaacatacataaatccaagcattgaccactgaagccctagtataccaaaaccccagtaccaataagtcccccaagagtctacaagtaggatcctaaacaccatcctctaacaaaagaaaccaggcctctctggaggagaagtcgattccagggcagggacaaggaaaacacaagagcctggtggtgaaaaaaaaaaagaaagncaaancggcgcggggtggggtatcacagtggctgcctcgtggcgccctggggctctgacttcccacagcacaacaggcctcgtgca

SEQ ID NO: 558987 - DNA, 601 bp, Homo sapiens
  misc_feature (5)..(5): n is a, c, g, or t
  misc_feature (7)..(8): n is a, c, g, or t
  misc_feature (10)..(10): n is a, c, g, or t
  misc_feature (13)..(13): n is a, c, g, or t
  misc_feature (18)..(20): n is a, c, g, or t
  misc_feature (22)..(23): n is a, c, g, or t
  misc_feature (29)..(29): n is a, c, g, or t
  misc_feature (87)..(90): n is a, c, g, or t
  misc_feature (127)..(127): n is a, c, g, or t
  misc_feature (158)..(158): n is a, c, g, or t
  misc_feature (161)..(161): n is a, c, g, or t
  misc_feature (166)..(166): n is a, c, g, or t
  misc_feature (188)..(188): n is a, c, g, or t
  misc_feature (190)..(190): n is a, c, g, or t
  misc_feature (207)..(207): n is a, c, g, or t
  misc_feature (239)..(239): n is a, c, g, or t
  misc_feature (247)..(247): n is a, c, g, or t
  misc_feature (258)..(258): n is a, c, g, or t
  misc_feature (279)..(279): n is a, c, g, or t
  misc_feature (288)..(289): n is a, c, g, or t
  misc_feature (293)..(293): n is a, c, g, or t
  misc_feature (311)..(311): n is a, c, g, or t
  misc_feature (328)..(328): n is a, c, g, or t
  misc_feature (333)..(334): n is a, c, g, or t
  misc_feature (346)..(346): n is a, c, g, or t
  misc_feature (383)..(383): n is a, c, g, or t
ttcanannanaanaaaannnannaattanaaaaaaaaaaaaaaaaaaaaaaaaaaaaaaaaaaaaaaaaaaaaaaaaaaaaaaaaannnnaaaaaaaaaaaaaaaaaaaaaaaaaaaaccttgtggnccgcttgggcccagtcgattttaaactgggncangtttntgcttggggccgaatttggggntnattgggccaattccccntatggggggccgttttacaattaatgggccgnggtttaanaacgtgggaangggaaaaccctggggttcccnaattaaatnncttngaagaaaatccccttttncccagttggggtaatancaaannggcccgacccgntggcctttccaaacagttgcccaccctaaagggcaangggaaattgaaggcgtaaatatttggtaaaaatccgggtaaaattttggtaaaaccagctaatttttaacccaatgggccgaattgggaaaaaccccttataattcaaaggaataccccgaaatggggttgagggttgttccatttgggaacaaggatccccttttaaagaccggggactccaacgtgggcatttttggggtcaaggcgcttggcctt

SEQ ID NO: 558988 - DNA, 1184 bp, Homo sapiens
ggaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgacggatgaacggcagttactgggagaatttgagacaggaactggaaggggatcctgcttccgtcagaccgagaccggctccgttcggcacgtgacaccgctggcatggcagcgggcacactggaaccacatcatccaggagacagacgaaagcagctggacccagactgggcctgaccgacgggacgtcacgagccgggatcggcgccaatgcctggcctctcacagtccactctcaaacaaactcatcacaaagactggaggcaaacacagagtccagagctggtgaagaagcacaagaacacacacgagggtcgtccccaaaaagcctcccccatcaccccaacctacagaggaggatcctgaggcaccagagtccgggtccgggtcaccaagctccgtctcgcgagggtcctacctcaggatctgaactgtccctcggacgatgacaccgggcaacaacccacagctgaacacaacactcgacggtggctcggtgcacggacgctgctggacgacggggacggacctccagcagctgtcgcggaaacatttgcgcatcacaagtcgttccgcccccatggcggcttgacagggacgtggaagccacgggggccgctatggcgtgaaccggacgacggacacctgaagacaccgtccacggaagacccccagccgctacaacaagggcagcccggcagtctgagaacaaggccagtcaaggaccaggcagccggccaacacaagcggcagagcaacacaaccgacgcgagcactgcacggcgacctactacaaggtcgtggtagcggggaaacagggaagccgacacgaaacttgctacactccaaaaaaccaaaacacacaatccaacccatcccacagcacgcagacaaactagcacaagagcagcccacacccagaccacaaccgaagaacacgggggcaacaagaaagagaatcgcaaaagcgtacgagcaaccgaagcacgaagcaacgagacaaaaccccatagacgacag

SEQ ID NO: 558989 - DNA, 1739 bp, Homo sapiens
  misc_feature (836)..(836): n is a, c, g, or t
  misc_feature (1362)..(1362): n is a, c, g, or t
tggtaaaggggctgatccggttaattgggcaggaaaacgagaacaatccagcagcccagggagggaacggggggactttatctcctctcctctccttcggtcggtctctccagagccccaagccccaaccctgtggccctttcttgtggatttctttcctctctttcaacgcgggcccggggcgggccaaccccccggtagtggagaagccgcagagagagagaaagtctcgagtggtgctctcgtgggaaactccgagggcggcacaagtgaaagggagcgggaagtgttctccaccaaccgtggctgtggcggaacccgtggattagtgggcgcgtgggcggaactcagaaagcgcgaagcgcggtggtgtggatgtggaactgtgtggcccaaagcccccgagactctggaaacgcacctgtgggactctgtggagaggagcgtgtcttctctctatagagaagacattcgcctctatattcctttacgagggccccgagagatctgggtaatctcacaagagcttttacaaatcttttgggcgccctttcaatatccacagagaaacgccgacaaaattggcgggggaacacattgcgccgtggcgcgagaaaaagcacagtgggggccgtgtttagcggcccttttcagagaaacaaagagaacgcggccgggggggaggggatcaccacttatccatccactaactcaacaaagaagggactgttccacacaaggaacgaacgattataccccgcagcagagggggcaggaggggggaccgcccataactgaggacgggagggagaaaaattatccgtatggtggggagncgcaccgaagggtgcgctgacttacacacaacatatctctgttgtggacgaacccgccttcctttgcacacaaaggaaaaaccctccttacaacaaagcgatgtcttatgtgtggtgtgaaaaccgccggagagggagaagcaccccacaaatattgaaatcatccacggccgcgcaccgagagcaagatcacaaaaagagcacatccaccacaagcagacactaccctgaggagggaggtccccacgaaaccgaaccgcgaggagagaaatacttctcagcctccccaacagagaagaaggggcgaggttccacacaaccagcggaggggaggaagggctcacaccccagcaaataacacgagtgtctctctgggggcggacaaacacaaaaaaacaccaccgaatgagcgtccccccggcgggggcccacaacgtctggggggccatatgctgcggcgggccaccacagcggagtatacaccccccgccggttgtatgtagggggcgcccctataaaagagggnaagcacaaccccacccatctgttacggggggagagaagcgcggcggtcgccacaaaaaaagcggtcgcggcgggagataataaaccccccgtacgaagggttcgagcgcagacgaacacaaccaacgagcggggagaaaacagaaccacacacaagaagcgaagcgcgacgtaggacgcaccgcggggcgcgagcagcgaaaggaagacggccacaacattgccgagagaaggcacctcgtgtggagaaaaccgacacggggaggagacaaaacatcatgcgggcctcggtggttcggaacaacacacatatcaatggatgcgccgaacgagaagagcacatgcatatctagccaacgaagcgagagaaaactccac

SEQ ID NO: 558990 - DNA, 363 bp, Homo sapiens
tctccagccctcctagggaagcctcttttaaaatgaggctgggctggccgggcgtggtggctcacgcctgtaatcccagcactttgggaggccgaggcgggcagatcaccgtgtcaggagtttgagaccagcctggtgaacatggtgaaaccccatctctactaaaaatacaaaaattagctgggcgtggtggcaggtgcctgtaaccccagctactagggaggatgaggcaggagaatcgcttgaacccgggaggcggaggttgcagtgagccgagattgcgccattgcactccagcatgtgtgacagggtgagactccatctcaaaaataaataaataaataaataaataaataaataaat

SEQ ID NO: 558991 - DNA, 167 bp, Homo sapiens
catccatgctaaccgagtatttggaggtcagcactggtgctcactgtgtcgacggaacttgtacatgggaggcatgcaccgacacgtggtgaatacactgtcgaccagtgctccagtgttatacgatattgtggacggtcatgcacgtgtgctcactgtgtctgacg

SEQ ID NO: 558992 - DNA, 335 bp, Homo sapiens
  misc_feature (21)..(21): n is a, c, g, or t
  misc_feature (32)..(32): n is a, c, g, or t
ccccatagaggtctgggattncctggaatatnatatgaaaaacattttttaggctggttgtggggctcacacctgtaatcccagcactttgggaggctgaggcgggcggatcacctgaggttgggagctcgagaccagcctgaccaatgtgaagaaaccccgtctctactaaaaaaaatacaaaattagcctggtgtggtggcgcatgcctgtaatcccggctactcaggaggcggaggcaggagaatcacttgaacccgggaggcaggttgcggtgagacgagatcacgccattgcactccagcctgggcaaaaagagctaaaaactccatctc

SEQ ID NO: 558993 - DNA, 359 bp, Homo sapiens
tcggccaacgtattatacacggcgaccactatactggcgatctgttaacggccactggtcaacaaggcatgtacatttacaccgcataacatttaaatcagagaaacagaatttacaaataaagtgttacattcggcctttagttacactatagtaccatgctgcagatagcagtaactgttaaagtatggcacgaatgcccaaccctctggtgcctgatcatgtatctagcaacatatgcagaatgaagaaaagagatgccccggtctcaccccatggactagttaatacagtgaagcaggttcctgtctataacccttcctgctcagaacataaaagattaaggactacaatcaagg

SEQ ID NO: 558994 - DNA, 610 bp, Homo sapiens
  misc_feature (183)..(183): n is a, c, g, or t
  misc_feature (320)..(320): n is a, c, g, or t
  misc_feature (438)..(438): n is a, c, g, or t
  misc_feature (490)..(490): n is a, c, g, or t
  misc_feature (532)..(532): n is a, c, g, or t
  misc_feature (546)..(546): n is a, c, g, or t
  misc_feature (589)..(589): n is a, c, g, or t
gcgagagatgtttacattcttcccattccaaatacatacaggccatgagttaacaatctgtcattttcctaaaacaccaacagatgagcttttttactttcatttgtaagttataatactcacaattaagtggatctaaataaagatatttaaggtatatatctataatatctatctatctanctagctatgtggattaaaggtcaatgctattgtctatgcattagccactcccatgtatgagaatggtctaaacttgttactatatatctcttaaatggtgtcaagtagccaaatttatttgctgaaaaacaagtgancatgcaacagtgaaaatgaaactgtgtacatacctcttatgcatactgcatacaccttaagctctctacatgcctgtcaagcacttatgcttacatatattgagatctcattacatanggacacactgctaaaatgaaggaaatgatggagtattttctagacaaatgtnatgaggctttgatggaatgacaatgtaaaaggataccaccanatacctatacttgnacttataaaatggatgatattctagatgggcataaaggggagnggtatcagctacgctgggttc

SEQ ID NO: 558995 - DNA, 81 bp, Homo sapiens
accgaggacacggccgtttattactgtacgagagcttttacgaagaattattggttgacctttgactactggggccaggga

SEQ ID NO: 558996 - DNA, 372 bp, Homo sapiens
ggtcgaccaccgagatattttctatacttctctgaggatagcttatgtttcacaattttaaaaaagaaaataggctgggcacagtggctcatgcctgtaatcccagcactttgggaggccaaggcaggcggatcacggggtcgggagttcgagaccagcctggccaacttggtgaagccctgtctctactaaaaatgcaaaaattggctggtcgtggtggcaggcgcctgtagtcccagctactcgggaggctgaggcgggagaatcgcttgaaaccacaaggcggaggttgcagtgaaccaaggttgtgccactgcactccagcctgggcaaaggagcgaaactccgtctcagaaaaaagaaaataggggc

SEQ ID NO: 558997 - DNA, 293 bp, Homo sapiens
ccgctacggacgcagctcagaaccaagcacggttttcagatcacacatgtagtataggcatctcgcccactctctccccacaatcacgatccccttccctttttaggtcttgttttccaaacggattctaggcgatagtttcccctctagccttggctcatttaaatggctcgaagacaccaatcaaaaatacattaaataattcattctcaccttagcagaggtgcatggattctgtctaccaaatattaatactacagggcccgccaggggttatttggttgttacaaaga

SEQ ID NO: 558998 - DNA, 320 bp, Homo sapiens
aagcagttatacagactcatcaacctatagaactggtagtgatctggagactcgagcatataaagacgttctgaattatcaatctccaacaacatgccagtattttaccagcaagagtagggtgcatgcgttgaataacgaggaaacagccgtacacccaaacatttgctttggctcttgagggaggggcagatcccaccatggaagcggtcaaaggttcctgaccttgtacattaacagcaggctgttgcattgtaacttgtggctgtccttaaagatgttgctgaggattgcgaagtcctgcagcatatttatactgt

SEQ ID NO: 558999 - DNA, 128 bp, Homo sapiens
ctccggggcccggttataggctgccaggtcagcaacgctagtcgccaccaggagttgaggcttctacccggaggaagtttccctggtagggtccagactaagggatttttattattttgaagagggga

SEQ ID NO: 559000 - DNA, 158 bp, Homo sapiens
tggaaaaaaacatatgttcaattaacatatgaagagctgctcagttttcatagtgatcagtgtatatgcaaaacatgatcagaatgtgatactattttacattcttctcgagtggcataaataaggaagcctaaaaaaatagtaaggggtgaagaaga

SEQ ID NO: 559001 - DNA, 819 bp, Homo sapiens
  misc_feature (327)..(327): n is a, c, g, or t
gaagacaatttggaaaacagcaattaaagcatctttaggtagggtgaaaaccccccgggaaactgtgcatccagattgaggagctcccacagccacttggcactgatggggtgctttctacactgcagatgaataccattgcctgcaggtctcttgggtgatgtccctacaaaagtgcctgttttgcatctattcttggtattatgtttagccaaagtttcactttccttatgtttctatttgctactggttatactgacactcagaagtcaaagaagagtaagtctgaaaactcccaactgtccaatttaatgaagacattacttnatcatcatcatcaccaagcatgtataaccgtccagtgccaggactggaaaaactggaagcaacccagccatctcagtgtgatttagaggaatgaaatgccattgtgccccctttcctgatgagaaaattgaggtagctaaatagaaaggggaagataaatgtcccacagcggatgtacttattcctgacttggcgcactctgtcgcttttccaaagtagtacccagtgaaaaagagatgatctgataaagttggcactgcacagggatatgagatgggaggtgaggcaggggagctgggatgggcgacagtcagtgatggtgatggtggtggtggttggtgatggtggtgacggtggcgcctggccggctcctctcccgtttctccatcacagcccgtcctctctgcctcctccgtccccgcgtggcctgcctgcgctgggccccgcgcgcccggcggcccgagacaaaggctgcgcggccgcggcgccgcc

SEQ ID NO: 559002 - DNA, 857 bp, Homo sapiens
  misc_feature (327)..(327): n is a, c, g, or t
gaagacaatttggaaaacagcaattaaagcatctttaggtagggtgaaaaccccccgggaaactgtgcatccagattgaggagctcccacagccacttggcactgatggggtgctttctacactgcagatgaataccattgcctgcaggtctcttgggtgatgtccctacaaaagtgcctgttttgcatctattcttggtattatgtttagccaaagtttcactttccttatgtttctatttgctactggttatactgacactcagaagtcaaagaagagtaagtctgaaaactcccaactgtccaatttaatgaagacattacttnatcatcatcatcaccaagcatgtataaccgtccagtgccaggactggaaaaactggaagcaacccagccatctcagtgtgatttagaggaatgaaatgccattgtgccccctttcctgatgagaaaattgaggtagctaaatagaaaggggaagataaatgtcccacagcggatgtacttattcctgacttggcgcactctgtcgcttttccaaagtagtacccagtgaaaaagagatgatctgataaagttggcactgcacagggatatgagatgggaggtgaggcaggggagctgggatgggcgacagtcagtgatggtgatggtggtggtggttggtgatggtggtgacggtggcgcctggccggctcctctcccgtttctccatcacagcccgtcctctctgcctcctccgtccccgcgtggcctctgcccagagaaacaggatttgcacccaagccgcacgtgcctgcgctgggccccgcgcgcccggcggcccgagacaaaggctgcgcggccgcggcgccgcc

SEQ ID NO: 559003 - DNA, 1194 bp, Homo sapiens
  misc_feature (295)..(295): n is a, c, g, or t
ggcactcgtgggtcgacccacgcgtcgggccacgcgtctgcgatggtctacagccgagtgacgggagaagggctcaaggcgtagtgttctcatgtgatgactcggagtgggagacagtaggctacaccagactggtggtagagtaccccagatgatctaagctactttgggaagtggaggcgaccgaatgatgttgcagagtctattgacagttgttcctgcaggattacattgcagtgaacggagaacgtatgcgcaatggtaccttgcctctactaggatgcaggggtcgggntagtgcacgcgaagcgtctttgcgaaatagctcgagggttccgcagtgtgtaggcagtcgcactgcaagcttaattgcatcccatggatagattgtcagcggggcggttagaaaccgggaaaagataggctcgatgagctgtgacgcatcgtcgaggccatgcgcttcggggatcatgactgcttgtctcaacaggccgaggaaccttctggtgggggtctcttgtgaatgaaaccggcgaattcgattctaaaacaagtgtggggtcacccccgcgtgagcggtaacgtcccaaccaagctgcaaatttggggggctgccgaccctgggtaacataggttggaaggaattgaacctggggccctgggttgggactgggttggttcgccacgcccccctggtagtcccggattggtggaaaagcgcctagtgacccaagtccttgggggcgtttggattgggtttggcaacccacgggggggggtttcttgtgtgaaagaggcattttggcgattttccgcgcggaaacttaatttgaggcgaagcgcgaattatgtcttggaagggtgtgccccgtggtgacaaagaatttggatggcgtatttaggttccaaatttggctctggtcgagaaggtggggctgcgctgctggagaaacgtgccgtaattggtcaatttgaaacgaaaacgaaaacggacccgaatgccgttgggaagggctggttgttggggccccacatgtatcacaaatgggcggcttgaatttgtttcacccaaatggctttggcgtttggccccaagattgacagacccctgtgttctgtggcccccttttgtggtggtggccaaggacctcccaaggtagagtatatcgacattataacgagaaatccacacaa

SEQ ID NO: 559004 - DNA, 445 bp, Homo sapiens
ccacagtttaagattcactttctaaccaatagggggaaaggcggagggtttaagagcttgttttttgtaagttttacttctcctaagaaggttcatgccctctggtgctgggcttcccaacagccctggggctctgtccctgtgtttgttctgaatggtcagccgtccctggggcccagtgaaaaagagatgatctgataaagttggcactgcacagggatatgagatgggaggtgaggcaggggagctgggatgggcgacagtcagtgatggtgatggtggtggtggttggtgatggtggtgacggtggcgcctggccggctcctctcccgtttctccatcacagcccgtcctctctgcctcctccgtccccgcgtggcctgcctgcgctgggccccgcgcgcccggcggcccgagacaaaggctgcgcggccgcggcgccgcc

SEQ ID NO: 559005 - DNA, 848 bp, Homo sapiens
caccatgaatggttctacccctctattaagaaataatgggaccataagcatctcgtttgcttatggctgtgtgtcactacttacaagagtcttgaaaataatacagaactttgccgttcttatttttaattgtcttccacaatgttgtgactgacttataaccctgttgcccctcagagaagagcgtatggctcagggatcatgtgttgactctggcattcagtggctttgtgaaggatcagaaatccattaacatgaagcctgacaaagactgatctcatgtcctttatacacgtagttgaatgccactttaagaatgttactcctcggtttgcttttgtctaattctaatggcttaaagccaagaaaaccatagtataaatctttttgtgtacctatgctagtgtttaaatggcagttcgtgtgataaagtatcagtcacttcaagttttctgtgaaagtttttaattaggttaaaaataatttggcatacgtctctacttcagtttataaagcagttccaaccatgcaaaaaaatctaacagcaaaggtatctttgacctgatgttacttgaatcttgaggacaaaaggtcattactttactaactgcaactccttgctttgtgggaaacaattttcttcttccccagaagagtttaccaggtgagtgttcaggtcctgacttaaccttaaattaagaggcaacttattccggcacatgaatattgctacccagcttattggcctggccgcgagcacaacaaggccctttgtgtgagcgtgcaacaggcgagagaaaaaggagaggattgcacacacctcggggacacatttggataccactctt

SEQ ID NO: 559006 - DNA, 111 bp, Homo sapiens
gggagagagcaaggtctccaacaaaggcctcccggtcctccatcgggaaaaccatcttcaaaggcaatgggcaggcccgcggagaccacaggagtacaccctagcgcccca

SEQ ID NO: 559007 - DNA, 504 bp, Homo sapiens
  misc_feature (144)..(144): n is a, c, g, or t
tctctggctcagtgatcctcaattgtggctccacccataccttgtcctcttgtctcatctagagtctgcaggcccactgggtcccacagccaaccatgcacgggacagcccgggcgactgggaggggatacgaaggtcttctgngccctctcatcccaggccagcgtccaccacaactcaaagacagcggggggactgcacccaccactcctcccgagaagcagtggttgcacatttccaacatagcgaggaggatcacttgagacccctggtagccaggtctgatgccgcctcatctgcccttccagtggtctgtgtcaagttagtcactccggtatcacccggccattttctgaaggcagcagtgggttcagggcagacagtgggaaggaagtcaagtggaggatgttcccagccaaggggatgagctggatcccgggcgcctggtcagcctggctcgcggcacccttcacagacaccactgatcggaaaacctggtgtgag

SEQ ID NO: 559008 - DNA, 212 bp, Homo sapiens
caggggggcgcgttagggcgcggacagggtcgccaagagatgggggtgggacgtagcggcgcacggggggaagagaggactcgtgatgcagcgggaaccccttctggttgaaacgccaggccgccatgtgccgcgagacgtccacccccgcgggaacgcacttaaccgcgcggtgtttccccgccgccaccaatggacgagacacgacacac

SEQ ID NO: 559009 - DNA, 287 bp, Homo sapiens
tctgcttcttgaaactctgaaagtgataaaggaagctgctgatcttgaagaaacactaagcttatttgagagatacatggccttgccctaggtgaatagtgtgtccagctctaacagatctcaagccccccacagggtcaaaccaggccagcccgatcaggagagcttctgtcccttctgccaggagtttctgggatactgggatccctcatgtacacgacagtatcccaaggagttgcagaggaagtagaacgcagatctggaggatccctagtctcgcttgtgcc

SEQ ID NO: 559010 - DNA, 881 bp, Homo sapiens
gaggagcaatcgtctgcgcgctgggcgagtgccgatttgacaagatcaaagtgaggataatggacagtgaggttcaacagatggtaggatcgttggatggattgatgatgcttggtgagagagacaaaggcagccttcatgagggatgtcccaataccactgaatagtgccttcctgaactgagagaagagcgaagggtggacctaagagataatcggtcgaagaaaggaaatgaagtggatagacttagcttacagtacctcgatgacaatgtgtcccaccgcattgtgaactgacgctcgggtccttgcttgtggctggattttctcaaagtacagcagatgagtgcatggtgtcgtcttcagtgctgccaatcattcaagaacgccttccgagtggatactatcaggtagtcaagaaatgtacagccatctaggtcgtggtagcaaagtgccatgcgatatggaatgagaaatgagatctctcagtcactggtgaatatcccgtctttacaactaaggagcttcattgagtagcttatatcgaacatgatcggtccaacatttgcctctactctgattgtgctgtgtgtccaagttaagaccttccaatacttatgtgtgtgctgtcacaacggtgatcgaacgttgagagggcacgcatgaacaaggagccccagactacgagaatcttacgcctcatactgcccgactgagagatcgaggtttaggggcaacgtcggagcaacccacccgggctggggcctaaaatccggttccactggcactcccaacatctccctcggccccaatcggggacgacgccgaaaattcacccccctccccccactcttctcctccacactctcccccccgcctccc

SEQ ID NO: 559011 - DNA, 256 bp, Homo sapiens
gggcgaggagttcatccgcaatgtcttccacctgtgtcatgcctttatttttcaggcaaagagaagtcccagctctgcgttctcctggttacagtatgagattgcaaaggtcatttggtgcctgcacactaaaaaacaaagaagagatttaaagtctcaaggggaagaactgcaaaaaactagccaaagaattctcctttaaggagcccagaaaaacttgcaacaacttttggcctgttggaagcagttatgcaca

SEQ ID NO: 559012 - DNA, 284 bp, Homo sapiens
ggtgcctgttctgtgtgaggggcagatgaagaatcacaagccacaaacaccccctcgagttgctgacacctgccctgtgcaagctgaaggtggcagacagggccaacggcagagatccttccgctccccagtcccctttcaggagcttggaaatgatacataaattatacttcaaaactcgaggtgtactgtcagagctcaaaagcaggaaagggagcagactctgaaaacagaagcgaggagtcacacagctaaacataataaaatgtgaatgttgaatcctc

SEQ ID NO: 559013 - DNA, 980 bp, Homo sapiens
ggccacccggaacaacaaagcaaggaagacggagtccgagcctcgggggctctagcaagggggcggggggggagtcccatggagactggggagcgcgccccgttcatcctcatccttgtcctccagttctccttcgatcggacgcaaccggagcagcgcctgcggccggggtccctcgagcccagcggtccccttcttcccccagggattgtgactctcccgggggtgggcaacacgctaaatttttaaaaacccaccccaattggtattcgcagcgaccggtggcgtggttggctttggggccccattcttattcacaacttggtacggccctggtggtttccacgacaacaaacggattggtcatttaacaacttttacgggggaacgcgatggcgtttgtcggaaggggacgcaaccttgttattttaaataaacgcggttgagtgggtgcgggacaaagtgctaatcaattggaaggtttaagaaaaaccctaaggaattaccaggtctaaccaagtgtgggttccctagaggaaacaatttttttgtggcctggggaggcgaacagcggtgaaggaagcgaaacggtcaaaatttgtgggtgggccaggacgggtctaaaaggccccggaaggtttcgtggcaagaaaccttaagagtttcccagggttaactactttaccacgcattccccaggcgggtgcgcaacaccggttcccctggccaagcgggtcgtagaccactggcccagttgagacaatcccggttgttggccagaaattcacaccaaaggacatattagaccctcattggcagagttatacgaaccgtggaactttcacattcctaagtggtggtggcgaaccgggataacattctctaaagaggctcaccattaacagagtttttccacacggaggttcaccagaacagcgcgcccaatggaacagctcggcgccctgggttgaaccgattcc

SEQ ID NO: 559014 - DNA, 669 bp, Homo sapiens
  misc_feature (61)..(61): n is a, c, g, or t
  misc_feature (171)..(171): n is a, c, g, or t
gacggcgaatgggcaatctaggggtggctggatgttgcttccagaggtgtcacacagatcnaattcatcacgttcggaaaatggtatgatgcagggaaacagaagtactttgcctcatcatcgaccttgtttgtgattgagttcatcttattccactatgtggagataagnagatggcaggacatcaagaacccaggaagtgttaaccaagaccctatcttcaagcaatatagcttgcctcctaatgaagttggttaccctggtggcatttttaaccctctcaactttgcacctactgctgaggccaaggagaaggagcttgctaatgggagattggcaatgttggcattcttaggattcattgtgcaacacaatgtgactggaaaggggccttttgataaccttctgcagcatctatcagacccatggcacaacaccattattcagacattcggtggtaactaagatccatctcaaaaactagaaggaaacactgcgttatagttcttttgtaacaatcatatcttttgtggactatgtgatattgagcttctggtaattattaaagggtttccaatgtacagagcaactgaagttggcactactattttttccaatctttagctttcatgttatcatatttttactgcttaattacttgcttagcaa

SEQ ID NO: 559015 - DNA, 360 bp, Homo sapiens
tttaaggatccccagactgtcgacaggttgggttctgtgatgatcgtgaaagagatgcccagtgcagactctggtccccgccagagtggcctccaagcaatgtcatccctgggctgaggacctggtggagcccattaagaagcacgaggtcccagcaaagtctgatgtttactgtgaggtgtgtgaattcctggtgaaggaggtgaccaatctgattgacaacaacaagactgagaaagaaatactcgacgcttttgacaaaatgtgctctaagctgccgaagtccctgtcggaagagtgccaggaggtggtggacacgtacggcagctccatcctgtccatcctgctggaggaggtcag

SEQ ID NO: 559016 - DNA, 932 bp, Homo sapiens
  misc_feature (105)..(105): n is a, c, g, or t
  misc_feature (149)..(150): n is a, c, g, or t
  misc_feature (217)..(217): n is a, c, g, or t
  misc_feature (233)..(233): n is a, c, g, or t
  misc_feature (237)..(238): n is a, c, g, or t
  misc_feature (254)..(254): n is a, c, g, or t
  misc_feature (295)..(295): n is a, c, g, or t
  misc_feature (299)..(300): n is a, c, g, or t
  misc_feature (311)..(311): n is a, c, g, or t
  misc_feature (333)..(333): n is a, c, g, or t
  misc_feature (358)..(358): n is a, c, g, or t
  misc_feature (392)..(392): n is a, c, g, or t
  misc_feature (406)..(406): n is a, c, g, or t
  misc_feature (410)..(410): n is a, c, g, or t
  misc_feature (420)..(420): n is a, c, g, or t
  misc_feature (426)..(426): n is a, c, g, or t
  misc_feature (447)..(447): n is a, c, g, or t
  misc_feature (460)..(461): n is a, c, g, or t
  misc_feature (465)..(465): n is a, c, g, or t
agcggggtgtgttgctgcctgagtgccggagacggtcctgctgctgccgcagtcctgccagctgtccgacgatgtcgtcccacctagtcgagccgccgccgcccntgcacaacaacaacaacaactgcgaggaaaatgagcagtctctnnccccgccggccggcctcaacagttcctgggtggagctacccatgaacagcagcaatggcaatgatantggcaatgggaaccantggnngggctggaacacgtancatcctcatcctccatccacaatggagacatggagaagatncttnnggatgcacaanatgaatcaggacagagtagttncagaggcagttctcactgtgacagnccttcgcaccaagaacgatgggacgatcatgtcngatgtggaaatgcnacancagcagggancatagntctcagtcagaagaagaagtngtagaaggagagnnggangtcgaggccttcgcacgcacaagctgcggactgggtatcacgactggctccagtcgacccgacaaacattccacgccaaggcagttccacttcaagacaccctaaacgttctgtgctctctcacgcatgaggaaaagtggcagccatgacgaacaggcgcgcctccactccgcagaattcctgacgctgtccaatcccatctctcttcctttcctcactgtcggcctcggggctagcatctcataacgcacagcgacttgaggacacccttgcagccccttctgaggggaaaggcaaccgcccctggacaatgcctgttgacctgtgaagcggcgctatggcacggcagcccgattacgaccttcacacccttggtcagcatgacccaacctcaaaccggtttacctattccatccagtaactatccacgtccacatgcactccaccctggcaggacttgatcaccg

SEQ ID NO: 559017 - DNA, 371 bp, Homo sapiens
ggcaggtactgtttttttaatcccccgaaggtgtcctgtaggagacaaaaattttttcctgtctgtatcccttggagtaaaaaggtagtggcatggggggagggggggttctttctcccaatctattatgatgtttattaaacccttttggaacaaaaaaggggggagtttttttgttactgaagttgcccttccccatggctattttaaaaggaaaaggacttggacggttctgtaaatcttgaaaaaaactgtttggagatttaaccccctctttgatggggggcccactttatggaaattgtaaaaacgttttttttataaaccgggcccgggattcaaaaaacatttttgcagcctttcttttttta

SEQ ID NO: 559018 - DNA, 439 bp, Homo sapiens
cggcacgagctcagcttctcaggaggctgaggcagaaggatcacttgagcccaggaggtggcggttgcagtgagccgtgattgtaccactgcactccagcctgggtgacagagcaagaccctgtctcaaaaacaacaacaacaaaaaacagcttcctctgctcagggtccgtccaaaagggcatctctgagaattacaggccactggcttttaacctgacatttcaaaactgtgccccacacccaaggggtttctgcagtcctctcaaaggatactgaattaggatttagggagaaggagagacccagctttgggagatttgatgtcagaactgtgttttctgtgtgttccagtgtgacaggaagtcccttcctggagcttatcctctcgcattcggggtgcctggcccagggagctccttgattcctaaattcctgct

SEQ ID NO: 559019 - DNA, 231 bp, Homo sapiens
ggttatctgttacaatcgaaggcagtgtggataacgccaaggctctgttcaaacctccagaggactcccaagatgacgagagtgactcagatgccgaggaggagcagactacgaagcgccggagacccacactagggggttacagttgagagcgacaacacgcaaggagcatgctgaagacggcacccactagtactgtcatagctcgaccctagaagtagcaaacgataa

SEQ ID NO: 559020 - DNA, 600 bp, Homo sapiens
  misc_feature (2)..(2): n is a, c, g, or t
  misc_feature (17)..(17): n is a, c, g, or t
  misc_feature (40)..(40): n is a, c, g, or t
  misc_feature (84)..(84): n is a, c, g, or t
  misc_feature (142)..(142): n is a, c, g, or t
  misc_feature (155)..(155): n is a, c, g, or t
cnccccatttgtgtggncccgggagccctccagggataancccccccggacacaaaaggtggagaagagccttgttccaccccncctagccagataaaccgcccctcaaaactgggttgggaccttacctaaagtaaaatgnaaaccctaatatntgttaatattattttcccaaaggtcctataataacacactcccttagtaacttatgtaatgttattttaaagaattggtgacctaaatacaaagtaattatgtccataaacccctgaacataatgttgtcttacatttgcagaatgtgaggaaattatcaggaaaggaggtgaaacatctgaaatgtatctcattcaacctgacagttctgtcaaaccgtatagagtatactgtgacatgaatacagaaaatggaggtaagctttcgacagttgttgacctgttgatctgtaattatttggataccgtaaaatgccaggaaacaaggccaggtgtggtggctcatacctgtaattccagcaccttgggaggccaaagtgggctgatagcttgagcctaggagtttgaaactagcctgggcaacataatgagaccctaactctaca

SEQ ID NO: 559021 - DNA, 844 bp, Homo sapiens
agcgtaggtggaagaggacgaagggcctatgcctatgagaaaaacgaaccgcatgcacttatctctcttctaataagatgacaccagatgataatccagatgtcctggacttcgagagatagaatctgtacatacggctgtggtcgctgtagaaccggagccatccatgatcaccaaaggaatgagaattccagcagcattagcggcacacgaatgtagctaaacacacagttctgaaacggacataggcactacctcgacggtgtcctggacactcccaagatgattctggtcatgcccgatgtagattcctactgggtgcagagaacgccgagaggccagcaacagagtgatgaccgcccataacatctccggagggaatgagcagacaagtagatcattgaagagaggtgagaaaggaaggaaatgaggctacgctagaattatccacttgtatgaaagcaaccgttccatagggagtcgaacaagactgagtccaaaaggtaggaattactggtccatgttgtctattggtacgaaaaaaatcgttccaatgctgaagcgaggcggacaccttgggaaagtaaactggaatgaaaggcatgacctcgcaacataatagatagaagagctatggcatagatagatgagaacgctataggtctacgagtgattggtggaccgagggaatatatctaaaccacagatggtagtcgtcgagagaatggagagactaacacacaaagctacctaggcacctgttagtaagaatgactgagttgttcacttctcttaaaggttgcagtaccgagaaaagcaggaaactttagcttctgcctacaag

SEQ ID NO: 559022 - DNA, 291 bp, Homo sapiens
  misc_feature (23)..(23): n is a, c, g, or t
aaaaaaaaaaaaagatataaatnacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaatagggtcaaacccttaaaaatatttaaattctttaaaaaaatttgaaaagattattcttcttcaaatttagtttgagctttct

SEQ ID NO: 559023 - DNA, 217 bp, Homo sapiens
  misc_feature (38)..(38): n is a, c, g, or t
  misc_feature (45)..(46): n is a, c, g, or t
  misc_feature (48)..(48): n is a, c, g, or t
  misc_feature (114)..(114): n is a, c, g, or t
  misc_feature (130)..(130): n is a, c, g, or t
  misc_feature (141)..(141): n is a, c, g, or t
  misc_feature (154)..(154): n is a, c, g, or t
  misc_feature (181)..(181): n is a, c, g, or t
  misc_feature (186)..(186): n is a, c, g, or t
  misc_feature (192)..(192): n is a, c, g, or t
acacccttctacgtctcatactgcgatatcataaccanacatatnnantctcattaaaatatatttaatataaatacagcagtttctgctgtgaaaactttacaatgcactgcntaactaaaaacttgtnttttttttttnggctcccttggtntaaagaaaacaaagtggcaatgattantgggncaaaantaagaaacctaccaaactttgggga

SEQ ID NO: 559024 - DNA, 737 bp, Homo sapiens
tatgtcatacagttcacccattcattaaagtatatagtttagtggtttctagcatattcacaaagttgtgtaaccatcaccagaaatcaattttagaatacatttagtcatctgaaaaagaaaccttgtgccgaggatggtggctgatacctgtaatcctagcactttgggagtctgaggtggacggatcacctgaggtcaggcgtttgagaccagtcctggtccaacatggcaaaaccccatctctactaaaaatacaaaaattagccaggagtggtggcacatgcctgtgatcccagctactcgagaggctgaggcaggagaatcgcttgaacccaggaagtggaagttgcagtgagctgagatcgtgccactgcacttcagcctgggcaacagagcaaggctccacctcaaaaaaaaataataataataattttaatgtgtgtcccatgttcttttgtacttttgttccttgtgtatttgggtgtcacgtgtacgaaatcttagtgaatgcaaggttatgaagatttacacgtatgtttgctttgaagaatttatagtttctctcttatcttagtcctccaattcaattcatttgttgacactgtctacctggagataccatcagattcgataggttaaggactcagtcccagaagaaagactggctccattttggatgctatgggagacctatactcttgatgaatcagtataatgggggattccataatccc

SEQ ID NO: 559025 - DNA, 80 bp, Homo sapiens
  misc_feature (16)..(16): n is a, c, g, or t
gatcaggcagtccttnaggatagacagatatacacaccacacacacacaccacatacaccacacacacacgtccccatcc

SEQ ID NO: 559026 - DNA, 327 bp, Homo sapiens
  misc_feature (35)..(35): n is a, c, g, or t
  misc_feature (81)..(81): n is a, c, g, or t
  misc_feature (209)..(210): n is a, c, g, or t
gctcgacggggatttcgatctggcggaggaggccntgcacgaagccttctttatcgccatcgaacgctggcaggcgatggntgccggccaatccccgggcctggctggtctccaccgggcgtttcaaggccatcgacgtgttgcgccgccgcggcttttgccgcatcccaggggcagttgatcgcccaggccgaagcgttggagcaganngatggaatgacgaggatgtcgaggacgatcgcctgcggtgatctttacctgctgtcacccggcgttgtcggcggatccaggtgccgctgacattgcgcgaggtctgcgactggtcga

SEQ ID NO: 559027 - DNA, 371 bp, Homo sapiens
caatgaaaaaaccagagacataaaaatccctccgttactagctgaacaaaaatgtcgcggtgtgtacttggcgctatgataatcgctgaaatgaatgtggaaccagccctgtatgtatatcaggtagctcttatcaggcgaggtttatacttaccaatatgctgcctaacgtatgcattcaggcatggtcatatggcctatcaagcacacccgtggttgttgcaacttggtagagcggaaaaagaaagatcccgcggttatcgatgtactagatttgggtatgatctcaagacagttctagtttcaccttacacggaatactcaggaagagggtatgaatgcaagagtgaattacctgtccatcagttaga

SEQ ID NO: 559028 - DNA, 377 bp, Homo sapiens
ccgtgtctagaggatccctatatggtctcagatggctatggtatagaaaggacagcactctagatggatgagagggcaggcagatagatacgactaggtcatctcttcagtctacggttatagctagacttaatattgagaattatgtgctgtatctattatttcattttcttcttacttaaaaaagaaatcacagaaaacaccaaataatttagttatactatttcctcagatagtcttagaaaggtttctttgaaatgcatctgtagtggctactagggactcaatgaatattcatccaatgaacagatgaactaagcccaataaaatcaacaaaacatctcctaagaaattgttgatcgtgtgcaactgtttga

SEQ ID NO: 559029 - DNA, 364 bp, Homo sapiens
ggaagacacgtctgtgacttggtgcgtctgtgtaggccagcagcctctgatctgtagcaggatattaacgtgtcagagctgagatgttctgggatatctctagaggctggcaagcaccagttgttatgtcttgcgaatctgtcagggttggaaagtccaagccgtcggacccagcttcctttcttaactgatgtctttggcctgaacaccgtgggctgttccttgctttgagttaggaagcggtttgcatttcacgcctgtaactgtattcattcttaatttatgtaaggtttttatagtacgcaatactcgattctttgacgagatgacaacaaatttaggttttctactgttatgtgagaac

SEQ ID NO: 559030 - DNA, 211 bp, Homo sapiens
ccggcagtctggggctggctgtggttccaccacgcttcgctttctggtggaccgagagcgtgcggtcacctccgtactgggagcgtatgtgttcccagtaatcagccaggaccatgaaggtcggttagatttggacagtattgcgtgggatgacattcatgtggtccccggagccctgaagctttttctccgggagccaccccagctgcgg

SEQ ID NO: 559031 - DNA, 1587 bp, Homo sapiens
  misc_feature (971)..(971): n is a, c, g, or t
  misc_feature (973)..(973): n is a, c, g, or t
gctttcggcgggcctcgcggatggcggcgcagggcggtagggcctgggccggggtcggcggcgcccccggggctgggaggcggcccggcagaaagctggcgctgcaggcggcagagaacggtgctgagcacccgaaggagatggagctggtacgagctgggctcaggccggcgggcacggcgggtaatcgaaccccgaaggtggttacaaaggaatccctgtggggtggcgaccttggcgtggaaagcctggaaccggtgggaccccacacttcggccggtcctcccgaaggaatgcttcaaagttcccactggttgttgcccgggggccacgaagcggcataaggcagaagcaaggaaagccccacaaggggaaacccccttgcgcggagccacggtagctccttcgtgggcccacaacggttccggaaggccggttgcccccggaaggaaacccccggaaggtgggaacagacaggaaccaacaagggcacaggacggcttgggcccattccgggggcggcgaaggctaatctgggggcccccattgggggcgcggggaaaaccgcggcacagcgcaaaaacacaaacagcagaaaggggagacattccacaagcgcccacagtagacgggatggtgcgcccaaacggggccgagaggcgccacaaaggggcgggcttaacacccaagggcggtcttgtgccccccaacagggggggggcggggcacaggggcgccccttggcggggcaaccagaacaggacgccttataacgcgggccaagggtgggcacacacgagccacacactctttaacggggagaacttgggcgcggcgcccaagtgacaagcaacttttggtcgtcaccaccacatttccgatggtgtgggtcaccccccacatagcgccaacaagaaggcgcggcatgaccaatgttggtttaaaccccgtttcccctgtacacacagggntntcgagaactaaatatttaaaaacacgccctttttcgcccctgggcagcgaacgttccagtactcattcacaacacaccgaacgccacgaacacacaaacaacacaccacacacaacacaacacacagtgtagtcgctgacggacgcacgcacaaggaggcgccaccaacctcagaagcaaaaacacgcgtctccgtacacgaccaaccacaagccgagacgatggaaggagcacagcgcgacaggcgaaccccacaaaaggtagcggataacgagtagccgcacccagcggcggcgagtcaccaaacaagcgaggtcgttacctcaaacaggagaagccaaacaacaccaggtgcgagacatgatagagaccaaaagggtggcacgatgttgaggaactattccgacacccaacagactaaacaaacaaccgccgcgggggggcaacacaccacggagacgccgtcgttgctagagaacacaaaaccgcacgaccaggcggacgcgctgtgcggcacacaccaacgcgaggggcatatcacaaaacagggacagccacccagcaggcaacgcgcgattacacgaagacgcaaccgacgcagcagaagacggagg

SEQ ID NO: 559032 - DNA, 106 bp, Homo sapiens
gcttgccctgtggactgctcctccaggagactgctgattttggcattctttttcctttcatcatatctcttctagaatttttattagatacgtttattgtttaaaa

SEQ ID NO: 559033 - DNA, 117 bp, Homo sapiens
ggtggactctgaggatcccctcggacgtgtatcgtcagacaggccttgcaaacagagttttggatggctggcttctggcattaggtgatcccctgggtcggataacacgttcgcgag

SEQ ID NO: 559034 - DNA, 174 bp, Homo sapiens
cacagtgtgctgcggtgatctcagcaggcatccccatgcatttagcgggcacatgcaaggcaagccttgcttctgtcttcctccatggtcatttccctcccagggccaggcgctccaatcttccccagccgggggggtcacgcagctcgcaattcgtcaatccatggtccatca

SEQ ID NO: 559035 - DNA, 195 bp, Homo sapiens
gcatggctgtatcctagaggaccccggtcatcctgctacaccgacataaacagaaacatatacttcaaggttatcaggcctttttttctgtgtgtgtgtgtgtgtgtgtgtgtgtggtagggtggggggcatcctaatagtagaagaaccctccataaacctggagtgactatatggatgccccccatccatgcc

SEQ ID NO: 559036 - DNA, 283 bp, Homo sapiens
tggtaacgccaccactttttgtgcaagcttgctcgtgctgggcatctaaacaacccctgtcagaaaaaaggaaaaaagttgacaggagtagaaaggagacaaaactattttacgcatgtgagttcccgcacagatacaaaacacacaccaacaaaaagtctctggagcgtgatttcaacaagtatctgaaacagggaaaagccaggaagatctccggttccacgtccaatttgtacgtccagcgcccttgattgtcgggcctgagacaacgtgatcaggcctt

SEQ ID NO: 559037 - DNA, 1525 bp, Homo sapiens
gaaccctgggaagggatgggagccctgtgactgtgaccggtctgtgggacgtctgcacgactacgacaagcacttaccattctgtttaaacgacactctacctactaccttcgggttgggcagccacttccactgacggctgacttattccgtgaaaccacctacaagacgacacactgtcctttatggtgctaccagcgttctgcgctaagcactgaccgttctaacactgcacacgacttactgactcgacggtcacacactcgtcgatacgtggcggtctaaattcaacacgactacacggtctattacggtacaccactccaacaacgacttacgcgtagaccgcgctctcactaggcacacacgactagacttatccatgggctttacaccacaaacggtactttcaccgtcacacggaacactactacactactggtcgactcacgcgctttctcacaacgcaattttaccaacgtgcctgccacacggcttcaacggtggaaaaccacgccattgttcatcacggtcaacactcgggatggacacaatcgctagggagacacgcccctttgcgcaccctggcccactctcgtgggtctacgtcgggaccaccacttgggtgcaacacactgcaccatcgtcccaggacacggggcccttcaatccaccgcaacacgcattccacgtggggaagaaggctaacagccttcaccgatcattacgtcggatggataaccagttgggttaggaaacggccaggcacttcaggcgacagaccaaattacaggcaacaccaacttaggggttaacaggttcgtacagttcattgggggctataattagttctcacgaacactgtgcttgggacactttggactactcttcaacgggacacactacagccacagaggagttctactttccgttatctcacatttgttcaattcctctcgtatctctacgctctctatggcactctttcctattgactataggacgttggggatctctcgctagaaaggggcacacgcggtcgttccacatctataaggcagagggggcacagacaaacattatggtagtccagattagagcagtagtaacagtcgttggtggtcaagctgccaagctccaaccaactggtgtaagatcatcacctatacacacgagtagtctactgtgagcacgtaagccatctggggcagcactgcttccagcaacaaccactgggtgagtgtgtaggtcaggagcaagactaacagaccgtcctagtccccagagagacaatcagcacgcagtatgaggacagagtccctgtggtgacgaacactctcgtcctcctacaaacaagacagactgaagagcagtccacatagtagtgagccacgccacgacaccagagtagatgatagtgtgtagtccaacaaggtcgtagtggcatgctgactatcatctcggtgctctgctttgtgctctcgttacaaacaacgatagcgaaggacagcgagacgcagcacgg

SEQ ID NO: 559038 - DNA, 112 bp, Homo sapiens
cccgcaactgattgcagcaggccagtggaaatgtacacagaaggccctgaagctgatggggtcaacatgaaggtgacattcaaggctgaaggcaaatagccccattccacct

SEQ ID NO: 559039 - DNA, 89 bp, Homo sapiens
attaaagtgtgttatactataatatttatttattttaggttgcaatacaagaacatgaaataaataaatattaaagtgtgttatactat

SEQ ID NO: 559040 - DNA, 184 bp, Homo sapiens
gaactgcgagtccattaaacctcttctttctctataaattacccactctcaggtatgtttttatcaacaaagggaaggccgactattacactataactcaatgccttcctaattctacccacagaacatggatcggtctggggaaggccaactccattcatgaaaaactttggaagccctttca

SEQ ID NO: 559041 - DNA, 407 bp, Homo sapiens
ggcgcagctgaggtagcggtcgtagatgatcaccgagcgagcgtcgtccagcggcggctgctgtagggatggcgctgagcaactcgacgacgttaaggcggcaatcacctcatcgcgatcaggctgaaggttgtcccagctattggctgcgaacgtattggtcgacatcgacgcgaggccgagaccaatgaaaaaagcgagggcggtgctggggaacagatgcttcatgctgattcgacgcgggggcaattgataacgcatattaggccgtctttgagggagccggttccatatggtccggtcgcataatgcaaaaagcccggcgctacagcaccgggctcagtccagactcactatggaggcactgtgaaagcattgcaaggcgttgacggtgcggattaggccat

SEQ ID NO: 559042 - DNA, 452 bp, Homo sapiens
cattttttgattataaaaattgtgtgtattttacaatcagtggcatcatagagttgtcattggccattttttcacattttttatctgaagttgggggtgtaccttagtgttgactgtagatttgataaaaagtgaggttgttttttgttataaaaaccaaggccacttctttcttaggctagtctttcctgacctttctcttcccagcctcctaattgaattgagtgtccattcatctctgcatccacagcaatgcgcattctctgagatagcccttgtgttggtgaggcagcgtagcatgttggttctggaaccagaccacttgtgttttaattttggctccaacatttactatttgtgtgaccttggatgattaatgtaacttctgtatgcctcggtttccttctgtttaacagtgggataataaatagtatctacctcaaaaaaaaaaa

SEQ ID NO: 559043 - DNA, 100 bp, Homo sapiens
agcgaggagggctggttcctgagcttcgcaattcctgtgtcgcgcttctggagctcccagcctgccgtggtcgctatgatccctccggccggagctggtt

SEQ ID NO: 559044 - DNA, 147 bp, Homo sapiens
cggcctctgcttgaggcaagccccctgtaggcagctctggcctgtagatagcctacccctgccagcaagtgctgcagcaagccacaggtggacatgctggaagcactgtggcctaagacccatgcttggacacagtacgcagtcgta

SEQ ID NO: 559045 - DNA, 388 bp, Homo sapiens
gtatggtaagggagcctactatgtgtgtagaataggaagtatgtgcctgcgtttcaggcgttctggcataggttgcctacatcgggtgatgattgccattgtggggattagtgtggtttcgaagaacatttaacatattattatgtctctgtggctgttaatcttcatatacttcaccgagcatttgttgcggagattagctatagagaggctagagcttttttttcgtgattgtggtaccctggataattctcgttgtcttgccatgattcgctgaggggtaggacgtcaggtagttagtatatagcgaggggggttgttcgggggtcggaggaaaaggttgccgaacagctaaataggttgttgttgacgcaatgagtacagatta

SEQ ID NO: 559046 - DNA, 441 bp, Homo sapiens
  misc_feature (122)..(122): n is a, c, g, or t
ggccaaacaggcctgggcacagttcgggtgatcgtcatggaccgctcgacggacatcgtgaaagccatcgcccgcctcattgagttttataagcacgaaagctgtggccagtgtaccccatnccgtgagggtgtggactggatgaacaaggttatggcccgttttgtaaggggggatgcccggccggccgagattgactccctgtgggagatcagcaagcaaataaaaggccatacgatttgtgttttgggtgacggggccgcctggcctgtgcagggtttgatccccccctttcggccggagctcaaggagcggatgcaacggtttgcccaacagcatcaggcccggcaggttgccttttagcccccccccctggcctgttgtcctgggtttatccatgtggaatgttggccaataaagggagtgttgccccccctccca

SEQ ID NO: 559047 - DNA, 162 bp, Homo sapiens
aggggcttcgagttgccctcatttacataaatatatactagcatatacactctcacttctaggcatactagtatatcgctcacacctgcatatcctccctactatgcgctagaaggaatactactatcgctgttcattatagcaactcgacagccccaagcg

SEQ ID NO: 559048 - DNA, 2113 bp, Homo sapiens
  misc_feature (1062)..(1062): n is a, c, g, or t
cggacgcgtggcgccagagtggcagttgtgcagcacgcgccctctgagtccgtggacaatgccagcatgccacctgtgaaggtggaattctccctgactgatatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagaggnctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacctttacacggtgtaccgagctcga

SEQ ID NO: 559049 - DNA, 671 bp, Homo sapiens
ctcgaattcgacggtgtctccctcatttatgaaagacactttgctggataaagtattgttggttggcagttgttctcttgaggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 559050 - DNA, 122 bp, Homo sapiens
  misc_feature (25)..(25): n is a, c, g, or t
  misc_feature (34)..(34): n is a, c, g, or t
agatctgttagcttttatgtatttnatgttattnttaagatggataaatgggtctgaatttagtcactactttttgatagccagggctttttttttttagaacatcctgatctttatagatg

SEQ ID NO: 559051 - DNA, 1842 bp, Homo sapiens
  misc_feature (1062)..(1062): n is a, c, g, or t
cggacgcgtggcgccagagtggcagttgtgcagcacgcgccctctgagtccgtggacaatgccagcatgccacctgtgaaggtggaattctccctgactgatatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagaggnctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggctgatgaattcgggtaccgagctc

SEQ ID NO: 559052 - DNA, 156 bp, Homo sapiens
tcgattctataggatccccagtctgccgctgaggtcgaactgaaatgtcctgtacagagctcagtttgtcttttaatgagtacgttgcaaaatctccagtctcatgatcccactactctataattgattgcatccttctgaagcagagaccattat

SEQ ID NO: 559053 - DNA, 404 bp, Homo sapiens
  misc_feature (208)..(208): n is a, c, g, or t
gcaggcgcctactactactactaaattcgcggccggcgtcgacccaaccctgaagactataagaaggctgaagagaaactcctgaaagtgcgtcctttcgtgacctacttccattcttccaagtacatctcggacctggccaacggaatatctgcgtggcggccggcttctccggtgatgtgttccaggccaaggctcgtgcggcganggcgggtaagggcgtgaacatcgcctacgtgattccgaaagaaggcggcaacctgtggttcgacgtactggccatccccaaggatgcgaccaacgtcaaagaggccctcgccttcatcaactatttgctgaaacctgaggtgatcgctcaggtcagtgattacgtcggttacgccaaccctaacccaggggcggac

SEQ ID NO: 559054 - DNA, 493 bp, Homo sapiens
  misc_feature (3)..(3): n is a, c, g, or t
tgnaaagaagactgggcaaggtggctcatgcttgtaatgccagcactttgggaggcttaggtaagagcacttgaccactgggagttcaaccaacagcctgggaaacatagcaagaccttatctctaccaaaaattttttaaaacttaaccaggcagggtggcatgtgcctgtagtcctagctaatcagaaggctgatgcgggaagattgcttgagctcaggagttccaggctgcagtgagctatgatcacgccactgttttccagcctgagcaacaaacagtgagaccctgtttctaccaaaaataaaataaaataaataaaataaaataaaataaaataaaataaaaataattgtaacaatcattcattaaatggaaaaataaggagaaaaaaactaaaaattttaagtctcaataatgggagtacagctaaatttataagaaaatggcttcctaactttcataatccattcttcttttaagccaactacat

SEQ ID NO: 559055 - DNA, 435 bp, Homo sapiens
  misc_feature (178)..(178): n is a, c, g, or t
  misc_feature (422)..(422): n is a, c, g, or t
  misc_feature (428)..(428): n is a, c, g, or t
ttatggcccggtgcacaaacacctgacggcaggtatcacttacccgaagaaggtaaagccctcaagaggcagtaactcagccaacctctcctccggccactccggcagacgcgtcaggacgtccgtcagccaagcatgtggctccagactgcggttcccagaaggctcattatctgtnccgcgcggttcccggccaccagtgaaccagcgaacaaccaggcctttcgtcccataacgaccggacggatagcacgctcgcagatattgttgtgtgtgccttgaaatgcacgatctttccgtcggtgaaagtccgccccggctaactctcgctccgactggaaggacaagaagcggtccaggaggtaacaaaagggctgaatctctccctgaaacgacttcttcaggaagtcaacgggttatgngggccntaacgtg

SEQ ID NO: 559056 - DNA, 1006 bp, Homo sapiens
gggtcgtctcccgtgcagtgcagctgcctgctacctgaccgccctctgcccgccggccctgtctgtctacccccagcatgagctggcctgcgctgtctacatgcacgtctgtgtcaccggctccctgcgaaatcaagtcccagcagagcgaggtgacccgaatccttggatgggaagcgcatccaataccagctagtggacatctcccaggacaacgccctgagggatgagatgcgagccttggacatggcaaccccaatggacaacgccaccccagaattgtcaactgtgggacacagtactgtgagggactatgagactcttcgtggaggctgtggaacaaaacgacgctgcaggagtacctgaaagctggcttgagatcaagcctgtaccagagttacccctgctggaccgtccatcacgcagaagaccaccgccagaccttcacctggagcatgagcgggacctgttgagccaacgtcgctgatcattcctaaagctaaagcttagagatccctaccacccaatgcaaggggcacaacgtacgacgcagtaccaccacaagtcaaacgaaaaacggtagagtaccccacatacgaccgaacccaatcgtaagagagacaagaaaaccagaagcaccgaaaaagtacagcaggaaagagtgggcgagaaggcgaaggagcgcaaaagtgcaggagagagacacgcagagcgaagagaaaagaagagccgacagccgaggccctgggaaagaggagatgaggggacaaacaaagaggcgggcaacaacaaggccagacaggacgaccaaaagggaccgaaataggacaccacggaaggcacggagcgggggaaagaaaaaggaagggacgggaaccacgaaagggcacaagaaagaagagaggagaaaaagagaggaaggcggagagagccggcggagagaaaaagcgaaaaagcagggggggaggcaacgagagcagaaaggaagaagaaaaagggagaaaag

SEQ ID NO: 559057 - DNA, 630 bp, Homo sapiens
tcggactcacacgcacttggctccaaagtgcgggattactggctgtgagacacgcacctggtcagatggactttttttgagcatttagttccaagcaccttccctgcactttctcagttaatcctcccagtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 559058 - DNA, 375 bp, Homo sapiens
agtcctcttacacggcttctatgatgtatatcgtgtgacgcggtggctgcacgaaacgaccacctgggttatatagctagttaactttcgtttaagctaaaggttatcactgtctgtttcccgtgggggttgtgggctaagtaacctttaaatggctgtacgaaataaaagtctttccaaagggcaaagtgatatgccaggagctgaaaagaatcaactgcaaagaaaacctcatttctattttcaattgctgtttctgttgacaacaacaagatagttttttatttatttactgcctcagatacaacagcacaaccaagtgtattattgatactttcgcatgtctttaacaagaaagaaataatctcctcattc

SEQ ID NO: 559059 - DNA, 310 bp, Homo sapiens
cggatcctttgtcggatacgcctgatctggcgtcgccagctgccaatgcggctgccggcgctgccggagtgtgcctaccttcatcgagcatgtcattgccgacttcacctggcggctcctgggccggcatgatcgcgccggccggcacgccagccgatatcgtgcagcgcctggccgtcgtgttggaccgcatcgtgcgcagcgacgaggagcgccagcggctcgaagcgatgggtacggtgccggtgggcggatcggctcaggccttcaacgagttcatcgcggccgagacgagaaagtggggcgaggt

SEQ ID NO: 559060 - DNA, 1830 bp, Homo sapiens
  misc_feature (1062)..(1062): n is a, c, g, or t
  misc_feature (1588)..(1588): n is a, c, g, or t
  misc_feature (1605)..(1605): n is a, c, g, or t
cggacgcgtggcgccagagtggcagttgtgcagcacgcgccctctgagtccgtggacaatgccagcatgccacctgtgaaggtggaattctccctgactgatatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagaggnctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacaggtgagttgtgaaactattaggtccattaatggcactaagaaaatacccatcttgatttcaatttaacttcctgggttctaagtcttagcccaggcatgacttctatgggggaaaaggtccacgtcagctctgtgcagcccaacatcatcttattctgcataatcccaggtgtaaatggagtcttactttacctgtgatcagactcagtgaaaatttgatgggaggtgctttnggggctatcactagaantcacgtatccattagacatttctcctgtgcctcatactgggactcgagttgatttgtggtctgtgatgctgtgaagattggcgtttcatttactcagtgatttaatctaatacaaaactgcttagaagaaccaagacaaattggctggaatcatgaatgctgggttggatctgaccatgagtgtctgtccgactctagcccacccactatgtgtattggataggt

SEQ ID NO: 559061 - DNA, 788 bp, Homo sapiens
cggacgcgtggcgccagagtggcagttgtgcagcacgcgccctctgagtccgtggacaatgccagcatgccacctgtgaaggtggaattctccctgactgatatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgatctccccccaacaagaaggaattctccagctgaatgcctttggaaatgaaatgacaactcttccttgatcaccagcataccagccccaagg

SEQ ID NO: 559062 - DNA, 695 bp, Homo sapiens
cggacgcgtggcgccagagtggcagttgtgcagcacgcgccctctgagtccgtggacaatgccagcatgccacctgtgaaggtggaattctccctgactgatatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgttcctcatcccagtacgttcctcataacagtacgttcctcatcccagtacg

SEQ ID NO: 559063 - DNA, 440 bp, Homo sapiens
  misc_feature (413)..(413): n is a, c, g, or t
  misc_feature (437)..(437): n is a, c, g, or t
ctgagctgcccccagctctgcaatggaaagcatcaggctggacttggacattctgggtgggaagtgtctggaacctggacgctggcttggagaggagcctcaggaggaatcgccaggattctcagctgtcgagaatgtcacccgctgctgtactcccaacagcaagggaggcacctggcacgtcgtgagcaactctcgtgtatttgttgcatgatctagtccaagaatggccaatgagtttcacctgccagttttcacaggcctgtgtgccgagagtgttccttaccattttttcattattattctgctaaggaggatttttagacattatgttcctagtcaagccctcacctctgcaatgaaattatgataccactgttgacccaaagatgagcagcaagcgctagaactgnagggaaatcatggtgagaatttantct

SEQ ID NO: 559064 - DNA, 329 bp, Homo sapiens
gtcctcacagcaaccctacgctcccccatccactcaccctgcctccattcctgtcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 559065 - DNA, 230 bp, Homo sapiens
tagcagctatcggtcaatcttctctttaaacctattttaaatgactacttactctcaacccttacaaatggagacttccgatcaagcgtggtggctcacgcctgtaatcccagaactttgggaggcctaggcgggtggattacctgaggttgggagttcgagaccagcctggccaacatggagaaaccctgtctctactaaaaatacaaaaaattgaaccggatagcttg

SEQ ID NO: 559066 - DNA, 385 bp, Homo sapiens
gcggccatggcgcactgggaaagctgctcaaggagcagaggtacgaccggcagctgaaggcgattctccatacatttgacagctgtctgggcccttatggggcataccagtggagtggaaagatggatgctcagcaaacaaaaccaaatgaggccaggtacagtggcttgtgcctgtagtcccagcactctagaggctgaggttgtggggtgatcatgggcaagaggctttagaatctctcatgtttgcctaataaatgcacagcacaggactgaaattcttaaaacttggtactacaggtattgggtcggttacaattattgatggaatcaggtcagcggggaggatgcttggaacaatttcttcctcaaaggagcagtatcgg

SEQ ID NO: 559067 - DNA, 328 bp, Homo sapiens
  misc_feature (98)..(98): n is a, c, g, or t
  misc_feature (323)..(323): n is a, c, g, or t
gcacatgtctgtaatctcagctattcaggaggctgaggcaggagaatcgcttaaacctgtgaggtgaaagttgcagtgagccgagatcatgccactgnactcctgcctggacaacaagagcgaaactcaatctcaaacaaacaaacataaatgaaaaggctgggtgcagtggctcacacccgtaatcccaatgctttgggaggccaaggaaggaggatcacttgagctcagggagtttgaggctatgggtgaactatgattgtgccattgcattccaacctggggcaacaaggagtgaggttcaaggagtgaggacctctttnaaaaa

SEQ ID NO: 559068 - DNA, 283 bp, Homo sapiens
cgctctggaaaaagtgaatcttgtctatataaaagctttttttaatggccgggcacagtggctcatgcctgtaatcccagcactttgtgaggccgaggcgggcggatcacaaggtctaggagttcacgaccagccgtggccaccattggttaaaccccgtctctacaaaaatacaaaaattagctgggcacagtggctcacacctgtaatcccagcattttaagaggccaagacaggtggatctcttgaggtcagaagtaagagaccagatgggccaacatgg

SEQ ID NO: 559069 - DNA, 1514 bp, Homo sapiens
gcgcctgtcgccgatgaagccggcgctatctcggtgtcgctcctggtcgtggcgcggcttgccatgtggcgccgcgatggagtagctaccaaagatcctgaccgattgagcatcgctggcggtggcttgtcagcgagtcccggtggcagggcgtcctggtggtactcaggctcgcgtccgaggcgccgccaggtgcgagcgcggcgtcttggggcgaagcccggaatgtcactgtctgacagcgtccgggacgcagcatggtgcggcttgtcctcgtttgtatccaggatccctgcgactacgatgtcactcgtcgttcctccccgtgacactccttgcagacagattgtacccgcgtttcatgcgtcttccatatgcggtgcagtggcacgtctccctcaatgcttcttaacggctgtgtcgtggggactttgataggccttggtgtttcccatggccactgaaaccgcgggacgccgtgcctgaggccctgcaggaatgatcgggactccggatcagctgtgcatcggggggtcgacctcacggttctcgcggacaactcatttgcgttcttcgggcctgattcgatgggtcgccatcctggagcgttccgcgttgggtggcaacccgggtcccattcgcggggtgcccggccctctggttgttgcgcatttgggcccttagagttcgtgggcagttaatttcctcttcggatgctagggccacaagggccataacgcttgaggcgtcgtaacataaaggcgttatgccggtgggaagaaggcactcgaagggagacccgcggtcggctccatgggagcgaagagaggagtctggtagctaattggcccagagggtgtcgcaacgtgggtccctgattttccccctccgaggtaccaggtcgcttatctaaataccccctggtggtcaccacccccctgtgtgtttggacccctgagtccactcagggacgatttccagagatcccgtatgctttggcgcgtttcccaagggacggtccgacgcccctgggttcggcctcgggggttttgggcgtgacttccacgacatgtagatccgtgggcatattccttaaccctagagatagcccgcgggggtggcttaaggggtgccacattgcgccagggctcttggggggaagttagccccatttccaggtccagacggcgacctatgcggctaatcaggcgatcggctcgaagatatggtcactgcaatggatgccataacagagcggctttatgcggtgtgcacgacgccgcccagaacagccttcttaggcacacaagaggcacgaaccactaggttcagttgttcggccccacaagtgaatcatttgtcaataaagtgaacaacagaaagtttgcaactttgcccgcagacgcttgcaggagtacaagatgaacagcgcgagagatccctacggcagattttgtccgagatggccgcggggacccactcaaggcctccagggcttggtggagaatcaacac

SEQ ID NO: 559070 - DNA, 359 bp, Homo sapiens
  misc_feature (27)..(27): n is a, c, g, or t
  misc_feature (54)..(54): n is a, c, g, or t
  misc_feature (71)..(71): n is a, c, g, or t
  misc_feature (79)..(79): n is a, c, g, or t
  misc_feature (141)..(141): n is a, c, g, or t
  misc_feature (206)..(206): n is a, c, g, or t
  misc_feature (215)..(215): n is a, c, g, or t
  misc_feature (230)..(230): n is a, c, g, or t
  misc_feature (238)..(238): n is a, c, g, or t
actaagctgggcgtggtggcgggctgntggtcccagctactcgggaagctgagncaggagaattgcttgancggggggnggaagttgcagtgaccgagattgtccactgtactcagcctgggtgacagagtgacactctgnctcaaaaaaaaaaaaaaaggacaggcacgacagtgctcacgccctttgatccagcactttggagnccgatcagncggatcacatgaggncaggagtnaagaccaacctggccaatatggtgaaaccccgtctctactaaaaatacaaaaattagctgggcatgatggccgggtgcctgtaatccagctactcggtaggcggaggttgcggtgacttga

SEQ ID NO: 559071 - DNA, 415 bp, Homo sapiens
ggttgggagattttgaggcttttagaaaaaagcggcaaaaccccccagaaaaaaaacgaggaatacaggaactggcaaacccgccagctttaaaaagaaaaagggcgaaaggcacctacagcaacaaaagaacaaccaccatccctgctacaaagccgttaatgaaaaaaaaaagatcaccgggcgaaagaacacccactccaggaaagacaacacccttccacttcaaaggataaaaaccccaaagcaagttaaggccctacaagggcccccgaacaaaggaaaaaaacaaggcccgccaacttgggggggtgagaaaaaaaccctttatggagacaaagtagtaaccgaggccaaagaaaccgccgaactgaaaagaataacaggccaggcgggaaccattaaaaaaaacccg

SEQ ID NO: 559072 - DNA, 372 bp, Homo sapiens
tctggaagccgagtcggcctgaggtctaaggggcggagggaactccaagcttggcctggagctcagggaagggagctcgcgtggacttcaggagcccggtgggtgcttcctgtgcacaaacgggcagggtctgagctcccaccgtctggaaatgctgcccagtggatttcagcctcattttacccagctcccaatcaagatggaattgctctggttcaaacgcctacgttcgccagctagggggtgaaccggccacagatccccggaggccaacagaagacagagcccctgggtcagaggcaaggacggttgacttctcaggcagggaggtggccaagggaatcgcttctgcggcggcttcccaagcgaaaa

SEQ ID NO: 559073 - DNA, 317 bp, Homo sapiens
  misc_feature (293)..(293): n is a, c, g, or t
ctaatagtagtgtaaagtggtggactgctctacagagcagcacagtggttcctcaaaaagttgaacatagaattactatatgacccagtaattccactttgaggtatatagccccaataattaaatgcagggacccaaaaagatatttgcatagcaatgtttacagcagcagtactcacagtagccagaaggtggaagcaacatcatgcccactggtggatgaatggataaacaaatgtgatatttgcacgcaatggaatattattggatattattcctttttaaaggaaggngattcttgacacatttcaccatgt

SEQ ID NO: 559074 - DNA, 387 bp, Homo sapiens
ttttttttttaatgttctgaacccttaggaagaagttaaatcttaaatcttattagttgaattgttgtaaggcccgtgatgtctggtacccaaatgtgactttttgggagccccgttggggttccttcttttccaatccatttttgtttaaaaccaaccccagttttagaaacccaagcctttaaaaaaaaccccctccgttttatgggccatatgtaaataaataaatgtaatatttccccccttttttttccgggaaaaggtcccgctgttcccggggtagtttgggggcctaaataaaacttcccaattaaattttttaaaatttggctgatttccaaaactgtgaaaaataaaaaaggggttgttttgcttgtgagaacttga

SEQ ID NO: 559075 - DNA, 910 bp, Homo sapiens
  misc_feature (153)..(153): n is a, c, g, or t
gggatatctgctacctagtctaatacacagcatgaatctcactgggggctgctgatacccgcggacatggagaacagtaagggagcagagtggttaaggacatttcagagaacttgaactattctggaataaggaatgaatcaactgtacctngaggccagcaggatttcttaagtaaatcggttacttgccgtattcctcacccaggtatagagtcagtcgtcgtgctacgttggtgtcacctattgtcggaagacacagatgtcatgggattagactagattctgctctaatggtgtgtgcataccattcataggcaagtggcgccttgattctttgcatgtttgagtcaagaccattcgcatatcatgaatttacgcttggttttagatataggagtattggggcttaaaacgtagtggtcaatgtggttattcttaagtggtagcaattgttcttgagtaaattgttgactgggtgtaaaaatgggactatagacgtaggcaaagtcaagtttataagagtattgttacagagatttgcagtagcccatttgatgattatgcagtggtggtaagtttcagcgcaagtttaaggatgcaaggtttataatatttcaaggataggacattaatgccattggtaagtaagggggtacaagaccaggagacacggccttggttggttcttcttaaccttttgaagttattaaatgtagctttgtaagcacaatcttaaagagggttttcccgcgtggtagaggtaagtttttaaagcactgaaatatcagaccaagcaccgtaagagcaggtcccagacgcgaaacgagtgagcacagagaatacacagaagtgcaaagtcaatgatagcagcgaggatcaccacacgcgaggtatacgaagagaaactg

SEQ ID NO: 559076 - DNA, 107 bp, Homo sapiens
attcttttaaagttgaaaataaccttcgtggctcaccgatatttatcatgttacctgtggtctccaagatatgtgtattccataacttatatcttagatgtccatat

SEQ ID NO: 559077 - DNA, 861 bp, Homo sapiens
gggtttacgggatgcgccctcggggctgaaggcggtggtgggggaaaaaattctgagccggagttattcggagggtcaagaaggatggggagtggaaggtgcttatcatggatcacccaagacatgcgcatcttgtcttcctgctgacaaaatgtcagatatcctggctgagggcatcaccattgttgaagacatcaacaaagcggcgggaacccattcccagtctgttaggccatttatttgctgagaccccacggagaagtcggttcaggccctgatcaaagacgttccaggggaccccgacatttcaccgtacaaagcggaccatatcttcttcaccgaacacactgccccgagccccgtgaacagatgacgctaggccggacttctcgcctggcaaaaggatggtgaacgaccgtagaaagggagattcaaccccttggacctaacctacccctaagaaggacccaagggatgatctccacgcatcgaagcgctcgcccaaaagagcatccataacacaacacatcataacagagcaccaattcccgagggacagaaagggacgcacgctacaggcagcgacaactcaggacgtgatggcacgagacccatagacaagaagttagccaacagacctaggtgcccgccccacaccaccttcgcaagggcaagatacccccagggccccaaatccggcgtacaccaggccacgggcgacccccacgacacggaaccccaggccgcaacggcacggcacacacggcccggacccgtggacaccaggcagagggacagcacactgcacagggcaagaagcaagcccccagaacacgcgaacgacaggacccaaggcgcaca

SEQ ID NO: 559078 - DNA, 385 bp, Homo sapiens
tgatctagacgatccctagctggtcgcagtctcagagtctgtgtcgtagcccctttttgcagaagagggtttttggccactggtccagtgtcatccttgatcttcttgagccgggccttggttctttgggtggaaatggagaaaggtgaagggagttcttggttgaactcaaggcgggaagaaaactaaattttcattaaaacgggtcttggaacaccttgcaaaatacggtttccctggcccgggttaacagctttcctggtcccttggaggattcagaacatttgtctgttttcctgggctttggctttgggctgaagcccaaaaaatgggacgcctggtctgcagtttcctttggtcatccaatcctcttttccgggggggt

SEQ ID NO: 559079 - DNA, 452 bp, Homo sapiens
agtcgagaataaggatgggaaaagaatatatcagggatcaggacaagggcgggaagccaatcaaaggaaaaaagaataacaataaagtgttataggagctgaaggacaaagtagctggtataataaaaaaaagaaactaactgatctgaaagcgccaagataacacaatacaagaatttcacaaggcaatcacaagtatgaacagcagaaaaaaccaatctgaggaatgaatctcagaacttgaagatgggttctctaaaataagatggacaaaaataaaaaagaatgaacaaaaccttcaaggagcatgggattatataaagaagccaattctacaaatcactggcatctctgaaagggaggtggagaaatcaaataactgggaaaacatttcaggaagaaatgggctttggttacaaaatataactgtctgcctttgggggatggtttaa

SEQ ID NO: 559080 - DNA, 128 bp, Homo sapiens
gtacttaggggagcgtgcctcccatgaggaggtggcgggcttggtggagaagatccgcttccccatgatgctaccctaaggagctctttgagctgcagtacaacctggtccctgatactgggagccac

SEQ ID NO: 559081 - DNA, 1000 bp, Homo sapiens
taactgggacgtgtgcgcagacatggtgggcaccttcacagactaccgaggaccctggccaaggttcaagatgaagtactggggcgtagcctcctttcgtccagagaaggtagaatgagtgaccactggcatcgtcgactacagatctacgactacgtatgccgtgcagtactcctgccgactcctgaacctcgatggcacctgtgctgatcagctactcctatcgtgttattcctgtgggaccccaaacggggctgaccccagagagctgcagacagattgtcatggcatgcggcaaggaggagctgtgcctgggcaggcagtacgggctgatcgtccacaacggttactgcgatggcagatctgactcgaaaccttttgtacgcaatagtcaaagaatctagttgcatctgagaacttctgattagtctcagtcttcagctcgtagttgatcttaggagttgaacttggccttgtctcccccatcttccacgtcgaggtccgcataagaccgttcagttagcacgaaatcaggcatcaaaaagaagactaagatggcataaccaggtggtgcaagaagtgtgagtcccaggaaaactcttatacaagaatttgtgaaggtgcggggaggtctccaaaagaggaataagtcaagtgtgtaaatagcagttgacagatgggaacactaggtacttaaagtctgagtggggctgttctacgtagaaaaaataagcccggtggagaactcgaggtgctttggtaaaccttctcaagaaaggagacacactagaggggacacaacaaaggggggcgaatctctacaacgacaggtgttctcccacgagaaggggcttgcagagctctcagatatattggccgccgaacagggggggtcatacaaatactaccacggacatgaaaacattcagagagagagaggcgaccagacagaggaagaagcgagaacacacaacggcaaatgaagccgcaatgagacatg

SEQ ID NO: 559082 - DNA, 254 bp, Homo sapiens
tttttcagcacgctggcgtgctgcagtgcagtgtcgcatctctcgagctccgcaatcctctacttccggggctcaagtgattcttccacctcagcctcccaagtagctgggactattggcgtgtgccaccattcccaccgattatttttgtcttttttttggtagagactgggcttcaccatgttggtcagtctggtctcaaactcctgacctcaactgacccacctaccttggactccagcgtgctgatacaa

SEQ ID NO: 559083 - DNA, 216 bp, Homo sapiens
cttccttttccctttctcggttctcttctctcctctgaatggctgaaggaccctctgcccggggaggttggggattttggacaaggtcccctggtgctgatggcctgaaggggcctgggctttgggcagatgcagttttctttgggcttggggaacctctcccgttgctgtgtcctggtgggcagcccgcccaataaacctgcttttctaaaagga

SEQ ID NO: 559084 - DNA, 1044 bp, Homo sapiens
ggttattaggagtctatatcttttcttttatagacagagtttgtgcgtctatggtagcctaggctggagtgcagtggctgcagtcttggctcacctcaacctctgcctcccaggttcaggctattctcctgctcagcctcctgattagctgggattacaggcatgcgccaccatgaccggctaattttatatttttagtagagacgggatatctccgtgttggtcagatctggtctcaaactcccgacctcaggtgatccacaccgactcagaactcccaaagtgctgggattacaggcatgagccaccgaacccagcctggttatgggattcatttattatattttgagataaagccttgctctgtcaccaggccggagtgcagtggtgtcatctcagctcactggaagctccatctcccaggttcaagcgattcccctgcctcagactgccaagtagctgggattacaaggcatgcgccaccatgcacagctaattgtctccagtagatatggagttaacacacgattggcaagacagactcgatttcctgaccttgatgatcccactgactcggactcccaaagtgctgggatcaccggcatgagacaccaaacctgatcgggccacttgattataaatacgcacactctcaacaataatgtcaggatacatttttgtcacagacatcactgacgttaagctcctgaaactgatgatgtccaagacattaatgtagcatacacggggaaatgaataccaatatttaggccattacactctggaatataggacaaaggcttacgtcaagaatagcaatccaacaatgtaaaaagaatatcaaccgataagcatacaatcaacaccacacaaaattatcaccatgcaaaaaatgaactcacaaatcaacacaacaccaccacacaaaacaatctaaacaaacaaacagataccctcatgaccacaacacaatcaaatcaagcataccactcgtcaatcactatcctaccaccccacatcctccccagcaagcaacgagggacg

SEQ ID NO: 559085 - DNA, 263 bp, Homo sapiens
  misc_feature (80)..(80): n is a, c, g, or t
tagctgctatccgtgtgactatcggctttcgtcgattccggagcaaacatcaatcactcctgagttccatcaatcactcntgggctgcagtcacctatccggacccgttttactgctacgcggagccccaccgggccttcacaactggactgccaacgttatctacccaaaggagatccgtctggctcctccgtcgcgacgttacctgaacgcccatctgcagcctgcgtcgacgcggacgcgaatttagtagtagtaggcgg

SEQ ID NO: 559086 - DNA, 359 bp, Homo sapiens
  misc_feature (240)..(240): n is a, c, g, or t
  misc_feature (280)..(280): n is a, c, g, or t
  misc_feature (282)..(282): n is a, c, g, or t
  misc_feature (327)..(327): n is a, c, g, or t
  misc_feature (351)..(351): n is a, c, g, or t
tgcgacagagtcttgcactgtcacctgggctggagtgcagtggtgcaatctcagctcactgcaacctctgccttccgggttcaagccattctcctgcctcagcctcccaggtagctgggattacaggcacctgccaccatgcccagctaactttttgtattgttttttttagtagagatggggtttcactatgttggccaggctggtctcaaactcctgacctcgtgatctgtgcgcctnggccccccaaagttctgggagtacaggcgtgaaccaccgngnccggctggggctgcttatttaaatcccctagaaagagggattctncagctacaccacacccttaacttngaaggacc

SEQ ID NO: 559087 - DNA, 184 bp, Homo sapiens
agttattgtaagtctagtttatctattttggtggtggttttggtgcttctggtgtggcatcttaaaaaaccatggcctaagtcagtatcacagatttacttctgtgttttctggccaagagctgtatagttttagctcttacatttaggtttcgggtccatttggagttagtttcggtgtaagg

SEQ ID NO: 559088 - DNA, 538 bp, Homo sapiens
  misc_feature (377)..(377): n is a, c, g, or t
gaaaagtaataaaaagagttcagttaactcattctgaacatgggcattggctatagagcagattgcttggtatacagcaagcactgtcagtaaatgcttatcaaagaaagaaggagaggccgggcatggtggctcatgcctgtaatccccacactttgggaggccaagaggtgggaggatcaccctgaggtcaaggagttcgagaccaatcctggccaacgtggtgaaacccccaatctctactaaaaaatacaaaaaaaaaaaaaaaaaaaggagggaaaaagggtttacgccagattgattactaaaacggtctcattctcaggggccctctttttaaacggtctttaaaaatttatttttaggggctaattgcnttccccttccccgtaagggggctttaaaacctagatgatgtgttgatagctgcagcaaacgaccatgggcacattgttattacctgtgtaacaaacctgcacgttcttacacttgttttcccagaacttaagcgtaaatttaaacaaacaaaaaaaaaaac

SEQ ID NO: 559089 - DNA, 798 bp, Homo sapiens
atcggttgaggccagaagtccaagaccagcctgggcaacataggcgagaatctgtctctacaacaacaacaaaaaaattaaataagaaatgaggccaggagtggtgctcatgcttgtaatcccagtacattgagaggccgaggcaggcagatcacctgaggtcaggagttcgagaccagcctggccaacaatggcaaatccgtgtctctaccaaaaaaaaaaaaaaaaaaaacacaaaaattatagctcggggtgtgtgagtggcgtgtgcccctgtgttggttcccagctatacctcgggaggcgtgagggtgggagaaatctcgcttggaacctggggagggcaagaggtggttggcagtggagccagagatcacggccacgtggcactccacctcgggtgtggacacaggcggagaccctggtctcaaaaaaaaaaaaagaaagaagaaaaatattagcgctgggccatgggtgggcatggtgcgcctggtaagtcccgagcactaacgtggggaagctccggagagggcgggagaggaactcgcttgtggagcccccagaagagggccggaggccgtgaaagagtgagaggccacatgagcattgggtgccccaggggtgcaactctcccagcccgttgtttggaacaagaaggaaaaataccctataatttcaaaaaaacagaaaaacaaaaaaagaaaggttacgggacggcgggtataacgagggaacaagtgttggggaacacacaggtgtgcccccaggacgcaagaggaggcccaccagagggacccc

SEQ ID NO: 559090 - DNA, 1015 bp, Homo sapiens
gctaagagccttccatgggctccctactgcctacagcgtatgaatcgcaacaagtcatactctttgagactttgaaggttctccaccctgtggccccatcgctccccacagagctactatcctcattactgtctctgttaccctgacttatgggcagatggcgtagtcctcaactgtgacccacgactacacctctgcccacgactgccagcctcctttaccacaggttacaggcatctcagatatcgctcaccaaccgctactgcactacatctcacgtccagtgcccccagagacatgcaatgtgcaacgcccaaggcctggcacttgaaaagaagagatacaatcccgagaactgcccagctttcacgccccacaaggcccagtaggctccatagaatcatcgctcaaccaggtgttcatccgtcacgtcggtcgttgtcaaacgctatacgcacactcggcacgtcaagaaacggacaaaggcattcaagaaaccgtccacccctcccccctccctcgtgctcaggaaccacttccacgccactacagcaacccatgtgcgcatcgacccctcagacctacagcaccatatgcacactgaacactcctggcaaacgctcccaacggctctgggcaccgcctttcaacccaaatccatgagctctctttaccgcgagcccgaccatcctcgacgactcatacttcaacatactcagccaactacaaccattacattgtgtgtccaccatggcatccacaccccccaattgtgcacatccccaccccaccacagcaccacaccaccctataggccagccaccccagcgcccacccaccactagcaaacacaacaccctctggcaccaacaccacgggaggcaccgccgtggaagagcccacccggcggccaacgacacaacaccgcggcaccaccgcccatcaaccaccaccaccaccccagcggcccaggatccaagccacggaaactcacgacacagagcaacgaccacac

SEQ ID NO: 559091 - DNA, 234 bp, Homo sapiens
caagcgattctcctgactcagtctcccgagtagctgggtactacaggccgtgctaccatcacgcccagctaatttgtgctatttttagtagcaggacggggtttcactgctgattggacaggaatggtctcgcatctcctgcattgtgtgtatctgtacctccctgtgcccttcccaaagttactggggcaggccatcatcataattggcttaccacccaatgtctgctgtctg

SEQ ID NO: 559092 - DNA, 588 bp, Homo sapiens
  misc_feature (364)..(364): n is a, c, g, or t
  misc_feature (393)..(393): n is a, c, g, or t
  misc_feature (403)..(404): n is a, c, g, or t
  misc_feature (408)..(409): n is a, c, g, or t
  misc_feature (490)..(490): n is a, c, g, or t
  misc_feature (494)..(494): n is a, c, g, or t
cgcgcaggcggttggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccaggccccagccccaagcccagtctcagccaccgatcatccaacaagcgtcccagcaatagcacgccgacacccccacgcagctcagcaaaatcaagtactcagggagggccccagattgtcaagaaggagcngacaggcaaagctcctcccgcatatcaancatcagcaannaatnngggagctgcagaagcttcctgccactgaaagatatcgacaacccgaggagcgggaaggagctgtatatccaggaagctacnccangtgctgatgtcacatctatagacataacgatggtcagaagcacaatacagtgaacctcaaaattcaaaaggagagtgaagacgggcaaggaaat

SEQ ID NO: 559093 - DNA, 273 bp, Homo sapiens
aaggcgcaagtaagagctgtatgcaacaagtgctaaatggactgcactgctacacgctcctctttgtaggacaccataccacagatgctcataacacttgaccagactatcccgatgacaactggctctgggatgtagtatattaaccatctcctccttaacatataaaattatatccttaaatggatcaccacgggacatctgtccttgaagtacttactggagctccttacgagctccgatggttggctgataccgaacatatactgaaag

SEQ ID NO: 559094 - DNA, 130 bp, Homo sapiens
ccaactttttttaaggggggggaaaatttaaaaaaggtccttttaaaggggaacccgtaaaatgtttttaaaattggggtcccaaccccttgggggcccgaaaaaaaaaaagggaatttttttctttcca

SEQ ID NO: 559095 - DNA, 747 bp, Homo sapiens
  misc_feature (465)..(465): n is a, c, g, or t
  misc_feature (467)..(468): n is a, c, g, or t
  misc_feature (474)..(475): n is a, c, g, or t
  misc_feature (479)..(480): n is a, c, g, or t
  misc_feature (487)..(489): n is a, c, g, or t
  misc_feature (509)..(509): n is a, c, g, or t
  misc_feature (514)..(514): n is a, c, g, or t
  misc_feature (524)..(524): n is a, c, g, or t
  misc_feature (541)..(541): n is a, c, g, or t
  misc_feature (548)..(548): n is a, c, g, or t
  misc_feature (555)..(555): n is a, c, g, or t
  misc_feature (560)..(560): n is a, c, g, or t
  misc_feature (563)..(563): n is a, c, g, or t
  misc_feature (565)..(565): n is a, c, g, or t
  misc_feature (575)..(575): n is a, c, g, or t
  misc_feature (577)..(577): n is a, c, g, or t
  misc_feature (584)..(584): n is a, c, g, or t
  misc_feature (732)..(732): n is a, c, g, or t
cgcgcaggcggttggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccaggccccagccccaagcccagtctcagccaccgatcatccaacaagcgtcccagcaatagcacgccgacacccccacgcagctcagcaaaatcaagtactcagggagggccccagattgtcaagaaggagctgtttatccagaagctacgccagtgctgtgtcctctttgacttcgtgtcagacccactcagtgacctcaaattcaaggaggtgaagcgggcaggatcaacgnannggtggnnttannccacccnnnccgtggatgttgtctatgtngcctntttacctgtngctgtctacatgttttntatgtancttcttncgggngcntnctaccttcangnaatccancaggggcctagttttgacccagaggaagatgagcccaccctggaagctgcttggccacatctccagctcgtgtatgagttcttcttacgtttccttgagtctcctgatttccagccaaacatagccaagaagtacatcgaccagaagnttgtacttgctctcc

SEQ ID NO: 559096 - DNA, 196 bp, Homo sapiens
tccattatttgtttcgtgggttaaagccggcaggagagggactgcttggggccactgcggtggtccagcgcaagaggatagcaaagtgcaggctaaatcagacatctgcgagaacagagtcagaggcaggcagattgcagaggtgttggaaggatagctggcaggagtggcaccggggagatcgcccttgatcgta

SEQ ID NO: 559097 - DNA, 296 bp, Homo sapiens
  misc_feature (114)..(114): n is a, c, g, or t
  misc_feature (117)..(117): n is a, c, g, or t
agctcctaaaatagaaatttccttttatggatagaaggccagaattttgagaagaaactaaattttcccccaattttaaggaaaaattgtccttatctaaaaatgtttttatanatntgcttcatcttcccttcatactttgaaattccctatagcagccagagctagggaaatattaaaaatttcccctatttattttttggaactaaatcaacccttaactatacccttatgagagtaatgggaactcctgctggctttaagtaaataaaagtccttgttttcccccgtatata

SEQ ID NO: 559098 - DNA, 138 bp, Homo sapiens
tattttatgaccataacacgaaaacaacatcttgtgttagaccctcggatgcctaatacaagcagcagaatgccactgtgaagagtgtgaacgatgatgaatggggtacacaccgaggtagctggactagtgaactag

SEQ ID NO: 559099 - DNA, 101 bp, Homo sapiens
  misc_feature (76)..(76): n is a, c, g, or t
gacatttttatcatcccccaaaagaaacctcatactcattagcagacattccccatacatgtacatcttgaactcnggaggcggagattgcagtgagccga

SEQ ID NO: 559100 - DNA, 407 bp, Homo sapiens
ggggtttttatccccccccaaagccagtgaaggatatccccccccggttttttaaaaaaaggcagcctaaatccaattgaaattagccttgggcctggtccgtcgttcctaatgaataaaaatcaagtgccaaagcttcagccccagataattatgattcctcttagtgcccaaccccacgccactcaaacaccccctttgggacagacccctcaggttggtctcaaaactaatcccccccttatccaggaaaagcctgccaagaccagcaaaaagccccccccgtcaaaggaagaaccccttaaactaactgaaactgttgtgactgaatatttaaatagtggaaatccaaatggggctgtcaatggtgtaaaaaaaatgagggctcctaaacccccccgttttta

SEQ ID NO: 559101 - DNA, 299 bp, Homo sapiens
ctgcacctatccccacagtgagaaagcagccaagatccgggctcgggactcttttccctctcccgaaacataactggttttgtatgtgctctgagtcctagtatttatgtcttggctgagaaccacagaaaggactagatatacatacatgcgagagcacatctagggcattgcatgtttatttgggcatattgctagaaaaacttccgcataggacttgccagaactcagtgcctgtaaccaagtttacggtcatctagttcctctcacaatttcaaaatgtcagatcagaagattct

SEQ ID NO: 559102 - DNA, 1054 bp, Homo sapiens
ggcgaaagcccgcgtcggagggcgactgcctggtgagcgggagcggcgcagggctcggggcgggcggccatgctcatgccccatgctgccatgctgccatgcgccatgcgcggtgctgatgctctgcgggaacgaatgggatgactccatggctgcgacatgcatgccgctggctccgtagccccagctgtctgcccaagtgctccctgaccctgctgggacaaatgacgacagaggcttctgtgtgttgcccgaatggcctctggaacgtggcctgcatgagaggcaaccgtgtctgcctgtgcttgcttttgtccatgccctgatggcccaagcgaactgcggcagatgatgctgtggctgcttcctgatggactctgcctgaggtgatgctgcctgatgggcaaccttgctctgccgctgtctccggccctgccctgcctgtgccctcggtgcttttgtgcctgcacttgggctccggctgcagaagagtcagccggcactcgagcgccgaggggggcaccgtgccctgcaccagcccgagtggagtcagtcggcaaggcagccgcacgctggaggtagaggggaagagctgagctaagcgctgagccgggaaggaagccaccaggccaaggcggtggaactgcgcgctccgagggagctcagagccgagctgggaggactgtcagcttccacccatgccccgggctcttgccccaaatccactggagcgctgagctcggaacttgaaaactctctggtccccaggtttccccccgatctcatctccctttgcttgcggatggttggggtcttcctgtttctccgggcccctgagcttgggggacgactttacttcggggcgcaagattgttttatggcccgttattcgtggagagttgtggacgagcatccgagagttaaagaggccattttcaagccccggggaatcccgggcccatatataagtacgattgaggaaagtcaagggagagaaactcgcgggttttaacagaggatgaaggtacacgtaaattgaatcattaggggcctg

SEQ ID NO: 559103 - DNA, 1184 bp, Homo sapiens
  misc_feature (386)..(386): n is a, c, g, or t
  misc_feature (397)..(397): n is a, c, g, or t
  misc_feature (425)..(425): n is a, c, g, or t
  misc_feature (616)..(616): n is a, c, g, or t
  misc_feature (692)..(692): n is a, c, g, or t
  misc_feature (700)..(700): n is a, c, g, or t
  misc_feature (717)..(717): n is a, c, g, or t
  misc_feature (770)..(770): n is a, c, g, or t
  misc_feature (797)..(797): n is a, c, g, or t
  misc_feature (897)..(897): n is a, c, g, or t
  misc_feature (948)..(948): n is a, c, g, or t
taggtctatggttttcctcgacgttcttgagtcgggaaactggccgctgatggtggttagcaatcggagatagaattcccaggaacacgcgatctcggcgatgtcatcgaattcgaatttatgcagtttcaagtgtctcttcatgatgcagttcatactcgcgaggcaacgaagatttttgcaccagttgagtctccgagaagacctttcaactatggaggcgttgctgtagatgcctgcctaactaatacacgcaacgcgatgcaaaacgcaaacactggggtctcgcctctcaactatcgtatgactcgacaagtttgccgttcaacacgtgtacgaacagatccgttagcactgcagcgagactgcttaagctctgcgtacgnaggttcagagnacttcgaaagtactcatactaattcctnagtcaataggacagtcggcagtgacgacagattacttagcgtgctacctacgtgttccacaagtaatcaaatatacatgtccagcagcggatcctacgctaatgattaaacgtaggcacctctgttcacctgcgttacatctccttgacggcaacgagttataagtactgctacgggccagtacctataanacaagaggacgagaacttcaccacctcaaccaaccggtcgcaccacatgcaccgttagcagcaagcctcctcttancttgtggncgcttactctagcgaancggtgcaccatacgcgctcgcgccttacgcaacggcgggcctaccttgtcacnttgcgacaccgaggtacgcgtgcaccncgcaccgacgtctcaccgcgacggttcagctactactacaggaccggagaccttgctgcatcctcattggacggaaggctcatcgtgtcctcgtaggcgnacaagcacttacctacacgagccggaaacgttcgattattggagacaaggnctcctctcttaatacaacccacggcaacacggacatcccgaacttacaacaaccaggtcacacacaaggcagaaagagtttacaacacacacgaagcattacgaactcgcgcagttttccttctccctgcaacagcaattcccagcaaacggcacacaatcactccgcaccgtagcctcactactcacgactctctttcctagcgactctccgcagacacacttccaatccctcca

SEQ ID NO: 559104 - DNA, 256 bp, Homo sapiens
atatacatatacgaagcgagcgcttaacccagtgaatcgagtcgcgtactggatggatctctagagtctgaccatggctccagcataactgatattttggatgtgtcatgcactggtgctcactgtgtcgacggaacttgtacatgggaggcatgcacctgagagtggtgaactacactgtctgaccatggctccagtcttaactgatattttggatggtcatgcactggtgctcactgtgtctgacggatacttg

SEQ ID NO: 559105 - DNA, 1234 bp, Homo sapiens
gtgtgcagctgtgggtggtgcccgtgaggccctggttggccctggtgatggtggaacctgctggtggcttcctgctggagggtttctggcaagtggcattcgggggccaggggtcgctgggccgttggacgggggcctggggcccgatgtgccgcgtgaggcctcgccggatgttgcaatgggcctgaggcataagggagtggatagccctggtcaccaatggttgggccggcttgtgttcaacgggactatgtgaatgtatcaaggtcccttggctaggaggactctatactcttacttcccgtgccgcatctacagtgaactcatgacgatcgacttggcagttctcctatccgtggctgggccctcgtcatccaagtgaatcgaggcgttccgcgcaacgcactttatgcctagctgccacgatatgcatgacccctgcttgccggggccaagcgggccacctaggcgcttccaacggggccaccttatgacagcggcgctacctcgggagagcgaccttacccgaagtggtgacccaccgctcccgcgcccctagcggctcgctcacaaccggcttggcttccccaccaccgcacgcgctcgcgccccaaccgcgggcacacctccaccgatgtggcgcgcccaataccaatcccgtggggcccaaacggccttcttcacaactcctgcatgcccccgatggccgacaagcacgcggctaacctcgcgagcggacaaccacagacatcggagccaaacagccccacaacaacctgggtcgcctcgtttgtccacatcgcgtctcgcacctgctggccccgtcctgtccgtgccatcacttgctggcctcttgccgtataccggcgccatcacatactcccattgtgtcgcccccacgggggcggccccttggtgccagattcggggccttccgcgcaccccttgtgttgccccctcatctacaacgccctgccccacaaagctgaacgggccccgcggaccaaaaccccgcaacgcaacaccgtgtcgtcaacaaacccccctcctcagacacccccgacgagcgtcgtcccacacacgggcgccaccccccgacattaggcgcgcaaacacactatcgcgcccacacaatgcagccaccaacccactatagtgagtgtgcacaccacctcccaaacaacgaccgcccaaagcgcgtacaacctgtacgaagcacccgcagcagaacata

SEQ ID NO: 559106 - DNA, 166 bp, Homo sapiens
agcgggaggcctgggcgctgcggcggcaggaggaggacggggaaggacggagccgagccgcggctgcctccctcgtatccctgcatcggcataatataatactatagtaagggctaacggttttctttgggagtggtgtagttgtttggtggggattggttgatgc

SEQ ID NO: 559107 - DNA, 997 bp, Homo sapiens
tcctttgtcatccattcgcaacttggctatgggaagaaagtggctaattcagtacttttcccctgtaaatatgcgtcttctggatgtgaaatagactctgccacacacagaatagaagcagaccatgacagagctctgtgagtttaggccttattcctgtccgtgccctggtgcttccatgtaaatggcaaggcgtctctggatgctgtaatggcccatctgatgcatcagcataagtccattacaaggcctacagggagaggatatagttcttctgtgctacagacattaatcttcctggtgctgttgactgggtgatgatgcagtcctgtaatgggctttcacttcatgtcagtcttagagaaagccggcacaagctacgatggtcaccagccagtccttcgcaatcgtaccccctgataggaacacggcaagcaagctgaaaatttagcttaccgacttgagctaaatggtcactacggcgacgattgacttgggaaagcgactccatcgatctatttcatgacggaatggcaacagccattcatgaaatacgcgacctgtctagtcctatgacaaccagcaattgcacagcttatggcagaacaatgggaacttcaggcatccatgtcaactatttccatgtgtcggaaattggcaagtcaaagcatattctgggccacggtggttcacaacttcagtttcaccagacagatacgggaacccatctgtctggcaacctagaagctcttacgggaacgggggacgctcaaaccccttggcagggctaccatcacgaccgcaacgggctgtaacactaaccggcaaaccacgtggacatcgtaagacaccacacgccttttacacacatacgtcaccaggaaccccatgcacaaaatacttgcatatacacccccaaatcggcctctgtagactacgacaaggaaccttgtacaaacatcccagctacgagcgcgaaacacgtggctcggcacag

SEQ ID NO: 559108 - DNA, 195 bp, Homo sapiens
agagccaccatagtcactagaaaacaggccgaaaccaaataattcaagcagggctgcatgacaatttgagctagggcctctattataaacatgcctagaagcctcagagtacttcgagtctccgcttcaccatttccgacggcatctacggctcagcatttttagtagccacaggcttccacggtacttcagcgg

SEQ ID NO: 559109 - DNA, 334 bp, Homo sapiens
gggggaaagccccctttttcaaaacaaaaccccccctgataccttctttaaaaacccttttttttaaagattccaccatggggtttttggcggggggcgggggggcaaaaccccccttttcctggctcttcagttaatttaactgtgggccctggggaaaatcacttaacccctctgggctcccgcccccccttcttttaaaaggggggtaaccccccccccccggggtttttggggggtttaattagaaataatttctttaaaccctttagggttcttgaaggggcccctttttaaaaacaaaaaaatttcttttaaggggggttttttttta

SEQ ID NO: 559110 - DNA, 114 bp, Homo sapiens
gcgcaagtaggtctacaagacgctacttcccctatcatagaggagctatcaactttcatgatcacacgccctcataaatcaattttccctaaacctgcctcccagggcccggta

SEQ ID NO: 559111 - DNA, 1050 bp, Homo sapiens
ccttcgagctggtcagccagatctctgcttgaggacctgctccgaatcggagtcactctggcgggacaccaggaagaaaatcttggccagtgtcctacgcagcatgaagtcccaggccaagtccggtgaaccccgcgtgctgtggacaggaggaccggccccgcagtactgacctgcaggaactccccaccccaggacaccgcctccctcattttccggggcagagtggggactcacagagagccccctaggctcctgttgccccggctggaattgcacttatgagcctcgtgaggagtgcaggagttgggacaaactttggcagagactggattagggggttctgcacatacataggcaggggatagaatcacccccctaggcacctcgggggtaactccaaaccaagggtgaggggcgccttgttccctcaggtactgggggtgtgcaccatgaggaaaaaggaagtgcccaaacatctctcgcagggctaccccaggtgccaccgcctcagcttgcatgggtgcgtacccgcgagaccaaagagagtgtagacgtccctttggccagctccagaatggaaaagggcttgacccattggggtcgaagacaggcggtgtaatggacccagttacaaagcccttggagtaggagttcccacacttggctgtgtcaccaccaaaactctatccattcttcccccttgttaatgcccctcccacagactgttgacttccagtaatgcaaggctcggacgatatgtgaccagcgcataaattttctacccgtcccttgtggattctacggtgtgccatactaccgacctgacataacgtatgtgtccacaggaacctgtttgttatggcgtccttgcccaggttaagcagggccgcatcatgtgtgagcgacgaggcgggcatcccgatcccgccgcccggaccccacgtgcataaggcgaggtggagatataaaaggtagggtgacaccacgcaggtgggctgtgaaatcaacctgtatataaaaggcgcggagaaaagggctcaggcagca

SEQ ID NO: 559112 - DNA, 916 bp, Homo sapiens
gaccccaataggtgtgaagatgaatatcgaaccactcgaccagccctagcgctatggctccggaggtgtcggtccacactcaaatcgtgactactcttgagaaattgtgccacagaagtaagtctagtccgtatgctgcccgcttgtgacgcatgatttgatcgttgggggaggcttcagaaagacggactgcgctcttagggcagaactccggatacatacaccgatgtaagcaagacgagtacgacacgcatgtagccacgcacagtagtacggtcctacaggttagttcagcccaattaagaaggacgcgttcacagctcgcagagtcctactgacgctacagaaaacagtcgccaatagcactatagagctgaaattcatcccttggactagggcgcaaaagtgtggcgcacacgtgctaactgcgagctctatacgaaggaaccttacgggtgggagtactccaagataaattccgtggagcaaacattttctgcactctcggcatgaaccaactggggattccggcttatgtgacgattaacctgaacgctggacaaatgaaggcaggcggcaatattctaacaaattcaatccccccgaaaaggcccaaattaggtgaacccacgtccagcttggtgcaagcccccagggcacacgaagaggctatttgcctcgagttataggcagacagggctttgccggacacaagtttaccaacggtacggcgtcggactgaagttctgtacctccggacgtggttgtatccgaggggacaccatcaccctcctaggaagtctaccaggtacttagaagggcaccggcctgccccggggtaccgcccttgtttaacggggcgggggatacaccttacgcagtgcgaagggaagacaataatccttgtaaccttgta

SEQ ID NO: 559113 - DNA, 120 bp, Homo sapiens
  misc_feature (10)..(10): n is a, c, g, or t
gctagggtancacacaagggagacaactggaagaagagcctggaggatgtgaacagtgaacccatggacggagccgaagcaggacaggcccacgaagacggggatgatccaggacactga

SEQ ID NO: 559114 - DNA, 356 bp, Homo sapiens
  misc_feature (165)..(165): n is a, c, g, or t
catacacttgactcgacgggagacagggacctgcgctagagcggacctgcaaccatgcaggccgagagctgaccgaggacgaacaccgcggggaggcgctagaaccccaacagcccattggcaaccttctcatgtctggtcacagagaactgatttgtcctcagnacctctccgtccaccttcatgtacacagtgggcaccaccttcacaaagtactggaacatcatggaggcttggggcgcagtgacattggtgtggtccacggggttcacaatgcctggatagtcctccccaaatgacaggtgctggatgaagcgggccatgttgatgttgccaaggccaaagctctgcaagtc

SEQ ID NO: 559115 - DNA, 353 bp, Homo sapiens
gctgaatgaacatggcccgcgcggtggtgatgaaattaatatcccgcaaaaaggcaaaaactacggctgccgctggcaacctggggaatcaactattcaggctttaagataccggaagcgaaaggggagatcgtcgccgggaccgagcaacctgttttttactggaaagattcgcccgctgtgagcggcatggccttctataacagcgataaattcccccagtggcagcaaaaattatttattggcgcgctgaaagataaagatgtcattgtgatgagcgtcaacggcgacaaagtgacagaagatggccgtattttaacggacagagggcagcgaattcgtgatgttcgcac

SEQ ID NO: 559116 - DNA, 413 bp, Homo sapiens
aatcacacggtcccagtagtcacggtattcttcatcatgcactcacagaaaaagccagtttcacttaagatggccccagatgacagaataaaaatggttaattttataaatccttgacccatgaatacacatctttaaaaaacggtgagtgataacatgggaagcatgcatcaaacacttccacacacagaagtaccagagtggtctcagggaaagacatctgtgcacttctttgagtggggctgaactagctacttatctcagggagcaccatttttattgtgcagacctgatagaccaccacggatctaccagatgtggggtatggggccgacatatcctccaaatctgcagtacccctgtcacttcaagaaaaacaactcagtatttgtggtaacagaaaacatttaagc

SEQ ID NO: 559117 - DNA, 105 bp, Homo sapiens
ccatacagtattcaatgtttacactaacaccacccctatcatactctttcacccacagcaccaatcctacctccatcgctaaccccactaaaacactcaccaaga

SEQ ID NO: 559118 - DNA, 322 bp, Homo sapiens
gaaaggacgaacatagtatagactgtagaaggagctctacaataaactatatattataataaactactggcaaggaacttaccgagctgttctacatgttttcagttctctttgggggccatgtcctacattagcatggcatggatgcctgcattgcctcagtcaactcacttcacaaagctcttgccactggtatagcatcttgaacctctcatacttctcccactttttagcagcggcgtctatagtttatttcaaacgcttaacatcttcccaccgccaacagcttgcctctcggcagggggaattgttcgttccattt

SEQ ID NO: 559119 - DNA, 322 bp, Homo sapiens
gtatctctatacaagtgctacactttaaccaagacaagtggtttatcttatacccctttggactaatcgatttgaaaatctgaaagacattcttttattatttacatgtttcatcatcacctatgcctcatctacatattacgaatcgcttatgtcttaatacttaatgctttctatttattgctaggattttggtgaaacagagttttccaactcttcatccctcaatcatacacatataataacagcgcgtaacagtggacacataaatgagcactaggactattgatcgcgtttcactgttctttgttatacccttccg

SEQ ID NO: 559120 - DNA, 221 bp, Homo sapiens
gggccccctttaaaagcccctcccccctaggccgcctccaggtgttacccaggggtcccctccatgttcccccccccaactcagggaagggggtcctggggctccaagttcagcgctccaggtttgggacagggcctgcatgcagtcaggctggcagtggggcggtacagggagggaactggggcattttttagccccaggaataaaaatttgtttgccca

SEQ ID NO: 559121 - DNA, 864 bp, Homo sapiens
gaaaatcctcacgtgaggtgaagcgcaggcgagtagggccagacatggtggctcatgcctgtaatctcagcactttgggagactgagatgagaagatcacttgaggccaggagttcgagaccagactggccacatagtgagaccctggtctcttacaaaatgctggacaaaggagacagaggcgtgcggcccgtggtctcatacagccgtggactgtcctggaagagcacccagattgttccttctaggctggccaagccaccacttgatgatggctgagagggaagaggacggacgactactgaggaagcctggatgcgagcatacgggccacagaagccttgccgttcccagtgctgcggcagtggctgctcaccctgtgtggtttagacctctatcaccgagatctggcaacagtgggaggcagcccaaagccagcaaggacaggagcctgactgcgtgggccagagtcacagagctgccccatccaagctgaagccagagacgccttcgtggacttctgcatcattgcatggaccaggctcactaaggacacctaccgagtccggtttgctctaccgggaacagcagcttggctgcggccggcagcacctcatcctacgacagatagtagatgacttagagagtcccgacgagcctatacgcccatcagccctggcacggccgaaggatacttgaagtgttattagtgctagcagatgggctggtgtcccgaggtgagcctggagcgggaaaagagtacaggagagacatcgaattactctaaaacaaaaagatgggagcattgagtgggaggcggagccggggcctgggaggccagatgaagggctgaacgtggaactg

SEQ ID NO: 559122 - DNA, 202 bp, Homo sapiens
actctgagctgcctgtcgtgacctccaccgcgcgtagttgcctgcgatctgactctgccctgcgtgacctccacccctagtgcctgcgatctgactctgcccgatgtgacctccagccctagtgcctgcgatctgactctgccctgacgtgacctcgatgctcctagtgcctgtgatctgactctgccctaagtgaccttga

SEQ ID NO: 559123 - DNA, 742 bp, Homo sapiens
  misc_feature (331)..(331): n is a, c, g, or t
tgccccccgtccgcccaccaccccgccgcagctagtgcaaaggcctccccggaatcacgtctatggggcaccacgcctcctggcccccaataacaagcaagctgggacaccagaccccctctcctcgcgctgcagtccatttcatttcgttggaaggccgagccgtggctgcttatgctgtaaggcaaccccccaccccctctgggcccatgaattcctggcttggtatagttccattgcacaccctgattacatcttcgactcaccacctcgagtcacaaggaggtggcattcccacaccagcacaaccatgttggtgtgaagactgggncgcccctgggtagaatccagtttttaattattattaatataaaggatcacattcatttcaacacgatttcgaagtccccagaccttttagttctgtgccgtctatgtggaccctttggtaaaatcccaattatgatatggacgttacccttggtctggtgaaatgtttcatatttgggcccgttaatttaaaaattatgagttaaagccgcccgtgtcaagggggttctgttttctttgaaacccccctattcatttggatcatgggcccccctttaatcctcccccccatcaaataagctattgctattggtttggagttgaaaaaccagtcccggaaacttttgaaaaatgctaataattcccccaggattatgtccaattttaaaaaaaatgggggggggtttcttta

SEQ ID NO: 559124 - DNA, 382 bp, Homo sapiens
cacccctctcccccccccgagtttttaatataattctcctttttttttttctttcctcctccgcctttcctccccaccgccctcctccctccccctctctcttcctcctccccctctgtttttcgcgcgcgcgcgcgcgcccccccccccccccgttttttttttttcccccgcgcgcggcgcgcgagcgaagttttttctcccccgccatctatctatatatagcccctccctgccttttttttctgcccccccttttccccttttttccccccctccccccttcttcttgccccccctcctctctctctccccgctcgctttttttccccccccccccctcctcctcacacacaaaaaaatacacccccccccacacaca

SEQ ID NO: 559125 - DNA, 187 bp, Homo sapiens
ctgtatatgtattttcagaattcagaagatgatgtagaagaggaacaacgaagaaagacaaccatctcctgagggctgtgactagaaaatgctgatcagtgtttactatgacgctcaccctgtgaactaatggcatataggagcctttggaagaatcctctcatgaaccttaacccgagcgctacca

SEQ ID NO: 559126 - DNA, 968 bp, Homo sapiens
tacaggtgtcaacgtacatagaatattacatgatgcagaatcacattgatctacgtcggtccagagtctacccagagagggctatgtgtatgacaaactcatgaacgagatactaaaatcgtggttcacttggtttcatctgtgctgagcgaagtcaggccgatatactatttggaaacccatgttaattacctcgtgaggcattagcggcattctgcactggatacctactatcgttccattctcctcaactttggaaaaggtctcagcaggtggctagaatgacgtacctaaaccaaggagctgtgaggctcgttgactcaatgatcacagacctcgagtggttagatgcttttttcctatgaatgaacgctggagaatgaacatagctgttataaaccgggtagttgatgtagaaagcgaaatatgtaatgtggaacgtgcatcattggtgttagttaagataagtcacgggatatgaacaagtgtgaagatggctagtggtaaggtgaattaacgggtaaatcgtgaagatatgaaccgtatggactataattaattcaagagctgatagtatattaggaagatgacattttcaaaggcggtattttctggatgcatatgattttgtatatgttctgtcaatttcgtgattgatactgctttgggataggtgggatcatagactggggtgggttttgtaaggttcggtctcaggacgaattgcctgtcttagtattctcgtcgtagatgcttaagtttcccttggtcggataccattagtggtctctaattgaatccggagtttttcaagttcaagctgttgggaaatccgggaatagcgggaatgccatctccttttgccacctgcccgggtgattgatttgccccgtagaggtcataagacctgggatagggctcttataccctgtcaccacgtcttttccacatacacacgacagggggcg

SEQ ID NO: 559127 - DNA, 710 bp, Homo sapiens
gactgggactgggatgcagtgcagcccgggcggagcgggcctggtgccgatgacggccccaggcattgctctgccccgggcattgcgcggctgctcgtgagtggggatgcttgcaggaggcggcgcggtgggaggagtatgcgtggtggccctcgtggagggagctgctgctgcgggccagacgggcccggatgctccagagtgccgccgacgtcgccctgggaggctccgcgcgtgtgagccatgtaaccctgcctgggctgggctcctgggcctgctccgtctcttccccagctccctgggctacgcgcggcagcgggggccacgatgaagaagcagttcaatctgcatgcgccagcttggacaaccagacggtggcgcagggctgaaaagacagaagtttctgagtgaagaccttcttcagggtggaggaagcgtctggagcttggtgaaacaggtgtcccacagcaactgcacaaatgaagctcaccgcatgtctgcaggtgacagcaaggggcagaggctgaccaagcgctccaaaaagttgcctttgacaacactggctcagtgtcttgatggaggggtcagctatccttgggagaatgacacactttcattgggaagatgcttgaaaactactgtggagagacggaggacaagcttggattcagggagctgatacattttgaggttgcaagtagagagagaag

SEQ ID NO: 559128 - DNA, 182 bp, Homo sapiens
gttgtgagaacacaaatgaacgaaaatctgtgcggcttcactcattgcccccacaatcctaggcctacccgccggcagtactgatcattctatttccccctctagtgatccccttactccttacactattcctcatcacccaactaaaaatattaaacacaaactaccacctacctcctgat

SEQ ID NO: 559129 - DNA, 885 bp, Homo sapiens
agcggagtaagtcggggcgctgcgggcggggcaggatgtgggcgctcgccgggggacgtgctggggccgggcgatggtcaggcagtccaccgcgggcctctgccagggaacaggcgatctcctgagtcgaggcctcgcgggctgcagccggcgacggaccaggaaagccgccgtccaagctgccagaagggggcgagggccattccaggtggaggcatggcatagggacctcgaggcccatgggactagcgttggactcccgggcgccgattggcgttcttcccgtgtcgggacccggggctggcgtcggacccgtgctggtccagatgcgcacgcgacgggggaggccggggcctgaagaaaccttgaggttcgcggcggcctcttgtacctcgcgtgcctcatggggcccccgtgggacctgctgattgcccccatggtggcccccaatatgtaaacgaggggacaagggagctcggcacaggggttccataaacgcacgaccctgcaatacagaataggccgcggggttatgaacctacgcgaaacccttggcaggtagcttgaggaggacacagggcgccatatcccttcaagttgaaccaccaagggcacgccataaccgggcttggcccccccggtggagaatagacagaaggagggaattatgtggaatgacgcagttaaaattttaagcccattttaacacagacaacaagctgggagcaacagacacttggtgcggaccccgaggtgagcagcccgtatttggtgtgtattccacagccggccatttgtgtaacaatatcgtacgaaggtgaaccttttccagcgcgaaaggcgccccggaaggggcacaggggacaggaattccacgctttggag

SEQ ID NO: 559130 - DNA, 94 bp, Homo sapiens
cggacacaagccctcttgacagtttttccaaatattaaaatcatttgatatgtatgcggtgatctgacatgctcagcatcagcagtcttcatac

SEQ ID NO: 559131 - DNA, 344 bp, Homo sapiens
  misc_feature (97)..(97): n is a, c, g, or t
aaaaaaaaaaaaataaaaccgggggtggtggctcccgcctgtagtcccggccctttgggaggcttaggcaggcggattgccttagatcgggagttcnagaccagcctggccggcatggtgagaccttgtctctactaaaactgcaaaaaaaattggccgggggtggtggcgggcgcctgtgatcccaactactcgggaggcttaggcaacaaagttgttttaacccggggggcggaggttgcagtgagtggagatcgtgcctgtgtgctccagcctgagcaacaaaagcgaaactgtttcaagaaaaagaagaaaattaattaattaaaccccgggccccagga

SEQ ID NO: 559132 - DNA, 285 bp, Homo sapiens
gtgactctagcaggatctctcataggttcgcaggagctatggcttctactacaaagtgctcaactacgtggactggatcaagaaagagattccaggaggaggactgagcccagaattcactaggttcgaatccagagagcagtgtggaaaaaaaaaaacaaaaaccaactgaccagtttttgataacaactaagagtctctattaaaattactgatgcagaaagaccgtgtgtgaaattctctttccggtagtcccttggatgtacttaccctgcgaacctatga

SEQ ID NO: 559133 - DNA, 533 bp, Homo sapiens
  misc_feature (219)..(219): n is a, c, g, or t
  misc_feature (287)..(287): n is a, c, g, or t
  misc_feature (295)..(295): n is a, c, g, or t
  misc_feature (298)..(298): n is a, c, g, or t
  misc_feature (382)..(382): n is a, c, g, or t
  misc_feature (495)..(495): n is a, c, g, or t
  misc_feature (504)..(504): n is a, c, g, or t
ggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcattgccaggccacatagttatcanttttttttctatcagctattctgttgtattctaaaacatttttagatgacttttaaagtatattagcntaacctangangttcaaatggtaaatccttgtaattagcctcatcgaatatagtaccatgtatagtgtatttttgcagcccctgaaccagagtangttcagagctcccaagttgtacttagacacatcagctgatggtactccctccttttgggacagttgtgcctataactaatggtagatttaatatcctaatttggccacggaanggagtcganacgactggatttggggagagcgagggggg

SEQ ID NO: 559134 - DNA, 859 bp, Homo sapiens
  misc_feature (17)..(17): n is a, c, g, or t
gcagtctgatacccccncgcagtattggatatcgtcgaccaggcccctcgctcatctctggcgtctttgccactgtcagaatctgaatcgcgctggaccctgtgaagtagaggatcctatcatggagaagtgggagcatgggctgcagtcaggactgctgcagactgagccatgtgatggtacgtaatgagttcccctgagggaatgaaacaccctcaccccttcaaagtcaccccttgggaattcaacacagacacacatatcccttcaaaaactttttattttgtatcaacagttcctagctcttgacttagcttagagcttttaacagagcagacaccttatatatttgagattgaaaaagtatctgctattaatcagaaataatcatttctatatttctggcttaccccttggaataaggccaaaaaataaaaaccaaagattacatttccctgacagatggctactgaacacaatagaacggaacatcctgaaattcctagagctttgacatcttgctggttgacagttacacacgttcagctttagtccatttctccataagctacaagcctgaaggcacacaactctttaaaacctaaattctttgttggcacacacatgactccacgtagccacattgccacagtgctaatacgaacaaaaagtaccaacttggggcactcttctcccttcatgtcctagggaatcagggagtgcatcaccatttcaaaccattgcaccccggctcaaagacggcagaaggctgtgcctaaagggccctcgagaccaccggctcgctcctacgcacaccttggagtgcaggccacgatgactacgtggactggcagacgac

SEQ ID NO: 559135 - DNA, 932 bp, Homo sapiens
  misc_feature (269)..(269): n is a, c, g, or t
actgctagtgtgaactaggtcttctaacatgctctcaggtcacgatctgataaatcattggaatgatgatgagctacctaccatggcaattgaaatccatgttggtgtgtaaccagattctgggacatgacttgcacctggtgggtggacaggaagatcgacgatgatactgcgaatgactcgagaagtgcaggtttatgtaagtcgatggctgaataactatcgtcaggttatagcgttgtcttgggcatactcatttgcgctcttgntaccctcgttccgctctttcaggaatccatgtactgcaagactttctttctctggtgccaggatgtcagatagatagttctactctagaagggatagtcgatcctttgaaagagggggaccagtctatggacagatattctagtgcacttgtcttgggcggtctctatggtgagagaacaagttctgtgacgttgaatctacgactattgtgttaaagtgtgggagtttccgttcgaaaagtaaattatttagtactaggttcatcatggatggtcaagaattggcgtattcttgctatttgaaaaacccttaaattgacttttgatttgctaagtgccgcctctttctcatggtgctcccacgaatgagcttatggtctacgtcccctgtgttggtacaatctggtacctcaaccacagaacgttttgtcagttcagcaagtactttctgtgtaacagtttaaagtccgcatcagacttgttacggtaggcatttatgtgttggctaacactgtctgcaccacaggtaacggcgggggttccgtcaaccatgacgttctcctgtccagtctaaacgagggggggatatccacaaaaccgcttcttgtcacaagaagcacatcagagacacaattggggctcgccggaacttcaacacttagg

SEQ ID NO: 559136 - DNA, 191 bp, Homo sapiens
  misc_feature (15)..(15): n is a, c, g, or t
  misc_feature (42)..(42): n is a, c, g, or t
  misc_feature (109)..(109): n is a, c, g, or t
  misc_feature (126)..(126): n is a, c, g, or t
  misc_feature (148)..(148): n is a, c, g, or t
  misc_feature (184)..(184): n is a, c, g, or t
  misc_feature (190)..(190): n is a, c, g, or t
gaacccctgtgagantgggggccgctgcgagtctgcccctgncagctgcctgtctgctcctgcccccagggtggcaagacccatgcctgaacggtggctcgtgcaaganggcgtgggctccttttnctgctcctgcctccctggtttngccggcccacgatgcgcccgcgatgtggatgagtgnctgagna

SEQ ID NO: 559137 - DNA, 990 bp, Homo sapiens
  misc_feature (26)..(26): n is a, c, g, or t
  misc_feature (87)..(87): n is a, c, g, or t
  misc_feature (113)..(113): n is a, c, g, or t
  misc_feature (131)..(131): n is a, c, g, or t
  misc_feature (165)..(165): n is a, c, g, or t
  misc_feature (167)..(167): n is a, c, g, or t
  misc_feature (170)..(170): n is a, c, g, or t
  misc_feature (175)..(175): n is a, c, g, or t
  misc_feature (177)..(177): n is a, c, g, or t
  misc_feature (183)..(183): n is a, c, g, or t
  misc_feature (186)..(186): n is a, c, g, or t
  misc_feature (193)..(193): n is a, c, g, or t
  misc_feature (198)..(199): n is a, c, g, or t
  misc_feature (202)..(202): n is a, c, g, or t
  misc_feature (212)..(212): n is a, c, g, or t
  misc_feature (215)..(215): n is a, c, g, or t
  misc_feature (222)..(223): n is a, c, g, or t
  misc_feature (234)..(234): n is a, c, g, or t
  misc_feature (249)..(249): n is a, c, g, or t
  misc_feature (252)..(254): n is a, c, g, or t
  misc_feature (272)..(272): n is a, c, g, or t
  misc_feature (289)..(290): n is a, c, g, or t
  misc_feature (293)..(294): n is a, c, g, or t
  misc_feature (299)..(299): n is a, c, g, or t
  misc_feature (305)..(305): n is a, c, g, or t
  misc_feature (311)..(311): n is a, c, g, or t
  misc_feature (322)..(322): n is a, c, g, or t
  misc_feature (333)..(334): n is a, c, g, or t
  misc_feature (341)..(341): n is a, c, g, or t
  misc_feature (345)..(345): n is a, c, g, or t
  misc_feature (351)..(351): n is a, c, g, or t
  misc_feature (354)..(354): n is a, c, g, or t
  misc_feature (366)..(366): n is a, c, g, or t
  misc_feature (369)..(369): n is a, c, g, or t
  misc_feature (375)..(375): n is a, c, g, or t
  misc_feature (393)..(393): n is a, c, g, or t
  misc_feature (398)..(398): n is a, c, g, or t
  misc_feature (412)..(412): n is a, c, g, or t
  misc_feature (482)..(482): n is a, c, g, or t
  misc_feature (508)..(508): n is a, c, g, or t
  misc_feature (532)..(532): n is a, c, g, or t
  misc_feature (550)..(550): n is a, c, g, or t
  misc_feature (588)..(588): n is a, c, g, or t
  misc_feature (591)..(592): n is a, c, g, or t
  misc_feature (598)..(599): n is a, c, g, or t
  misc_feature (604)..(604): n is a, c, g, or t
  misc_feature (606)..(607): n is a, c, g, or t
  misc_feature (612)..(614): n is a, c, g, or t
  misc_feature (620)..(620): n is a, c, g, or t
  misc_feature (634)..(634): n is a, c, g, or t
  misc_feature (647)..(647): n is a, c, g, or t
  misc_feature (655)..(655): n is a, c, g, or t
  misc_feature (692)..(692): n is a, c, g, or t
  misc_feature (694)..(694): n is a, c, g, or t
  misc_feature (698)..(698): n is a, c, g, or t
  misc_feature (700)..(700): n is a, c, g, or t
  misc_feature (702)..(702): n is a, c, g, or t
  misc_feature (704)..(704): n is a, c, g, or t
  misc_feature (706)..(706): n is a, c, g, or t
  misc_feature (714)..(714): n is a, c, g, or t
  misc_feature (722)..(722): n is a, c, g, or t
  misc_feature (725)..(725): n is a, c, g, or t
  misc_feature (778)..(778): n is a, c, g, or t
  misc_feature (786)..(786): n is a, c, g, or t
  misc_feature (794)..(794): n is a, c, g, or t
  misc_feature (810)..(810): n is a, c, g, or t
  misc_feature (815)..(815): n is a, c, g, or t
  misc_feature (835)..(835): n is a, c, g, or t
  misc_feature (852)..(852): n is a, c, g, or t
  misc_feature (912)..(912): n is a, c, g, or t
  misc_feature (921)..(921): n is a, c, g, or t
  misc_feature (953)..(953): n is a, c, g, or t
cttttaaaaagaaaaaaacaatttgntaacactcccttttctgtccagaaaaattcactctttcataatcaaattaccctaaaattnggtggcgttaagaagcaacaaaagtnaagcttccaacgaatctnttctctcaaccggaaatgtcttctatttccaatnanganaaaancntgaatnaantgcaaanaaaannaangttaaccctncantaattcnngaaaacaatantataaaaaaaaaaanaannnaaaaaaaaaacacatatnttcatattaaagaacannacnnataanatattntttaanataaaaaaaanagaatcttaannttgtggnacanaaggcnccnacattccctttncanaccatncactcaccattgggtggnatggnagcgccaccctgcnggccactcatacttattggctcacatatcccactaattctcctttgcgggtgctgaatttccaaggtggnggatttatttagagaccccctcagangccataaagggggacctttatgangttctttctaagataganatccccctcatatttgtagggtgggtgggttttctggnttnntttttnnttttntnnggggnnncagaangagccctcctcgangcagaaggcgggngggggggngcccccaaggggtcacaaccacccccccccctggggncnagcncngntnantagagacngggcagangcnggggcccagggaaggccattcgtttgggggcccgactcttcacgggtttctgnccctcacngatcgctncaggggcaggatttgnacgtnccatctttctggccggcatncattgagggtagggcgnataaactaggcgtttggggggagcgggcgtatacacctttcccgggcagttggacagagncacccgggnccatttctttttggagccaaaagacctgcgtncaatggaagttcgggcagcccccatccgcggggaatt

SEQ ID NO: 559138 - DNA, 454 bp, Homo sapiens
ccgggggggaactgaagcattttcggtttctagggttgttataaagctgcaggagcgagatggaggtggacgcaccgggggttgatggacaagatggcctccgggagcgcccaggttttaccgagggagggaggcataacttcaatgtgaggcctcattttggggcaaatgggcttcccaaacactcctactggttggacctctggcttttcatccttttcgatgtgggggcgtttctctttgtgtattttttgccatgacttgttcgctgatatctaaattaaaaacttggtttttgagtgaattctgtggctacaaactttttgaatgaagacaggactttcaatagaagaatttcacatctccaagggaccctttcttatattttacactttgttactaatttgcagaactctattaattgggtcggatttcacccattcctgctgttttt

SEQ ID NO: 559139 - DNA, 135 bp, Homo sapiens
acacgtattatacaagaaagcagaactatataccaggctgtaaacaaaaagtactctattagatagaggacactacagtatcctgaagctatatccccaagagctagtttcgtagatagaccttatgggcccatc

SEQ ID NO: 559140 - DNA, 186 bp, Homo sapiens
ttacgtctaccaatcccctagacctgtgaaagcaatgcaaactaggcacattctattatagtcagctccccatgtacgctttgggcccaaactagaccatagtctcatggttatagatcaagtcagcctatgtgcttctaatgccagtatccactatagtgatagacaggtccaacgagtatgcag

SEQ ID NO: 559141 - DNA, 937 bp, Homo sapiens
cttccgctgcctccaagcgccctctgggtgacagaccaatctgcgtgtgtctgtgaccgcctgtctcagtggcacgggcacttcctttctgtagctgggttagagcctgggtctgcctttcgtccagatcaccgtcgtgtttttgtaaaatctctgacttgtatttgcatttctacaagaagacgtgagaaatgggctgggaggtgccttctgtgctgcttgactacctcctgctggtgggtcccatggtagcgcggcctccagctgccgcaatttccatgccaggatattctttccgctgaatcagtcggttgaaattcagagtgagtcagaatgactcgacctgtccttcaatgttgataataaatgtctcaggcaaaaaccttgcttgagctgccatgctatttccccttgatctgtcacctcttccctcgtaacaatttctgcagggaagcccctgagcggaggcgccattgacaacgcatggtcttgccagtggctggcaaggcggttattgttctgcatcagttgctggagagggttggcatgcgtcccctgcatccagcctccccgcttgaggccagcactgagtctgggacactcagcgggaagggggctggcatcggccatgcgaccacagcattcctcacgtagtcttctgactcccaggaagggtaggtttaaaaatcctgtatatactttttagaggactcttcttaaagctattctgaaagtgcttgcatgttacatactttctcgtaccacacctttttggctgaaggacttccggcgaaagggagtcgtctgtccattcactggttacattttgtttctgcaaaggcgggcccaggcccctagggggccttcggtcagtgggaaccaagggccggagaaagggccgggggaaggacggaccctttttggccgataatttcca

SEQ ID NO: 559142 - DNA, 371 bp, Homo sapiens
atacctatggtgtggatctgcgctccagaacatgtgtgtgttcacggttctggccgtagagcagtgtagtgcattgcgtgtcttgacacgcctcacaggcagctcattgtctgacttgaccgatgtgggcttgcaccgtgcttgcatcactgtgactctgctgcttgttgacggcacactgtcttctcaatcaggccacgtgccttcacctgtctggtgaagtctggggcgcgtcaggattcagcatgaagggctgaggcggatgttcgctgtgcacagcacgtgacgggatactcgcagcctcctgcggcagtagcgcacatcaaggagcgtcgcccttgtcgtcacattcgatcttagctgcgatgcct

SEQ ID NO: 559143 - DNA, 757 bp, Homo sapiens
agcggagttccgaatgaatggcggggtctcctgagttggtggtccttgcaccctccatggcgacaaggagtctcgcggctggcacatggagagccagagccttgggtctccgccactccccgagaagactttcgggtgccgctgcatcgctcgaagcgggttgtgaccgaaatgctagaactgtgcggtcgcttcgtgcaaaagctcggggacgctctgccggaggatgattctggggagtgcccgcgctctgcagagatgctgcagtggacttttgaagtcagctgtgcaacgagcaatatcaaggattacatggtgcaaagccagtggcaggaaggcttcagactaactgtgtcttaaactggcattctgaccgctcgaaagtgacctttgagacgatcaagttcgtgattgacacattcgaataggtagactattaggccagaaacagggtaaacggcaggtatcccaagaacacgcatcctggaaaatggtgttcattcaaaaaaagcaatagaaaagccaaaaacaaagaaaagtttctggacaggcgagtacgcacctcgtggtatgtaacatcgcattgtgggacgcctaagaattattgacccctgatccaagcccgctcattatggcaaacaatttcgacacattgcacgaagcgggcggaaccaatgtaacgcaacacagtgagcatccagggtgcaaagcccaatagaaagttcgcgtttggcctttgcaatttaaatttagcaac

SEQ ID NO: 559144 - DNA, 509 bp, Homo sapiens
  misc_feature (145)..(145): n is a, c, g, or t
gtgactgcagtatttatttgactatttatggtaagggaaaagttgagtgttgttgtgaaagcctgatattagtaatggggatgatacaatctggcacaaagagaagttggcaagtaagtcaagtgtaattataggatctggtaanctctcttggcattgtagatgattggtattaaatgttgaaggcttgcagaaagcttcatcatcgttttggtctggaaggttaagggtaacctgagaataagaagaataaaatgaggtcttcagatgctaagcaggtccagggacatctggctgggggttaagtttaagagctatctttcttcttgaatttctttcctatcttcccttcccttgtaagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaagatt

SEQ ID NO: 559145 - DNA, 89 bp, Homo sapiens
taacttttgggggggaaaagtattttggcagaagtttgtcttgcaatggttatttataaatagtcaaataaagtttttcacctattaac

SEQ ID NO: 559146 - DNA, 315 bp, Homo sapiens
  misc_feature (11)..(11): n is a, c, g, or t
  misc_feature (106)..(107): n is a, c, g, or t
tccttcacagntttttaaggtgtccagggcattgggatggttttccaggcaaggcaatcggccaatccgcatttcagccctttcagggagcagttttccatcaagnngaattttgttttccaggaacggcccctatgggggggggccgcagggccacccttttttttttaaaaaaaaaacaaaaaaacagccttgtttttttagtcccatcatgggtaaacaaggaagccaggaaaaaaggtttttttaaaaattgggggtttaattttgttttttttgcccccgccaaaaaaaagttttttgatggtcccccca

SEQ ID NO: 559147 - DNA, 471 bp, Homo sapiens
cgcagtcccattgttagaaagcatcaaagtcttgtgagtagctcattcactatcatcaagaacagcacatgaaagagctgcccacataattcaatcacctcccaccaggttcctcccacgagacatgggaattgtgggagtcacagttcaagatgagatttgagtggggacacaggcaaaccatatcagggagggagcggagaagtggaccagaacagaaatgccacaccaagcaggtcaacagcaaccaagccagagaaaagattgtgcaaactccggggacttgaagttcctcaggctcatattctgttttcagtgtctgtgagactcggctaggcactatgattgggattccttaagagtctacttcccttattgctatgcgtgtctacctattacatgtccttggtacttcagttgtcctaacggtgtgtcagttccttgcaaccaagagtgtcgcgggtaccgcgc

SEQ ID NO: 559148 - DNA, 169 bp, Homo sapiens
aggatctccgttggtggtattggccgatgagctggtttgactcattaatttctactacaattatgggtcccagctaaagaggtggggtgaagctggggacagcttatcctagggtagagtttattcttattgaataattgtagtagcacgtacaccctgttggccaaat

SEQ ID NO: 559149 - DNA, 1387 bp, Homo sapiens
gtattacatgtctggtagcatttaaacttttgatgaatactttcccctggttactatttcttggatactcacagaaatccctacaaattaagtaatgtccatcttttccagatagtgaatccagtactgaaatgttcaaattaattgttcaatattccttagctagtaagtgggaagagccagaattcaaacctatctcatcgcgtttatacgttaaagttttttctatctatcggtcttttttcagtatttgcgattttattaggaaggaagtttagaccatgggtggcttgaacatgccctaataggtgaattttgttattgggctttccagatggcttcttattctattttgcagttgcaaatgctttttctgtaaaaagagatttcctgaggctcttagttgtttactacttaactattcgtccacggtcatcctctttaatgacttcattaaaaataatgagcaaggtgttataacagtggattctatctcctaacatatttttccatctatggtaagtactatgtaggacagaacacagtgcttgaagtttccccaatagatttatgatctaaatcgggctgacgtaaaaggattgcttccaaactgtctgttcagcacaagttgctgagttctaattaaccgtcgccaaagcttggcgcttacatgtttcgaaaaaggtgccatagcggcacacgttcgtcaggtggtgttcccggcattggtgtgtcgggacaaacagcggctaatccaatcgtggttgttgtcatgtacagatttactatcatatattattattatccgacgacacacatacccacatccacacacaccgacacatacgccaaccacaacggcctgaggagcggggggacgagacggtacgagggacgggggacagggggcagagtgccgggaaggggaaggcggagcagacggaggggagggggaaggggcggaccgcagccgaccagagacaaagacggagggagggcgacgagaggacgaagaggagggggagggggacaggaggagagggaggacgcgggggggaacgcgaggccgagaacgcgggcgaggaccagggcacgcgagggtgcgagaggcagagagggcgaggcgggagaacggaggcagagaaagcaaggcagagaggcgagcgagagcggcaggagcagagaagacagaagaataagaagaagcgaagacagaggacgacggccacgcaagacacaagcgcgagcgagaaacagaagacaggatgacagccgcgaggaacgcggcgaacgggcagtgcgcgagagaggcgcgagagaacaggcgacacagaggggaaggagcagagcacagacgaacagcaggcacaacagagccacaaagcgg

SEQ ID NO: 559150 - DNA, 364 bp, Homo sapiens
gctgccgcctactactacttaaattcgcggccgctcgacgttctgtttctttttaaagcctggttaatggccgggcgctgtggctcacgcctataatcccagcactttgggaggccaaggcaggcggatccctgagttcgggagttcaagaccagcctgaccaacacggagaaaccccgtctctactaaaaatacagaattagtcaggcgtggtggtgggcgcctgtaatcccagctactcaggaggctgaggcaggagaatcgcttgaacccgggaggcggaggttgcggtgagctgagatcacgccattgcactacagcctgggcaataagagtgaaactctgtcaaaaaaaaaagtcgacg

SEQ ID NO: 559151 - DNA, 474 bp, Homo sapiens
aggtcccacttgtaggtatttttaaccaagagaaatgaaaacatacgtctacacaaagatctatttggaaacgtttatagttgctttactcataatagctaaaatctacccaaatatcagtccactggggaatggataaacaaactgtggaacatccacaataatggaatatcactcagcaataaaaaagaacatattgatacatgcaacaacatggagagactacactactgagtcaaaaaagtcaaatgcaaaggctaaatactgtgattctatttctatggcattctggaaaaggcaagatcaaaggaacagaaatcagtcagtggttgccaggcactaggtgttcaggatggggactgaaaaaaaaggggcatgaggaagttttggggggtgagggaagtgctctacatttcaactgtgattgtggttacaagaaagtatatatttattaaagctcaacaaactataaaa

SEQ ID NO: 559152 - DNA, 402 bp, Homo sapiens
gcgaagactgcttggccgggtgtgcgccctgtaccccgcgctgcggctggcggttccaggcgcactaccgcgatgaggacgggacttggttgcctatccccagtgacgaggaattgacaatggccatgtcctacgtgaaggatgacatcttccgaatctacattaaagagaaacaagagtgccggtgggaccactgcccaccgtgtgctcaggaggcgccccgaaatatggtgcaccccaatgtgatctgcgatgagtgcaatgggcctgtggtaaggaacccgctaacatgtgcaggtctgcccagactacgacttgtgtagcgtctgcgaggagaatgggtttgcaccgggggcacacaaagctcggattccccagcccctttcgggcaccttgtctgag

SEQ ID NO: 559153 - DNA, 335 bp, Homo sapiens
gggcagagctcggtgctatgagcaccagtcgcacacacacggcgagcgctcctacgggtgcccccactgcggcaaagccttcgtggcagagctccaacttgcaatcagcacctgcgcatcacacgggcgagcgtgcctacgcctgtccgtactgttccaatggccgttcggcctagaagctcatgacgcgtgctccagtcgaccatgcacgtgcgattctgggctgagcgtccctatctgctgtcagctctgcggtgaaggccttcggccaggcctccagcctcaccaagcacaaacgggtgcatgagggtgcatgccggtgcgtgcagatggct

SEQ ID NO: 559154 - DNA, 472 bp, Homo sapiens
cctgggtgcatgcattgtgcaggaacgtgcaggtttgtacataggtgtacatgtgccatggtggtggttcgttgctatcaacccgtcatctaggtttaagccctgatgcattagatatttggttaattcttcttccttcctggttcccttcactctcgaaagggcccagtatattatggttcccctccctgtgtccatgtgttctcattgttcaactctcaattatgagtgagaacatgtagggttgggttttctgttcctgtgttagtttgctgagaatgatggcttccagaggaagctgcttttcatccctgagctcaaatggaagccactgaaggtttcagggaggggagggacataatttggatttgtgactgtagaagattggtctgggtactaagtggacagtggttaggagggggccaaagtggggttggggagatcagttaggaggccatgaggtgagtcaggc

SEQ ID NO: 559155 - DNA, 686 bp, Homo sapiens
  misc_feature (135)..(135): n is a, c, g, or t
gttcacctctcgattccagtgaggtgtaatgcctttgacatagcgatagtgttcctgagtatgacgtatcaagcatggcctcgaatagcatgagtcaaattctacagctcggtcatcactgcgatagatgcgtcnttagacagtgtgtccggatcctactgtgtatacacgcaaaggaatgctgcatctgccatgctagtcgtgacgcggactgtgccgatgacgctatcatgatcataggtatcagtatcgtgcatggtaagtaaacgtgaatgtcctgacattaggtcttagcttgccagtgtattcattctggtaccagacgttagttcatctaacatcaggcgtaggtacctctcatccgacagagacaaatactcggcgtcatggctcatcgtatttcatcagctagtactgataggcatagcatctaacagtgtggatgcggacagcttgtagagtcatcagatgcgcctcacagtgtgcactttgtccgatgggattgtctcatcctagatgtccgtaccatgaagggtcgtccacctctagcatttgcattagtatgtcagtcatcacagcattaaactgtgttcttcgtctagctcgtgtaaacggatattcaattgtcccttgagtctccttagccaggtagtcattgatgtgctccttggccttaacggtggtgt

SEQ ID NO: 559156 - DNA, 933 bp, Homo sapiens
tgacatagctgcggatcagcatgcggcggaacaggtgcgcacacgcgagcgctgggccggctccccaccggagtgctccccccgcacgatggtgttaaaaccgagagcggggcacaaaaatacgggcgggcccgcgttccgccccaggccgaggggcgccctaccgctttcagggggcggaagtacaaccaggtgagggggtcgccttccggttcgccccaccgccgctttaagacgcagttagtgactgcggggctgctaaacgccgaaagaaatcaaggcgttcttcctttgagaagagccgtgaacctgtttattgtcgtgccaagtcagcgccttattgtggcgcgaaggttgaaaagagaacgacgagaaggcgcgatctcaaaaatggccaaggcggggaaagcaaagaacccgggtccccacgaaacccaccgcgagtgtgaagaacttaggaaaattgcgcaccccctggggaaagaaacggggaaagccacttgtagcccgtcctccccccccgctcccgcgcgtactcttccgaaggaccccaccactccccgggctgggagaccccaccggagtcttccctcagaaacaccacaccattgctaaaaacgcgttctatatcaaattacttgggtggaaatgataactaggtaaaagccccgggccctctcctgtgactctcttatggagcacccattacacgtcacaagatctctctaaaacgtctgataaagacccgctgtatacttcatcccgtgcgggaatttgaattcccttatcgttggaaacgcgcccggggcaattaaaaagtctcagcagccccccgttctttataggacttgtcttccataaacttttgacaacaggcgcgagaacacgtcaaagggtcccaaattaaaaaatttcaaacccccaaaaaaaaca

SEQ ID NO: 559157 - DNA, 205 bp, Homo sapiens
gtagagtcgaccagtctccatataaacgatatttggagggcagctcgttgctcacgtgtggacggttcttgtacagggaggcatgcaccgcagtggtgaatacacgtcgacctggctccatctaaacgatatttggtgatgagcacggttcttatgtatcgacggtacttgtacagagagttatgcaccgcagtggtgaatacac

SEQ ID NO: 559158 - DNA, 111 bp, Homo sapiens
ccagaactgatgcgcctgaagggaaacgatcctcaggcctgtactagccgttttgggtcgctcgaaatcggtttgctgtcctagaatcggatgcattcgcttctgatcaat

SEQ ID NO: 559159 - DNA, 126 bp, Homo sapiens
cagaggacgagtttacagaaccaaaacgagagcgagaaaacggccaaacaccgtgcgaggaggaaacccaagctccgccgagcgcggcgggtctgtgccttcgcttcgcttccagcctctcgcttc

SEQ ID NO: 559160 - DNA, 371 bp, Homo sapiens
cacgaggcttgccgcctagcgcctcacccgttacagggggtcagatgaagcggtatccgatccggatgcccgcttccggttgaaaaggggcgacgcggcgacggggagcgcggcaaacccttggcgtacgggaaagatccgtcgaaaatgctcgtggagccgggtcggtcttggttcaatcgcgaaacgtctccagctttctgttttgccgtgcttcttgtcggatacagggtccccacttctccggaagcactctatgattttgcgcccaatgatcgagctgctcggcttcatcatctatcttatcgatctctacgtctacatcgtgctgggctcggtcattctgagctgggtcatggctttcggggtcg

SEQ ID NO: 559161 - DNA, 157 bp, Homo sapiens
tagcagcatgtcagcttcgtatctctcaacatgaggcccaaatcaagtcattgactgaataccttcaaaatgtggacaaaaagaaagacagttgaggatctgtcgatgccctcagtgaagaactagtccagcttcgagcacaagagaaagtccatga

SEQ ID NO: 559162 - DNA, 519 bp, Homo sapiens
  misc_feature (75)..(75): n is a, c, g, or t
  misc_feature (113)..(113): n is a, c, g, or t
tttcaatcccggctggagcgcaatggtgcgatgtcagctcactgcaaaactctgccctcccaagatgcaaatgantctcgtgcctcagccctccccaagtagctagaattacnaggtgtgcactaccacgcccagctgttttttgtagagatggggttagtagagatttgtttaatagagacggggtttcaccatggtctctactaaaccctgtctctactaaaaatacaaaaattacccaggcgtggtggcacatgcctgtagtcgcagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgt

SEQ ID NO: 559163 - DNA, 281 bp, Homo sapiens
  misc_feature (149)..(149): n is a, c, g, or t
  misc_feature (153)..(153): n is a, c, g, or t
  misc_feature (256)..(256): n is a, c, g, or t
  misc_feature (263)..(263): n is a, c, g, or t
gtaaaacttcaaactggaaaaatgtggccataagaatgcatggagccggacgcggtggctcatgcctgtaatcccagcactttgggaggccgaggcggacagatcacgaggtcaggagatcaagaccatcttggctaacacgaggaaantgcngtctctactaaaaaatacaaaaaattagccgggcgtggtggtgggcgcctgtagtcccagctactcgggaggctgaggcaggagaatggcctgaaccttggangcggacnttgccagtgaaccgagaa

SEQ ID NO: 559164 - DNA, 137 bp, Homo sapiens
ctagataggaggagggaagaatgtgtagccccacacactagtcctctggagcttatctaggctccatagattttaaattaaaattattataaattgggacttaaattctaactttgtcccccgggtgggaatccggg

SEQ ID NO: 559165 - DNA, 1492 bp, Homo sapiens
  misc_feature (784)..(784): n is a, c, g, or t
  misc_feature (831)..(831): n is a, c, g, or t
  misc_feature (833)..(833): n is a, c, g, or t
cacctggctattttttttgtatttttagtagagatggggttttgccatgttggccaggctggtcttgaactcctgacctcaagtgatccacccgcctcggcctcccaaagtgctgggattacaggcgtgagtcaccgcgtcctgcctgctcttcctgtttctttcccaagggtcacactcagtagggagatgaaggtggaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagcccttgtagagctagggctcagncccatcagtctcaaaggttaagccaccagtcaccaccgaggcacccntnaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccaaagaagcaccactgtagtttctgcagacccccatgcggttcattgtgcattgtttggtttctaggatgtatgtgttgctagttttttttaatgaaaccctggattaatgtaaatagctttttggggaacggattctaatgtcacgtatgtgaccgtgtggactatttcaaggtgctgatgcaacactaataaacctggaggggccggcaa

SEQ ID NO: 559166 - DNA, 127 bp, Homo sapiens
tcaatagtctagggtaggtaactgcttctctgcctccaggactgtgtaggttaatgacagtacatttcaactgctgttctatctaggtatgcactaaatacccttgcatatctacatatgatacaaa

SEQ ID NO: 559167 - DNA, 401 bp, Homo sapiens
  misc_feature (21)..(21): n is a, c, g, or t
  misc_feature (28)..(28): n is a, c, g, or t
  misc_feature (54)..(54): n is a, c, g, or t
  misc_feature (70)..(70): n is a, c, g, or t
  misc_feature (87)..(87): n is a, c, g, or t
  misc_feature (256)..(256): n is a, c, g, or t
aggttacatccccccctatangaccccngggctaaagctgggcatatttttttncccccttggcttcacnctaaaatcctcatgggncctcagataatacataatatatatcctatgtttcacatggaccagcccaggcgtcataaagcttacaacagcatacagtaaggagaaacaatagtagtttagttattataaaaatatgttatatattcagatagaactgggttcccatcttgtttctgttattgttttncctggtaatggtgtgacttttctgagtttgttttttcatcagtaaaatgaatataataatgccacttcaagatttcttagggggttggatgttaaatgagattaagtatctagcgtgtgattggtgattgtgatgtatataaata

SEQ ID NO: 559168 - DNA, 516 bp, Homo sapiens
  misc_feature (324)..(324): n is a, c, g, or t
  misc_feature (395)..(395): n is a, c, g, or t
  misc_feature (431)..(431): n is a, c, g, or t
  misc_feature (505)..(505): n is a, c, g, or t
ttggaagtttgactaccctacattctcctgcaaatggaccttgagagcttgtttggaggttctggcaggggagcgcatactcgtatacccttgaccaaagaacagtcctcctctattggggaaggttgtcctcttctgaaactacctttgcaaaaattatagcagtgagaaaattatgacagtgaaagaaatctgacctaattgactccatcttgcttctaacctcccagctgcccttgttcattcctggggcatagggagcactaactttgggaggatttagtttatagtttaactttgaaacaaagatgataacagcccctncctgagaccaacccacttcttgctggggaccagaaagcctttgtaaaactaaccacattggccacaagatnggaaatgacggctcaggagtcatgcagccaaaggcntcgaggatcatgaaccttcccaaattgctcctgtagataatattattattgtaaaaccttaccatgggtgtttnaggtattttta

SEQ ID NO: 559169 - DNA, 457 bp, Homo sapiens
  misc_feature (182)..(182): n is a, c, g, or t
gaggcttagcaaaggcgcgtagaggacgcgtttcgaggtgtgagaccccggacagctcttccaaaaagctgatccctaggcggcaaagatcgggaagaattacctaagcatgatcgaagtacaaagtgtcctacaaggggccaggaccaggcatcaagttcagtgcagagcgcctgcgctgncacctccgggaccatgtgaatgtattcatggtagaggtcagagattttccgttcaatacctctgaatgggagggttatcagcccaaggagagcattaggaccaaggcggggccttggggcaggtgtgcggttgtgtcgtcagcgtgatctctgaagtcttcctaattaggctgagaaatcgaggatcatgaggcaggccgtgaggtatactggggcacccaaagacaatttccatgaagatgtgggcacaaaagagtaccattggtctgatgaag

SEQ ID NO: 559170 - DNA, 205 bp, Homo sapiens
gactccactagaggctgatctggtgaccttcacgccagggtctgtctgtcggtaaatactatcaagagtgaattaaaacagtcgagtacttctctgaatccaatcctataattattttatacagtcatttctcagctgtgatctttggagcaacagccaagggcaggaacaactagtttgtaccagtttcatgaagtatgtcttt

SEQ ID NO: 559171 - DNA, 371 bp, Homo sapiens
cttcttaaaaatattacatgttaaattatcctgcccccagagggtggtttatccagaaaccaagaaaaaaaatcaatcccaataaactcaaaaaaaaaaggtatggggagcaaaaccataaaccaccaggcaggcaggccattagcccaccttcacctttggagggtccccaaagacccacgcccgacgcagaccctgaggagcatcaacaaggggcccgggccgagaatcggctatgtcttcattatgagagcaggagagacggcccagatatgttgctaggtgaatatatatttatataataaatccgtaagttaataaagtaaatagcaattctctgaaagtttttaaatctttcttttttatagttt

SEQ ID NO: 559172 - DNA, 393 bp, Homo sapiens
agactgatacagcagatatcgctgtataatagtcatgatgactccgaacagcgtagcacttagcatgcatacagattgtatttacagtctcctcatagctataaagctccttattttgatgaccgagttccctttccagcttctactgattactcaacacagtatggactgaaatcgaccacacattctgtagacttttattccactaaaacgaccatcttatagagcagaacagtacccagggtccccagagtcatgggtagtaacatcaagatgcccaagagaggcactactttctattctaaccttgttcagatagcggtgaaaagtccatcttgctgatttgatgattgccatgtgccagtgcagtggaaggaatagaatacagtgtgt

SEQ ID NO: 559173 - DNA, 230 bp, Homo sapiens
ggtcgactcttagagtgatccccactgggtgctccatcccccggcggggtcgaatgaaggtggtgttgaggttgcgcgtctgttagtagtatagtgatgccagcatgctatgcgactgggagagattcgagaagtacgactgctgtgattacgacggatcagactaagagtgtgcgtttggtattgggttatggcaggggcgtctatattgatcacttgcttgtgattaa

SEQ ID NO: 559174 - DNA, 706 bp, Homo sapiens
cacgggagccatatgaatgatctgccgcagtgcttcttggccctaggaggtcatctcttcgtgtccccgttggtggcccgactggccttgtattagccaactcctcaccttgagcctcggtctagcgcgagcaccgttactacgcttgtagctcaccttcccctatggcccatccataaggggcctgtgtatttgcccatcattagggagagcttctattccgctcgatttcgcccctattttccaggcgtacacaccctgaggcccatacacctaacgccctaaatcccatttcgcacctatctcatattctatccggcgggtaaatcctaacatttcttttccgccacgaacaacatttttctggcgcctatcccgggatgcccccgacagttacatctgggcataccccgatgcgatacaccaccatggaccatcctatctatctgtaggcgtcattcatttcttcttaccagccagtaatattaataattttcatgatttgagaagccttctgctttgaagcgaaaagtccttatagtagagagaacccctcccataaacctggggtgactatatggatgccccccccccttccacacattcggaggacccgtatacattataatttagaccaaaaaggaagggatcggacccccccaaactggtttcaagcccaccccctggcctccatgacctttttcca

SEQ ID NO: 559175 - DNA, 1527 bp, Homo sapiens
  misc_feature (148)..(148): n is a, c, g, or t
  misc_feature (358)..(358): n is a, c, g, or t
gggagtctttgattgaacagcagatgctaaatatgcatctaggcataacgggccacagactgtgagtgccaccaatgaatgccactcgaggatgcagagatggtctcgggataatcctaccatgcagtgtgattgcagggactcatgngagaagagcataggctcgtgcaggatccgagggtcccaggaccaggaccccgtgaatagccagtcgctcaccaatgcagtttctggcacacaagctaagctcaagtcctcacgagatggtccgctggtacgcgcagtggaacttagacgcggagtactcccgaggagacaagctgatcacgttcaagtcgcgtcggtcacacgtcgatcngaccgcatgtcagtcttgccattcgctgaagttaggggcagatgaaagtcctcacgtgtacgccacagagcagctggttcattaagtgctacatatgtcactagtgcacgtcaccgtttcggcacgcgtgatgacggacccacggctaacaagaagcaggtgcaaagatctcattctgcgaaagagggggcctcgatcctgggaacgaatcgtgtcgcctcgcgcattcgttgatcgcccatcctaacctcaatgcagttatggaagggtgccagcggctcccctcagttcagagctggcattggtcacgcacgcatcgtcgtcccttgtgcgctcctggacattgtagtcgcgtgatgtagtgcattgcagattcctttaggcgttccgcggttgcgttgggtcgagctggtgcgcttgagcaccggatagttacctcgttatcaactaggttttattagacacgaaagaaaacggaatataggttggcacctacgtaggaatccccggagcgcctcaattgagcgcaagaagaccgttctgaggtgggattcaacccccagagtggcattttgggagcgaagcccatttatccgccaagagacgctgagtgttaaccttggctggcgtcgttccccgggtctggctcccccgcttcggaccctctcctttttggggatcctctccctttccccccgtcattttgtgcgcgtccccttttctcgggtgtcctgttatcgggtgggtcctcccccccgttgcttttgtcccccgtggcatgtcagtgcgggattttgccctccttgagggggagggacctagtctggctggtgagaccctttactttctccatttggtgcgggtgtgttcgactaattattccgggtgtttcctctgtggccccgctggtatgttttcaccgggttggtggccaccccaatcggggtggagcggttcaagaaataccttcccgtgactttcacaacagagggggtatctctggggcgacgacagccgtcgcgaggtataaccacaatgagggccagcagagataatatgacacacgtggttgtaacggactcccttgaagatgagaggaagtatccaaagaaagaggatgctgcctccgtccatcatctccaaacgaaagatagaatgccccacgacaa

SEQ ID NO: 559176 - DNA, 128 bp, Homo sapiens
cacgaggacgagcacccctgggattctggagaaagatggcggtacttcggttcaggcggaggcatccttaccaaggaatcggcttttcaagtatgccaccaacattgaattaggttattggtgtgatt

SEQ ID NO: 559177 - DNA, 1059 bp, Homo sapiens
tggagagctagtctgtatatgctactagaggaatcatatttttatccttaagtatctagtcagaaaaagtcttggctgcacaggacaacacatagagggagttactagaagataggcatatgaagatgcctatatgaggttctatggtagagattcaggaaattgtcgaaaacagggctatagggtaggcgatatgcttcatttacacaagttctagtgaacagatataaatatattatagtatggaggcagaaatagtcaccatagcccacttggacaggacgatgtatctcctaggctacattcctaaagacaacaggctattatctagggggataaacgacattgaacatcattagctatatccctgctggtttcagtacctaggcaactactcagcacacgctagtacatagcggcagcggactattaggcataggctcgataaggtccttcctaccatatccaaaagaacagaggatcagagtagcacacttcaaaggacaaagcagggctatcaagcagcaagctcttacagtatccacagatcctgagcactcgattagagacttgctcttcagcttggacgagtcaaccacttgccataccaggttacgcagtggaacagcagagtcagaacagcaagtggacaactaacttgctgaaacttgccatctagctacatgtccagtttaggcctaaatccaggaagtgcctgccatacatggcacaggattataggacggcctggtgccttatcgaccctaggcctctggcaattgtcaatataggtgaacaagcaacacatggtgccgacaaaatgtccaaaataacgacgccatcacaacccaacactaaacacgacacgggtggcgcgccgcccaaaagaccagaaataacaccgagagagcacagaaaagacaaaggagacgaatcaatgcccgccgcagtcagcgtcaccaacgcgggaacgaacacaaaagcagcaccgtcaaccctgacgccaagagaaacaccccacacaatcgaccaacagcagaaccaaagcggcacagcggc

SEQ ID NO: 559178 - DNA, 136 bp, Homo sapiens
tttaggagagaagtccccatgtttcctgataaaggttttgggggcggctggtggataagtttgcagggctggaaatggcagggcccccccccctgagaaggcagagctgcaagattttgccttttagtagaactga

SEQ ID NO: 559179 - DNA, 759 bp, Homo sapiens
  misc_feature (25)..(25): n is a, c, g, or t
  misc_feature (42)..(42): n is a, c, g, or t
  misc_feature (64)..(64): n is a, c, g, or t
  misc_feature (69)..(69): n is a, c, g, or t
  misc_feature (98)..(98): n is a, c, g, or t
  misc_feature (389)..(389): n is a, c, g, or t
  misc_feature (478)..(478): n is a, c, g, or t
  misc_feature (480)..(481): n is a, c, g, or t
  misc_feature (483)..(483): n is a, c, g, or t
  misc_feature (489)..(489): n is a, c, g, or t
  misc_feature (491)..(491): n is a, c, g, or t
  misc_feature (494)..(494): n is a, c, g, or t
ctaccttacctacctacctacaacnttggaggggggaaattngggaaatttttaatttggggcnccaantcccatatatgcctaagcactttaccaantatctcatttaaatctttataatgagctcggtaccgaattactgttgtcccattttgtggaagaaactgagttagagaagtccaatatgttgcccaagggtaagcaaccagtaaactatagaatcaggattcagatctcagtccttctgcctccaaagctcatgccacactgaatgtggaaggccttaatgctcctccaatctggaattgtattttgtaagccaaagacaccttgatcagagcagaggtatagacttacagccagaagagatactgaaggccgggtgtggntgtcacgcctgtagtccttgcactttggcaggctgaggcagtcggagattgcttgagctcaggggttcgagaccagcccgggcaatatngnnanaccctntntcnaaaatgcaaagaaaaaattagctgggcgtgatggcatgtgcctgtagtcccagccacctgggagaatgaggtgggagaatcgcatgagcccagaaggtcgacgaggttgcagtgagctgagatcatgccactgcactccagcctgagtgacagagtaagaccctatctcagaaaaaaaaaaaagattttgaagataagttaaaactcactatacagttgagaaatttatttttaggattccattcggggggggatcctctaaagt

SEQ ID NO: 559180 - DNA, 121 bp, Homo sapiens
cgggtatgatcacaggcagaacctgaaactctatgtaggactgcgtacctccgcacatggagacataaaagtagatctggactggccgaaaaacagagggagcgaacgcgggaacagacag

SEQ ID NO: 559181 - DNA, 358 bp, Homo sapiens
tttggctcagcgacgggacgacgtggggctgcggagcggtgcatttgacagagtgtctgcagcgtgggccacatggtaagagcctttgatcaactgtttaacatgtgctctaactgatgtaactgcacacgtgttttagatgtggttatcccagtagcacactcttacagaatcatcaggttaaactggagctgccggtgtaaaagggagttcggcttactgaaggactaaagactgaaggaaatgattagactgttaagctgtactaggcttcctgaaatggggttattgattgtgcatttcacacgttcttgaggcgttggacatatcactttagacttctaatgagaacaaactt

SEQ ID NO: 559182 - DNA, 1002 bp, Homo sapiens
gcctcggctcccaaggtgctgggattacaggtgtgagccaccggctggctactatagctgttaatatgtgaaatctaaatggcatttttgacttgacagctcagacttgtacttcatgtattcagaagtttttagacaacaattagtttattgtctagttcattattaaagataatgaactaggccgggcgtggtggctcacacctgtaatcccagcactttgggaggctgaggcgggcagatcacttgaggccaggagttccagaccagcctggccaacatggcaaaaccccgtctctactaaaaatacaaaaaattagccgggcgcggtggcaggcgcctgtagtcccagctacttgggaggctgaggcaggagaatggcgtaaacctgggaggcggagcttgcagtgagccgagatcgcaccactgcactccagcctgggcgacagagcgagactccgtctcaaaaaaaaaaaagaaagcaagtttcacatgaataatgctgtgttggaaggctttttgatttaaaatcttttcggatttataacatcctgttaagttttaggagaacccgttttcccagagcagattcaagcttctaaaaataaatgctttcagtagcaggaatggcattgtttaaaaagctgatggcagggtaagcatttgggttagtgttttattaacatatttgtaagtacttgttcattgtggaaatgtgtccttgactaaaaccatacgtggctatggaaaccatgtttgtagttctgaatacacaggttttgtgtgtatttactctatgtattaaattattattgcccttagtttaaagtaaggattacaattggatttaagtagatcactgaatgttattgtttatgaaacttaactttttgtatgctgcttataaacatgatctataaatcagtgcttgggaaaattttactttcttaatctactgatacaggaataaaatatgaacaattaaacaggttgatccttgaa

SEQ ID NO: 559183 - DNA, 1436 bp, Homo sapiens
gcctcggctcccaaggtgctgggattacaggtgtgagccaccggctggctactatagctgttaatatgtgaaatctaaatggcatttttgacttgacagctcagacttgtacttcatgtattcagaagtttttagacaacaattagtttattgtctagttcattattaaagataatgaactaggccgggcgtggtggctcacacctgtaatcccagcactttgggaggctgaggcgggcagatcacttgaggccaggagttccagaccagcctggccaacatggcaaaacctcacctctactaaaaattaaaaggttagccaggcatggaggcatgtgcctgtaatcccagctgcttgggaggctggggcaggggaattgcttgagcccgggaggcggagattgcagtgagccgagatggcgccactgcactccagcctgggcaatagagtgtgactctcaaaaaaacaaagataatgaactggtttgcatttcttttaaagagatgatagaggaaaatatagttttttgtaagaatgtttatctctcttaaaagataatcttttaattttcttcagataacaagttattattattttttaagaaagcaagtttcacgggccgggcgcggtggctcacgcctgtaatcccagcactttgggaggccaaggcgggcggatcacgaggtcaggagatcgaaaccatcctggctaacacggtgaaaccccgtctctactaaaaatacaaaaaattagccgggcgcggtggcaggcgcctgtagtcccagctacttgggaggctgaggcaggagaatggcgtaaacctgggaggcggagcttgcagtgagccgagatcgcaccactgcactccagcctgggcgacagagcgagactccgtctcaaaaaaaaaaaagaaagcaagtttcacatgaataatgctgtgttggaaggctttttgatttaaaatcttttcggatttataacatcctgttaagttttaggagaacccgttttcccagagcagattcaagcttctaaaaataaatgctttcagtagcaggaatggcattgtttaaaaagctgatggcagggtaagcatttgggttagtgttttattaacatatttgtaagtacttgttcattgtggaaatgtgtccttgactaaaaccatacgtggctatggaaaccatgtttgtagttctgaatacacaggttttgtgtgtatttactctatgtattaaattattattgcccttagtttaaagtaaggattacaattggatttaagtagatcactgaatgttattgtttatgaaacttaactttttgtatgctgcttataaacatgatctataaatcagtgcttgggaaaattttactttcttaatctactgatacaggaataaaatatgaacaattaaacaggttgatccttgaa

SEQ ID NO: 559184 - DNA, 136 bp, Homo sapiens
gatagctataaccttgaagatggggtccaggatcagctggcagtaaggtgcgtggcagcttcttcccttcggggctaggtggctgactatgctgaactcgccgttaggccgatctgaggggatcctctagtagtcg

SEQ ID NO: 559185 - DNA, 1495 bp, Homo sapiens
gcctcggctcccaaggtgctgggattacaggtgtgagccaccggctggctactatagctgttaatatgtgaaatctaaatggcatttttgacttgacagctcagacttgtacttcatgtattcagaagtttttagacaacaattagtttattgtctagttcattattaaagataatgaactaggccgggcgtggtggctcacacctgtaatcccagcactttgggaggctgaggcgggcagatcacttgaggccaggagttccagaccagcctggccaacatggcaaaacctcacctctactaaaaattaaaaggttagccaggcatggaggcatgtgcctgtaatcccagctgcttgggaggctggggcaggggaattgcttgagcccgggaggcggagattgcagtgagccgagatggcgccactgcactccagcctgggcaatagagtgtgactctcaaaaaaacaaagataatgaactggtttgcatttcttttaaagagatgatagaggaaaatatagttttttgtaagaatgtttatctctcttaaaagataatcttttaattttcttcagataacaagttattattattttttaagaaagcaagtttcacgggccgggcgcggtggctcacgcctgtaatcccagcactttgggaggccaaggcgggcggatcacgaggtcaggagatcgaaaccatcctggctaacacggtgaaaccccgtctctactaaaaatacaaaaaattagccgggcgcggtggcaggcgcctgtagtcccagctacttgggaggctgaggcaggagaatggcgtaaacctgggaggcggagcttgcagtgagccgagatcgcaccactgcactccagcctgggcgacagagcgagactccgtctcaaaaaaaaaaaagaaagcaagtttcacatgaataatgctgtgttggaaggctttttgatttaaaatcttttcggatttataacatcctgttaagttttaggagaacccgttttcccagagcagattcaagcttctaaaaataaatgctttcagtagcaggaatggcattgtttaaaaagctgatggcagggtaagcatttgggttagtgttttattaacatatttgtaagtacttgttcattgtggaaatgtgtccttgactaaaaccatacgtggctatggaaaccatgtttgtagttctgaatacacaggttttgtgtgtatttactctatgtattaaattattattgcccttagtttaaagtaaggattacaattggatttaagtagatcactgaatgttattgtttatgaaacttaactttttgtatgctgcttataaacatgatctataaatcagtgcttgggaaaattttactttcttaatctactgatacaggaataaaatatgaacaattaaacaggttgatccttgaaaaaaaatatataagattcatatgtaagaagggcctcgcggcccggaatttattagtatt

SEQ ID NO: 559186 - DNA, 1110 bp, Homo sapiens
  misc_feature (10)..(10): n is a, c, g, or t
agtaccttgncaaaccatgccgttgttctgacttttgactatttaaaggataaagtagtatttaatgtgttaggtatgtttatgcccttgtaagctatactgcactccagcctgggcaatagagtgtgactctcaaaaaaacaaagataatgaactggtttgcatttcttttaaagagatgatagaggaaaatatagttttttgtaagaatgtttatctctcttaaaagataatcttttaattttcttcagataacaagttattattattttttaagaaagcaagtttcacgggccgggcgcggtggctcacgcctgtaatcccagcactttgggaggccaaggcgggcggatcacgaggtcaggagatcgaaaccatcctggctaacacggtgaaaccccgtctctactaaaaatacaaaaaattagccgggcgcggtggcaggcgcctgtagtcccagctacttgggaggctgaggcaggagaatggcgtaaacctgggaggcggagcttgcagtgagccgagatcgcaccactgcactccagcctgggcgacagagcgagactccgtctcaaaaaaaaaaaagaaagcaagtttcacatgaataatgctgtgttggaaggctttttgatttaaaatcttttcggatttataacatcctgttaagttttaggagaacccgttttcccagagcagattcaagcttctaaaaataaatgctttcagtagcaggaatggcattgtttaaaaagctgatggcagggtaagcatttgggttagtgttttattaacatatttgtaagtacttgttcattgtggaaatgtgtccttgactaaaaccatacgtggctatggaaaccatgtttgtagttctgaatacacaggttttgtgtgtatttactctatgtattaaattattattgcccttagtttaaagtaaggattacaattggatttaagtagatcactgaatgttattgtttatgaaacttaactttttgtatgctgcttataaacatgatctataaatcagtgcttgggaaaattttactttcttaatctactgatacaggaataaaatatgaacaattaaacaggttgatccttgaa

SEQ ID NO: 559187 - DNA, 1847 bp, Homo sapiens
gcatgcgcctgtgtggtcaccgcggacgactttgtgttacttgccctgctgactgctgaatgagtgtgtatctgtgtgatgtgcctttcttgtgcctgggtgcctgtgcaccagctgttgtcctctgtcttgtgtcaactgtgtgctgtgctcacgtgatgatgctgctggctgtgagcatgtgccctgcatgtgcagcatgcagtcccacagcgtgtgccatcgcactgcccaaccctttgtcctgacgtgtgcctggcccctgctgtgtgctcctgtgcgcctgcctgctgtgctgtcctcaatcctgccttgctccgtgcccctgtgaatgtgctatccttcccattgcgcacacgactgtgtgacttccctgtgtgatgcgctgtgctgtgctgtgccctgtgagcaacaggttgtgactatcttgcccttcaggtgcttgctgcgacgtccctgcaagccctagcacgcgcacgggaatttgctcagcccgaatgtgcaacccgcccccaacggcaatggccttccccggccccctgcgcacgcgcgattgcctgcgcgcgcaaggcgcaagcccctccggactgcgtccccccaagacccttaagacgcgctcttgcccttatcacctgccgggcgagacgcccctttgccccttcggagcgcccccaactgcgatggggcaccacccccccaagacacgggcccaacccagccacggtcgaacacgtgatggcccaaccccccaactggcccaagccagcattgcccaaccctgcttggccctccccccaaaatcgtgccccgagtttgccttggccccaaatacgccgctcgggttctccctggccccccctgcactgtggcccccgcacccctttgggcccaacgagaggcccccccttaaactttggcgagcaggcgggattagccacgggcccagtatatcctaagccgcggggcctgcgaaagacctctgtgcgccccccaggcgccagtatggcgcccacggccccatgggcctgtgtagggatatgcggtatacggcgcgacgattttcgcgcgccctttttgacccaaagcccgcttcatctcgcgcgcacccttttctgcgtggaaagagggtaggccgcgcacgcgccctcatgaggccactagggccccggacgtgtaggcaccccgtatatgccccgaggccccccccttctgccccgcggccccccccgtcgcgatatagggcggaaggtcaggccatcgcgccctcgcacacccccggtgcgcccccccaggtatgagtggccaccacgggcaccccgatcgtttagggggaggagcgccgcccccacgccatattcagtacctattgacccgccccgagtgcaggcgcacaacagccgtaggtggccccccccattattgacccatcagctgactatttgactatgcgacccaagaggaagacacccggccccgcccttatatatcccacgagacaatggcaccgtcaggaccccacattatacgaccaggcccccaccactcaccctctacttttcactccctggtcacgaccccacccatcgctccctccacacacacacattctacatactccccctagtccaacatattcctacaacacatccaccgcaagtacctcgaacatcatatgcaacctactcaccacccagacacgtaatcagctcccacaccctcacctaatctttactacgccccctcacccacatcaacgacgtaccatttcatccccccccacttatcgagccaacaccacaactacagctgcatgataaccaactccccccgctcattaatcacaccaa

SEQ ID NO: 559188 - DNA, 157 bp, Homo sapiens
attgccgccggttatgtgcttagcatacagctactagttgggggttttataaaaaattagtcctatagtgtctgggttttgtttggtttttgagatgagctctgctcgttgcccaggatggtctctgcatttgtctgttctcatgctgctgataaag

SEQ ID NO: 559189 - DNA, 385 bp, Homo sapiens
atgcgcggcgctctgaggatcccgtctgtgactacccatctctatttagttatacttcttcctttccaacctagatgacttttattttattttcttgcctaattgccctttcttgactgtccagtacaagttgaatagaaatggccaaagcagacatcgttgtcttgtttctgatctcagggggaaataatccagtccttcaccattaagtatgatgctaaccatgggttcttcatagatgccctttatcaggttgaggaagtttccttctattcctagtttgttgagggttttttttttttttttttttttttttttttttttttttttttttttttttttttttttttttttttttttttttttttttttttttttttttttt

SEQ ID NO: 559190 - DNA, 248 bp, Homo sapiens
ggggggggaaaaaaatttttgttttttgggcaaaggggttttcccctggggggggcaagggcctttttggaagtttgggggtttggggccaccctgggcaaaagggggggggccccccccaaattcaagggggaattggggggtaaggggttttaagggccctgggggggggtttttggggggtccccccggggttgccccccccccccccccccttttttttaaaaaaggcccctggggttttttca

SEQ ID NO: 559191 - DNA, 1252 bp, Homo sapiens
tatatccacgtcgacggctgtttggtgaaatcgtttgcacagatctctgtgttttcttaacgggaatgtcctagtcctcatttaaaaccgcacgttcttttgttgcggctatcgtcttttcgtataagagacggtgttcctcaatatggcgattcaagattagtattacatgggtgtataacatcgtcgtagacctttttcctcataagcaaagttcttggtggacaacaatttccttgttgtacaatggatgttgatagttaatagaaaagtggggtccaatgataaatgctgtccgcacatgtaagcttctcgaaaaattgtgggacccggctgtactgccattgtggtatttggttcaagcgtcttaatgtgtgacctgatgccctttcagctgaagtcgttctagttacgttggtacaaagttgtcccagttaacatgtcctggctgttaatcatctggccccttgagggcacatcacagtgtgaaggacctgtttaaggttgtaatagactttgcgctgaactattgggattctactaattctgagtgagtttccacgtatgagaggaaattaagatttcctcctccttcgctgctcatggtatatttgactttttgccagaaactgcgtttctctctgattttcttagtatttggtgttttgagatggagtctcactccagcctgggcgacagagcgagactccgtctcaaaaaaaaaaaagaaagcaagtttcacatgaataatgctgtgttggaaggctttttgatttaaaatcttttcggatttataacatcctgttaagttttaggagaacccgttttcccagagcagattcaagcttctaaaaataaatgctttcagtagcaggaatggcattgtttaaaaagctgatggcagggtaagcatttgggttagtgttttattaacatatttgtaagtacttgttcattgtggaaatgtgtccttgactaaaaccatacgtggctatggaaaccatgtttgtagttctgaatacacaggttttgtgtgtatttactctatgtattaaattattattgcccttagtttaaagtaaggattacaattggatttaagtagatcactgaatgttattgtttatgaaacttaactttttgtatgctgcttataaacatgatctataaatcagtgcttgggaaaattttactttcttaatctactgatacaggaataaaatatgaacaattaaacaggttgatccttgaa

SEQ ID NO: 559192 - DNA, 492 bp, Homo sapiens
  misc_feature (274)..(274): n is a, c, g, or t
ataggcatgagccaccgtgcctggctcaaaatttcttttttgcaccaaaatacactcatactaacttgttatgtctgatcaggatctagtttgaggcactgaaaatatttgagaagtttgagggctggggcaggaagattgcttgggggcaggaagattgcttgattccaggagtttgagaccagcctgggcaatacagcaagacccaaaaaatttaaaaagaaattagccagccatggtggtgcacacctatggtcccagctacttgggaggntgaggcaagaggattgcttgagcctcagtgctctcatagaacaaagtgagccatgatggtgccactgcactccagcctgagtgacagagtgagactggtctctcaaaaaagtttgaagaggctgggcgtggtggctcacgcccgtaatcccagcactttgggaggccaaggtgggtggaccacctgaggtcaggagttcaagaccgcgagcggccgct

SEQ ID NO: 559193 - DNA, 1575 bp, Homo sapiens
gcctcggctcccaaggtgctgggattacaggtgtgagccaccggctggctactatagctgttaatatgtgaaatctaaatggcatttttgacttgacagctcagacttgtacttcatgtattcagaagtttttagacaacaattagtttattgtctagttcattattaaagataatgaactaggccgggcgtggtggctcacacctgtaatcccagcactttgggaggctgaggcgggcagatcacttgaggccaggagttccagaccagcctggccaacatggcaaaacctcacctctactaaaaattaaaaggttagccaggcatggaggcatgtgcctgtaatcccagctgcttgggaggctggggcaggggaattgcttgagcccgggaggcggagattgcagtgagccgagatggcgccactgcactccagcctgggcaatagagtgtgactctcaaaaaaacaaagataatgaactggtttgcatttcttttaaagagatgatagaggaaaatatagttttttgtaagaatgtttatctctcttaaaagataatcttttaattttcttcagataacaagttattattattttttaagaaagcaagtttcacgggccgggcgcggtggctcacgcctgtaatcccagcactttgggaggccaaggcgggcggatcacgaggtcaggagatcgaaaccatcctggctaacacggtgaaaccccgtctctactaaaaatacaaaaaattagccgggcgcggtggcaggcgcctgtagtcccagctacttgggaggctgaggcaggagaatggcgtaaacctgggaggcggagcttgcagtgagccgagatcgcaccactgcactccagcctgggcgacagagcgagactccgtctcaaaaaaaaaaaagaaagcaagtttcacatgaataatgctgtgttggaaggctttttgatttaaaatcttttcggatttataacatcctgttaagttttaggagaacccgttttcccagagcagattcaagcttctaaaaataaatgctttcagtagcaggaatggcattgtttaaaaagctgatggcagggtaagcatttgggttagtgttttattaacatatttgtaagtacttgttcattgtggaaatgtgtccttgactaaaaccatacgtggctatggaaaccatgtttgtagttctgaatacacaggttttgtgtgtatttactctatgtattaaattattattgcccttagtttaaagtaaggattacaattggatttaagtagatcactgaatgttattgtttatgaaacttaactttttgtatgctgcttataaacatgatctataaatcagtgcttgggaaaattttactttcttaatctactgatacaggaataaaatatgaacaattaaacaggttgatccttgaatctgactgatttgtgactttttttcctcccaaagtgctgagattacaggcgtgagccaccacgcctggcctacttccctctctctgacccctgccacagcacatcctgttcggcgaacgctgggccgtcggagcacatc

SEQ ID NO: 559194 - DNA, 108 bp, Homo sapiens
  misc_feature (22)..(22): n is a, c, g, or t
  misc_feature (77)..(77): n is a, c, g, or t
aattttcaaggaatattaatcntcacccaaattttgaatttttatgtaaaaaattataatttaagggtaaacatagntggacacagctttcgcagtgcatttacattg

SEQ ID NO: 559195 - DNA, 210 bp, Homo sapiens
taggacgtcgggacagcgggaatgaggttcatccattcatgcacggcactaacgagatgacgaggcatcggcctacctgaggagagcgatacttactccgggcggtgacccgcgcttcattgaatgagttcactctgacattcagagcactgggcagaaatcacatcgcgtcaacacccgccgcgcgcctacgcgatgctttgctttaat

SEQ ID NO: 559196 - DNA, 754 bp, Homo sapiens
ggggaggtggggacaaggatttaaaaaattaacaattggatactatattcagtacctgggtgacaagattaactgtatcccaaagctttgcatcactcaatatgcccaggtaacaaacctgcatatgtaccccttttagtctgaaataagaattgaaattattagaaaataaataaagctggtgatgaagcatgaaccatattttaaacatatagatttttatcatttattacatacacacccaattttataattaccattgagattagtattttctcaactcatcattttattcagaatacatccattcttttcataattcagtaaagatgtatcgaaagtctagtatgaacaagataaaatggtcacttcagtaaggacatttattttgaagtatgtttactcttatccatgcctaataattctctccaaaaggtcgttatagcttttaatacacaatcttcataagaaagttttacatttaaattcaagtttaacaacgtaaaaaatttatttatgtttactgtattttggaacatttattagaaacaaagagaccatggttatattctatgccttagtaccagcatatacttttaaaatgttaatgtttatcaaatactaatttaaatacaaaacagtgagaataaaaaaacatctttgcttgtattaattcataaattacttcagctgaaagtcttttgaaacaatatccaaatattatttaatgtttatactgatgtacattgtatgc

SEQ ID NO: 559197 - DNA, 323 bp, Homo sapiens
cacgctccctctggtcgggcccttctctgcagtttcattcgaatagaggtcaccaccgagaacttctgctgtaatgccttctggcaggagtcccaatgctgctgcccctacccaggatggctatcttatgaattcttgtgctccagcatcacatgctgattcttcttccctctcccaccggggtagtctcacaggcgccccgtgaactttctccagaccactcttgtcggcacgttttgggacattatttggattgctttttctaggttcttggagccactcagtctgggtccaacagtatcaaccccccacagagagagcgt

SEQ ID NO: 559198 - DNA, 208 bp, Homo sapiens
attgtttttataatttgtggttttcatgaaacattgctctgcatttatcaggaaaaactgaatttcccaacaggtgacctgacaagttattataactattatacataatcaagatcctgcctctacggaaatagctaaacctaaaaatgtttgcattaatgaataaatacttcctgcattccttggcccagttctgaaattggtgacc

SEQ ID NO: 559199 - DNA, 194 bp, Homo sapiens
tgctagtgagtgggcgctcgcttggccagcacagagtcgaactgcagcccccagaatattccagaaaggggcatctgggtggaggctgcagtgtcgtgagtctcctctcagaggccatccaggccttgctgtattcgtctgtccagggaggtggctgagtgggtggagacgccggggtcgggaagagaccggca

SEQ ID NO: 559200 - DNA, 169 bp, Homo sapiens
tacagttcatatgtttggcaattttcaggtaatgggtgttgcagcttgcaactgctttcttaataggtggctagcttttagtgcctactatgggtgttacattttttactctctctacaaggtttttccctcagtgtccaactgagctgttcctctattggactaacag

SEQ ID NO: 559201 - DNA, 2179 bp, Homo sapiens
  misc_feature (671)..(671): n is a, c, g, or t
  misc_feature (1863)..(1863): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggccccaccaaacgtggtcctgggagtcacaaaccctttctttatcaaaacactccagcactggccccacatcctccgagtcggggagcccaagatgtcaggtcaggctcccggtgaggtgcagggggtgctgctcagaagcctcgttgagtgtggggccgcctcagagcccgtggggatggccagagctgcgggcactgaggcctggccaccgggcgtgtctcgtaggagacctgcctaagcaagtcaagctgaacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtaagatgcctcccagccttgtcccagcgccaccagcctggcacggagctgcgcctgccctgaccatggctgcccctncaggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacaaaaaaaaaaaaaac

SEQ ID NO: 559202 - DNA, 1479 bp, Homo sapiens
  misc_feature (671)..(671): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggccccaggagacctgcctaagcaagtcaagctgaaaaagcctttcaaggttgaagaccctggacaccaagccaggcctctacaccgcttacacggcccacctccaccgcgacaaggcgctgctcaaacggctgctcaagggcgtgcagaagaagcggccgtcagatgtgcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacaaaaaaaaaaaaaac

SEQ ID NO: 559203 - DNA, 114 bp, Homo sapiens
  misc_feature (99)..(99): n is a, c, g, or t
ttatgtaatattagaggagtataggctgtgactagtatgttgagtctgaagtaggagagtgatatttgacaggagacgtggtactagccagagagtctnccagtagctactagt

SEQ ID NO: 559204 - DNA, 331 bp, Homo sapiens
ggcgccgctgtggagccgccgccacgtgtgcgcatatgcaatggatgtgcgtgcgcgactgctccaggttcctgagcaagaggaataagcagacctacaggactgagcccaataacttggagggccgcaatttctttcgcttcaacggactgattcacaccaagagtgtgggcgtggagcccgcagaccaccgccttctatgtgcggaccaccatcaagaatggtcgcgccacgctcagaagaattagacacatgatccggaagaacaagtgccggcccgacctgtgcatgggagacattcgcaagggcagagccattctgtgcagacggg

SEQ ID NO: 559205 - DNA, 1452 bp, Homo sapiens
  misc_feature (671)..(671): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggccccaccaaacgtggtcctgggagtcacaaaccctttctttatcaaaacactccagcactggccccacatcctccgagtcggggagcccaagatgtcaggagacctgcctaagcaagtcaagctgaaaaagcctttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcgccggcagaagtgcgcctgggtgcagaagtgcgcctgggtacagatgtgcgccaag

SEQ ID NO: 559206 - DNA, 234 bp, Homo sapiens
atccaaagaattcggcacgaggggaagcagcactggtggtgcctcagccatggccttggaccctttcttcttctcgggcctccttttttaacttgaacaggcttttgtggaccctccaattgtttttgacttaaggccacccttgggtgttaatctggccccagggaaagaggggccacggttatcccttggggggaaacaaaatttggaggtaaaagtgtgacctggtacacc

SEQ ID NO: 559207 - DNA, 1085 bp, Homo sapiens
tgatgctgtgtgctgacgctgcgctgcgatctgcgctcgtgacccctggccgctgccgccatcactgtcgcccgcccagtcgccccgtcagcctgcttccccatcgccatgttgatggctgatggcctgcctgcctgcctgcctgctgtgtggctcgtgagcctgctgtgtgcctgtggctgtgctgtgccactgagtggctacgttgtgctggccctgaaacttgcctgcctgtgtgatgcctgatcgtgcggagccgcgtggtcctctgtaccccaagacggtccactgcccgaagtgcgccgacagtctacattagtactgacattgttgtccgtaaggaacgcacgtttgacagccacttcagtggccttgggtttgggcattgcttccgtcattaagcccaagccactcgtttggccccgtttccggcatcactcgttcgaacgttaacggttcgggaaacttttgtcaagccaccattttccccaagggggctgcttggagccgaacgcaaagcggtagcagacacgaactataagcccagaacgcgggttacttctgcgacgttgcggcacaagtttccccacccttgtacagcattggggtagccactgtggccccttgcgagtggcgccacgcgctgtcccaaacacccgtttagcagcccttactacgcggtacgccacacgacttgcgtgcgcccgacaggaggcaacgtcccaggctcacacgctcattaacacccgatattcgctgtgcgtcaacgcgacagcgcaacagcgcgcgttcacacgttaagatcggccccagactttgaggggagagtaatcgccccgttggcgagattacggcccaaagttaccgcgcgtagttcggccatcatcgacgcatgggccttcacgggggacaacaccgagatggggtgcatcccggtagggcaccgtccgttcgcgttcggtatcccaacgtgctaggcgccccgaggacagaccgagaacgccgtggagccattaaacgccccagagcgaacggcgggctcagcggcacccaccgttctccacagtgggctaacagcagggaaa

SEQ ID NO: 559208 - DNA, 417 bp, Homo sapiens
ggcacgaggagagtgtgagagagtgagagagagagagagagagagagagagagagagagagagagagagagagtgagagagagtgtgtgcgagtgtgtgcgcgccagtgttgcttcctatctactgttctcttccctatcttttactctctccccctctatgtcccctttcttttcccctcttctctctctttatctcctcctgtctctccatgtcttttctctttcactccttatcgctcttcttacttcgccttctctcctacactctctccctgttcccatgtttccgccatctttcacttttctgctctttcctttgcctcctctctcctcctgtctctttttgccttcctttccctatttttctctttattacctctctcccttttttcttctctggatctttctcgccttt

SEQ ID NO: 559209 - DNA, 385 bp, Homo sapiens
caccccgatatctgatcccagtgtgcaatagacattatgacttaaaaaaagtacataccttaatttaaaaatactttattagagacaatgatgtcaccaaaatggcagagtagaagcaatctggcttcacatctcccacagataagccaaaaacaaatatctagcacaaagcttatcatcagcaatatcccagaactcaaatctgaggctgatagtacccgtgagccacagaggactgaaaaactccaagcaaacagtaagagaaatagccttctctttgcatgatgccttttccgcaatctgccaggccctgtgcatgaaaaattcctcccagactcagcttcttcattggaaaaagttagatggaggaggacagccagctttc

SEQ ID NO: 559210 - DNA, 513 bp, Homo sapiens
taagtataaaaaaatctctatccttcggaaaaagggacaaatgcaactaaaattgttctcgtgtcactgcacatttaactgtcacagagtccccgaatgtcagaactggaagaaactttgctcctctaacccaaccccttattttataggcacagcaatagtcccaggaaattgtagtaatttgcctaaagccaaccacagaattggttagtactagatccaaaactagaacccgtatctcctaaccccatacccttcccattatataggacaagatatgtggttatataagtcttgcagaattctctgccatttcaatattcggtttactaggaaagttaagttgtacctttatttaaactaaggcacacgtagaaggaaactaatcaaacttgggcaaaggtacgttgtgcctagagcttgcttgagttcttgctgccacagttagtttgttggtatgggggtccgacaggctgtttgtgctttcaccgcaggtgtttccggcgtttgaag

SEQ ID NO: 559211 - DNA, 531 bp, Homo sapiens
acaaaacagaaaacagccctcccatagacattgaaagtggggattgaaaacaacaacttgcacattacagaagctgaaaaaggtatatatcccaacccagtaatgaaccataatgctgctaagcctcacttgcctgtttaacaaaatatataaaaagaaaaacaagccgagtatacattttgcaggtcctccaatcatatactgtgtgataaccatatcagaaatctcactgtaaacaacatattcatataaacacacgttataaatctaatcgtcattctgtattccatcttgtcattaaacaatttcaaaggaattataatttagcttatgtacaaatcaattattttttccttctgtgctttttattttagctcttcttactatacactcccaatgtgtgcttattaatcagtatactcccaagacttcatatttctttgtttctgcattcttctttcacagaagttttcccaattcttctgaaaacagaaacctcaatgtgagagtattttgaatccctcacagaat

SEQ ID NO: 559212 - DNA, 382 bp, Homo sapiens
aaggaccattctgtcctatccttcttagaagcttcgaactcaaaatcatggaaaggttttaagatttgaggttggttttagggttgctagatttagcaagtaaaaataaggatggccccgttaaattttaacttaaaattaacaagttttttgttaattttttgttttttgtctcagcatcagtatatcccatgcaatatttgaggtgtgctcatactaaaattatttgtgtatctgaaattcaaattaaactgggtgtctttttcttttcatctggcaaccctactaagatcataaacccttggaaatctgtgtgtgtgcgggtgtgtgtgtgtgtgtgtgtgcaggggtggcaaaagtactgtgggatgggccagaaata

SEQ ID NO: 559213 - DNA, 428 bp, Homo sapiens
ggccccagggaagatccaatatccatgggggcagtcataatcttggagctccaaaatgatcgtgccgtatagagctccatgctctcatatccaggtcacactgatgtaagaggtaggttcccatggtcttgggcagctccacccctgtggctttgcagggtacagcctcccttccagctgctttcatgggctggtgttgagtgtctgcggctattccaggtgcatggtgcaagctgtcagtggatctaccatctagggcctggaggacagtggccctcctctcacagctccactaggcagtgccccaatagggactccgtgtgggggctccaaccccacatttcccttccacactgctttagcagaggttctccatgagagccctacccctgcagcaaacttctgcctggacattcaggtgtttccat

SEQ ID NO: 559214 - DNA, 288 bp, Homo sapiens
cacgaggagaacaaggaagtcgaactggcttcgcgcgagaacgtgcgcatcaccgagtatgagctggtcgacaaggacgccgagggcgatgcgcgctttgcgcccaagatcacgctgcaagccaccacggtcggccgcgcgatcctgtccgagatcctgccgcagggactgccgttctcggtgctgaacaagacgctgaagaagaaggtaatctcgcgcctgatcatcacagcgctccgcaagtgaggtctgagcaaaacggtcttgttcacccagaacctgtagaag

SEQ ID NO: 559215 - DNA, 114 bp, Homo sapiens
ggcggggtgactctgaggatccctgggagcaggacactgtgggcagtagttaaagcatgcacatagaacaaatggcttctgcatcatcatctgttttctttttcacttgcaaaa

SEQ ID NO: 559216 - DNA, 115 bp, Homo sapiens
atctgcgacgggcgactcacactcatcacacagtaccgcagtttgcagcatcgagcattctagagacacgatgcgtcacaactctacagatgatgcaatggatctcacgtgctgc

SEQ ID NO: 559217 - DNA, 369 bp, Homo sapiens
gattagatcccatcgaccatggcagtgccagctactcttgacacagatatacttcagcactgatcttctgtccaaagaacatcatctgagcgattgagatctacaagctcttgagatcatgataatgattctctccacctggtgctcatataaaggtgtgagtgatttctagattgggcccctactggttaagatctctcttggtctgagaagagtgactgctccagaacaggatagaggtatggtgagtcatagcgtgtgtctccggcttgaccactcagctaattatgatccaggacttggcgctggacattggctgttctgctctgaatgaagtctgaacagaaccaaaatggcctcaggaaggac

SEQ ID NO: 559218 - DNA, 498 bp, Homo sapiens
ttcatagcatattaatggaagctcaccagaaaggggcaaaatgattaacgaaattgatggtttttagacagggggttggctttacaccaacgaaaaagaaagacacatgaatatgctctggatcttgattttatttctcttattctcacggtaggctgagatgctgttaaatgagatgttataagcctaaggcagattgacttgctgcatcaagtattttacactcctcggcaaagcaagtctgcttatcgtcagccttgcaggacttttttacaaaagctgtgaaatcatacataacagctttcagttgctcttttgttgcctcgggcttgagattcacaagctcaacaagtgcaggttgtttctagatgtggctctacttctgagaaagtgtgcatatatctgcttggaaggtgaatgattcagcattaaactctatgagaacgtatgtttggattgactccagagctgaaaagcatggccactctgttcaccaag

SEQ ID NO: 559219 - DNA, 172 bp, Homo sapiens
gtaatctgccatcccacaccggtgcacagtttgccagctaattcaaaaaactcctggtgccaggaaaaatccatcacattctctgcacaggaaacctttgcaccaaggatagttatgactatctcaagactctgcctggtgatgttcatattgcgagaggagacttcaatga

SEQ ID NO: 559220 - DNA, 414 bp, Homo sapiens
gttcaagcattccagtacactgacaaacacggagaagtctgccctgctggctggaaacctggtagtgaaacaatggcgtctcgctctgtcacccaagctggagtgcagtggcacgatttcagctgactgcaacctctacctcctgggttccagcgattctcctgtctcagcctcccgagtatctgggattacatgcgtgtgcctccatgcctggccaatttttgtatttttagtagagacggggtttcgccatgttgctcaggctggtgtcgaactcctgaactcaagtgatctgcctgcctcggcatcccaaagtgctgggattacaggtgtgtggccccaccgcttgccttttaacaattttcctaataaccgaattatattcctagcttccgaataaaatagcactaaatg

SEQ ID NO: 559221 - DNA, 260 bp, Homo sapiens
ctgacccaccaggatatgctgggctgcttttatcctcccagccccatcaacccttctaggctttctgatggaacaaatgggtggatagtagcactgtttattaaaatagggaagctgaattagggtggtgtcagggctgggggtgttactacagtttggaagtagaaagcaaggctttctcttggctgaaagtaggggaagtctgagaagtccgagggtcactagggagaaggtatcttacaggtgggtcagaacataag

SEQ ID NO: 559222 - DNA, 313 bp, Homo sapiens
  misc_feature (8)..(8): n is a, c, g, or t
  misc_feature (65)..(65): n is a, c, g, or t
  misc_feature (67)..(67): n is a, c, g, or t
  misc_feature (106)..(106): n is a, c, g, or t
  misc_feature (116)..(116): n is a, c, g, or t
  misc_feature (123)..(123): n is a, c, g, or t
  misc_feature (151)..(151): n is a, c, g, or t
  misc_feature (219)..(219): n is a, c, g, or t
ccaccccnggccctccccaaagtgcctgagattacaggtgtgagcccgccatgcccccaccctanantctaaaatcttaagtggtcccagtctgtgtatttagggntgaaaaaaanccctggnaaatcccttgttcactttctgtctcaantttcccagtaactaactttttctttctctctctctccctttctttatttttttgagatggagtctcantctgtcatctgctggagagcagtgcagtgacaccatctcagatcactgcaactgcactccagcctgaacaacaagagcgaaactccaaaatggg

SEQ ID NO: 559223 - DNA, 749 bp, Homo sapiens
gggctaacaacagccccgcgctgacaggcaactcgcagccgtagcaccaggcggcatgcagctgcggctcagcaacagcagcagtgcgtgcggcgtgctggcgctaccaagcctgtgcggtctccgcgtcaagcatgggcaatgtgctcccgctctggtggcaactgagaagaccatgaacctcaaccccatgatcctgattcaagatcctgtcgtcgccttacttcaagagttacagcgtctacgagctcaagacctaccacgaggtggtggactgagatctagctttagaggtcaccgcagcgttgaaccagtgggatgaaacggaagcatggagaacacatgcgggccagaacagggcatgtgcggacgggcgttcagaggctgtctggaacacggaggaaatcgctctatctaacaagcattatcgcctgttatacaaagtgtatttaccctgaagcttaactcgaaagcaagtgatgggtcttataacacacacagacatctccatatattagagcgcttggattcatgtatctaagatatacacagacccctacagatctgtgggacctggtgcgaatccttccttgatgcatgcaagaggacctcacatgtcgcaagactggtggcaggctgtcgctatgacccatagaacgaaatgctaccgaatctaactctcacaaacaactgcaacgtggcacactcacctaggaaccccagaaatccccgtcacaaatcaaccgcat

SEQ ID NO: 559224 - DNA, 758 bp, Homo sapiens
taagttaaaagttaaatggtagttcccaaatacttttcatatgacaatcttacataaatgtcccaaaacacttgggcgttatctcgtggtacccggtcaatagcgtggtctaagggctataaagcaggagaagccggtggtgacgtgggttctctgcggggagggcctcgtggtttctctccggcgggctcagggcttgcggggggcgtgggggccagggacgtcgtggcgacctagaagggtggtggacggcacagctgcagggaggccttctctttaaccctcgcggagaagttgggcacgtgggagccattctccctcttgttaagttccacaagagagaggcccgtttgccccgaggggaaccctccctctcgtcgggccctccacgagggttgggttgcggtgcaagccggcgcatctggggcccagtgcttcaagagagcatacgaggtgtgggacaacgagggggatacacaacttccaggtgtgtgcatgcgaatgacttgtttgaaaacgtggcccttgactcacgggggaaaccaagccccatgagggcttcttatccacccaaaacgaattgggatagaggggtcccccaatcatgccaatcatacacaagaaagccccctgggtcccatgggactggtcccgtggggggccagggccacaaccctgtttgggacgagggaaaaagggcttggccccaaacaggcgggaacaacaagatatgcgccatgggtgccctgaaaaaggaa

SEQ ID NO: 559225 - DNA, 125 bp, Homo sapiens
ctagaggatccccccacccagccataggcgcttgtcgcgaggaaaaagatctgacgcccagcctgtccccacagattaaggtcctgcggagtgtgaaataccccaccgagaaacaccgtgaaaag

SEQ ID NO: 559226 - DNA, 1294 bp, Homo sapiens
catagatgctcccgatggacacagagactttatcaaaaacatgattacagggtacatctcatggctgagctgtgctgatccgtgagttcgttagctcgcatggttggttggctgaactttgaatgcttgagtatctccacagaattggtgcagaccctgcatgagcgactgcccgttctcggacttacatcacgtgcggttgtgaagacgaaccgtaatatgtcggtgttaaagcacagacatgagattccacctgaggtccaccgctagcatgccacgacagagcatactgagggacacatgtgtgttaaggcgacgttcaagcaagcttacgattaacgacaaatttggtctacagagctcgctcggatcaccagttcaggcattgtagtgtctcacagttcttctaggctttcggcaacttgggtgtatctaacaatgcctggggagactcaaagctgtgcctagacactgacccttgagtttccaaagggcgcatggaacagaagtcaacacgctggtaaacgggattgggccaatgggcccatgtagtgaaacccaacagcgtgcttagaagggctccttgggactagcattcctaaccgaccaaacttcgtacctaaacctgacgaatgcccatttgcctgccttgaccgtcttccagggattggtcttacaaaaaattgggtagggtaatctggttaactgggttaaccttgattagggccggagctgggaacgacctcggatggtatcttcaaaaacccccggttattgggtaggggtcaccacttttggcttcacaaggtccaaaccggtttacacacccgggcaacggtaaacaacttcctggtcccacgcattgccaccccagtgaacaggctttcggacagttgaaagctcccttaccctggggggaccaatggtggggccttccaacttgggtccacaaggcaaccttgtgtgtcctggccacaggggcaagtctcccgaccttgttagacaaaccgtgtgctctggttgaaacgacctcaaaagatttagacccacccaaatgtgtgaaagcaagtgtgtgattcacatgggctccaacgagaacataaccccggaaagcactacaccgggacacgaaaaaaacgcacccagaataaaaacacacccagaacatgcagacgtgtcccaaccgggccaccaagcacgcagtagcagaagcatggagaccgcagcagggacaaacagacacatcaccgacgcagggaacaaacacagggtcacaatgagggcacgcactaaa

SEQ ID NO: 559227 - DNA, 1112 bp, Homo sapiens
tctttgcgtcttttcataccttcttcttttttattttttcctttatttgttccttgatcgacgagtgttttctactgtgaaatactgtagagctcattctcagtaggcttatctcgtctttcctaccacaggttagtacccacttaggtatgttgtcgatttcactgtacttatttattaacttctttactcaacttcctacattcttctccttgcttaagtcgcaaccttctttaatgtttctgttgcttttaggatgtctcgtcgatacatctccataaatttgaagtatctacatgtgttggtgcagccaggtttatagagtgaatgtagttaacaagcctaaaaatgtgctgccacctttataggacgagtcttctagaatggagacaacatttgcttgcatccacatagacctttatgttttgttttcagctgtaaacttgcctcctttggctacattcgtaaatgaaccagaagtttttttttctctatttctcctaatatgttagcttttgttcttgtcaagatgtatcatgggtattgcgtgctgctcgtacactgtaccacgaattttcattagcatgtggttcagaatatacaatgattaggtttttaaaaagtatcttgatggttcttttctacttataatgttcagacctttcagacacagtgtaccacagaattgtcataaactgttgttgtgtcagtgaactggctttttgctatggtaggtcattaaacacagcacttactcttaaaacactgaagaatttctgatcatcctacggagtattgacacattctacgaaattgtgtcagctgtctttttagtacctggatatattaatcgtgtcctctgaatggccaattgatagatggttcacgaagagaaatctcaatgaacataaagagaatatttattcatggcgacttaatctaaagttatttgcctgaaccttaagaaaactactgtgcgtaactctcagtttgtgcttaactccatttgacatgaggtgacaagaagagagtctgagtctacctgtggcatatgttggttaattttcagtgccttgaagatacattcacaaatacttcgcgtttgaggaaga

SEQ ID NO: 559228 - DNA, 387 bp, Homo sapiens
  misc_feature (110)..(110): n is a, c, g, or t
  misc_feature (124)..(124): n is a, c, g, or t
  misc_feature (161)..(162): n is a, c, g, or t
  misc_feature (380)..(380): n is a, c, g, or t
aacatgcgaacggactgatcgggtgctagtctcgaggggccgggaggtggacgacggcgctcaatcgaaggcgcggatcttggcgatcagctcgtcggcgtcgacgggcntgacgatgtagtcncgcgcgcctggcgcatgccccagaccttgtcggtccnngtcttgctggtgcacatgaacatgcgaacggactgatcccaacaccttttcaaggacaacttcgcacctctcatgttcgtcacaaatattggactacctacctggggacactggggaactcacgatcagtccgttcgcatgtttcacaacaattatcaatataaaaccccctgccataacccaataccaaacacccctcttcgtctgatcgtcgtcgncatgaat

SEQ ID NO: 559229 - DNA, 725 bp, Homo sapiens
gagttgtcagaaatttttatttaaagaagtaacattggttattgattggacatatatcattatggtttagggtatgagatacagtgtccaatgtggtattatcagtttaatatacatctacttgtggcaatagtgaacagtttcaagagatgaatacatatttcaaaggaggagaaaggcgtaactgcactttcatttcaatgtctgagtttgataaccaaaaggacttgcatttttagataaaaattttctatttcccaaatctcaagacctagatacaaaatgtagagctgcagatttagggcccgaatggctggagtagcagcaggtgttacctgcacatttgtgaacattttaccaagagaaaaaaggggaaagtgaagattctcatgtctgaatgtgtactcaatgaaaacgttactctgattaggtttgtgggccccatggtctctgaatcagtttaaggtctgaagatacaagagtcattgagataaaactattgattgttgccctgtgaagttggtagaaatttggtttagtctctctagaagtgactgtagaggactatagataccaaataggcagaaacacagttctgcttgcatatttaggggacagcatgcactttgttgcacaagtgtgagttgactggaagtctgaaaaggaaagtcccctctagagtaaattccactcgtgccgaaattcctgcaaccccgggggatcct

SEQ ID NO: 559230 - DNA, 402 bp, Homo sapiens
  misc_feature (395)..(395): n is a, c, g, or t
atccccaaccagtgtcgacggactgatcgcaagatgcacacagacataatcacttgaacccgggaggtggaggttacagtgagccaagatcgcgccactacactccagcctgggtgacagagtgagactccgtctcaaaaaaaccaaaagactttatcttatttcctgtatgtttgatcagtccgttcgcatgttaacatgcgaacggactgatcccaacaccttttcaaggacaacttcgcacctctcatgttcgtcacaaatattggactacctacctggggacactggggaactcacgatcagtccgttcgcatgtttcacaacaattatcaatataaaaccccctgccataacccaataccaaacacccctcttcgtctgatcgtcgtcgncatgaat

SEQ ID NO: 559231 - DNA, 223 bp, Homo sapiens
gggggggacttaaaaatttttaagcttgggcattaaatggtcctggattcaaatttagggtcaacatttgattaacttctttttcctttttgaaaaagggggataccattagaatgggggaggttttgaatgaaccaatttagggaaggttttttgggtttttgtcccctaagagggacttaataaatgataaatttttttaaataaataattttttacccca

SEQ ID NO: 559232 - DNA, 302 bp, Homo sapiens
  misc_feature (295)..(295): n is a, c, g, or t
aacatgcgaacggactgatcgggtgctagtctcgaggggccgggaggtggacgacggcgctcaatcgaaggcgcggatcagtccgttcgcatgttaacatgcgaacggactgatcccaacaccttttcaaggacaacttcgcacctctcatgttcgtcacaaatattggactacctacctggggacactggggaactcacgatcagtccgttcgcatgtttcacaacaattatcaatataaaaccccctgccataacccaataccaaacacccctcttcgtctgatcgtcgtcgncatgaat

SEQ ID NO: 559233 - DNA, 911 bp, Homo sapiens
ccgtaggttagtgaacctggtcagaggcggtcacctatgacaatcccggatcatgactatgtgtttgtgatctgcaccaggtcactaaaacgcccggaggctagcgagcagttccgatcatatccagatggagttactgatggtcatctacaggagtctgatcatacaggtagttctcactgcgagcatcgcatatcggaattactgacatcgttctgatagctatcctcttcaacaatatactctccggacaatgaaaccataaccaatactaaacaatcaatactcatcattaataatcataatggctatagaataaaactaggaatagcccctttcattctgagtcccagaggttacccaaggcaccccgtctgacatccggcctggttcttctcacatgacaaaaaactagccaccatctcaaatcatataccaaatctctccctaactaaagtaagccttctcctcactctctcaatcttatccatcataggcaggcagtgaggtggattaagcaaacccagtacgcaaaatcttagcataatctcaattacccacataggatgaatattagcagttctaccgtacaccctaaaataacccatcttagtttaatatatattatcctactaataacgatcctactactcagttaaaccaagcacagaacgtagtactatttggaactgaaaagtacagaatcaactagtcagcacttctctgcctggggcgcccgaacggtaggcaaggcaatgaaaacaagaaaaggctcaaacacaaaagaaaacgtaacgtatagtacgatacctcaacaccatacaggaaagggtacacagcccagccgacacacggaacggaaaaaagggcacaggaagaacaacggcgaacacagggagacaagaaacacg

SEQ ID NO: 559234 - DNA, 316 bp, Homo sapiens
  misc_feature (110)..(110): n is a, c, g, or t
  misc_feature (124)..(124): n is a, c, g, or t
  misc_feature (161)..(162): n is a, c, g, or t
aacatgcgaacggactgatcgggtgctagtctcgaggggccgggaggtggacgacggcgctcaatcgaaggcgcggatcttggcgatcagctcgtcggcgtcgacgggcntgacgatgtagtcncgcgcgcctggcgcatgccccagaccttgtcggtccnngtcttgctggtgcacatgaacatgcgaacggactgatcccaacaccttttcaaggacaacttcgcacctctcatgttcgtcacaaatattggacaagcccgaatgatatttcctattcgcctacacaattctccgatcagtccgttcgcatgtt

SEQ ID NO: 559235 - DNA, 240 bp, Homo sapiens
  misc_feature (233)..(233): n is a, c, g, or t
ctttcaaggtgacaaacttcgctacctctcatgttcgtcacaatatattggtactacctaccttggatggacaacttcgcacctctcatgttcgtcacaaatattggactacctacctggggacactggggaactcacgatcagtccgttcgcatgtttcacaacaattatcaatataaaaccccctgccataacccaataccaaacacccctcttcgtctgatcgtcgtcgncatgaat

SEQ ID NO: 559236 - DNA, 219 bp, Homo sapiens
cggacctagtgatgtaatgtatagcaatagagtacatctgtcttatcttttcgtaataagataaaggggcatagtcatatgatgacaaagggatgatttcaaccttttcttctcgccattaaagagaattgaaagaaacagtctttgcatacatatacagagagtttgtcagcctttcctagacacagccagccacagtcagactaaacattcaaagac

SEQ ID NO: 559237 - DNA, 288 bp, Homo sapiens
actctagaggaatcccctcaacagtgccaaataatctagtacaaggcctgcagagctaccgtggtgccacgttggatgaaaggggagctgagagttagccaggtctctgtctctggcaggccataccccacataagtggtaagactgacacaaacccaggagagctaacaggtccaaagtgtgcaaggcagtgggtgggggaagggctttgaaagacatctaatcccttctgagaacagggtgtcttagaggcacaaagggtgaatgcgtatccacccagaaaggtga

SEQ ID NO: 559238 - DNA, 1108 bp, Homo sapiens
  misc_feature (316)..(316): n is a, c, g, or t
  misc_feature (521)..(521): n is a, c, g, or t
accccgatgcatacaccacatgaaacatcctatcatctgtaggctcagttcatttctctaacgagctagtaagtatcaagtaagttattcatgcatttgatgaagccgttcagcgttcgaagccgaaaagtccataatagtagaagaaccctccataaagctggagtgacgtcatatggatgccccccacctctaccacacattcgaagaaccgcgtactacatagaaatctagacgaaaaataggaaggaatcagaaccgccccgagaagctgggttgtcaggctcaaacccctatggcacgtcctactgacttnttgtgccaacagaaaagagataaaacagaatagacagataagtaagcaattcgtcgttggtggagaggtcggagcggtcgcctgagaaacaaattagtaatctacagaagacaagtcaggtgtcgggaggggcaagggggcgccccgagcgagtgagtagagtctcacagccactcgtgtgtcccacagacgtgcgtgcacccanataggagggaactcctcgggaggtccaaacggacataaatgaggtcaggagtagtgtctcggcgcctccactaaacaaaagtcagaccgcgggagtggagaagcgcgagccgtcccttcggattagtaaaagtccccccgccaaagagcgagaggggccacgtgagagcgggcggcttagctttgcggggcgccaagtgaccgcccaagggagcgtcgacaaggggcagaaggggcgtgagatctacccacataggacgcccgcgttccgggggggaaggactttcataggggcagcaagtaaccaacgcgggggtacgaaagcccatgaagacctcgagaagaaattagctaagaggggcagggggaatcccaagggcgggatatcccctgaaaatggaacgtcagccagggagtgaagcttacgtcaactgcaacacctgatcacgcggctcacccctcacacgggaaacggcttaggtagcgagaaagtccgtgggaacctgacacggagagggcaaaggatcgaccgtgaagggcccctgaagaggaccaaccccacccccgggcataatgctcgggaggaac

SEQ ID NO: 559239 - DNA, 203 bp, Homo sapiens
gattttggatatttaataccctcattcctcttccttagacatttcaactctggcagctgattctaaagtatccatgctaaatttccccagtctctaaatttagagatttgagattcactcggtgtggcttctagtattattcagcacaatactcaatgagctacaacgtctggcacagataataggtacatactcagtaaaca

SEQ ID NO: 559240 - DNA, 919 bp, Homo sapiens
caaatgattagagggctggaactttcagtcccacccaccaacctctgggtaaggtgttaggggtgtataaaactcttgaacaggccgggcacagtggctcacgcctgtaaatcccagcactttggggggccgaggtgggcggatcacctgaggtcagaagttcgaggccagcctgaccaacatggaaaaaccctgtcgctactaaaaatacaaagttggccgggtgtggtggtgcatgcctgtagtcccagcttctcgggaggctgaggcaggagaatcgcttgaacccgggaagcagaggttgcagtgagctgaagatcactcccatggcaactcctaggccctgggcaaacaaggaaacaaagaactccggtccccaaaaacaaaacgacaaaacacaaagaaaacaaacacaaccatggggtggcggacaccggccaccccgcgaaaagcgtccccaacaaccacaacgtcaaggcaagcgagcaggccacccaaaggaacaccagaagaacgcggcacacacacgccccaaaggaaacacacgggcccaacaagcgcggcggagcctccaaccacaaagaaacaccgccggggagaaacgcacgcgtttcgaacaccaaaccaactgtggaagttccgagggcaacaggggcagcaaacacacagacgcacacagcacctcgaataaaaaaagccctcgcgcgagaactaacaaagaagaaaaaaatagccaccagaacacaaaacacaagccagcaagaccaacaaaaacgcaagaccagatagcaaccaccaccaaaagaacagagacagcagaaaagcaaaatacaacaacaagagaaaagcgacacgacacagcaaccataacaaccaaaaaaacccaccagcatcacaagacaaagaacaacaactacgc

SEQ ID NO: 559241 - DNA, 245 bp, Homo sapiens
actagctccttcaactggtaatccagtcagtaggcaactacagggtctccgcacctgacatgaaggcacatggaaggcttcgcagaacggagacggcatataaggcgtctttcagtcatgctacactatgcaaaaacctattttgacgcacacactatatgcagaaattcaatctcgattaccacgctagatgcatttaagtactgcaggtctctaagacgagtagagcactgacctaagttcca

SEQ ID NO: 559242 - DNA, 371 bp, Homo sapiens
tgagacagagtcttgctctgttgctgaggctggagtgcagtggtgtgatcttggctcactgaaatctccgcctccgggttcaagtgattctcctgcctcagcctcccgagtagctgggattacaggcatgcaccatcatactcagctaatttttgtatttttagtagagacaggttcacatatgcagctgtctgactcgactctagtgatcaccactgctcaaaatgctaagattacagctagagcaccacgcgatctttttttttttttttttttttttttttgagacagagtctgctctgttgtcgaggtcggagtgcagtggtgtgatctggctcactgaatctcgctcggttcagtgatctcgctca

SEQ ID NO: 559243 - DNA, 178 bp, Homo sapiens
cggctttgctgcatgagcagcagctgacgaatttcataagaaactggacgcaggacttaatctgtagtctttgacaacagtgctttcataaagactagttcttatcaaccttgaatgactacagattattttgtgaaggaggatgaagtaatgtgtgttcttgtgaggtgggaggggg

SEQ ID NO: 559244 - DNA, 382 bp, Homo sapiens
  misc_feature (119)..(119): n is a, c, g, or t
  misc_feature (255)..(255): n is a, c, g, or t
  misc_feature (299)..(299): n is a, c, g, or t
  misc_feature (306)..(306): n is a, c, g, or t
  misc_feature (318)..(318): n is a, c, g, or t
  misc_feature (322)..(322): n is a, c, g, or t
  misc_feature (324)..(324): n is a, c, g, or t
  misc_feature (358)..(358): n is a, c, g, or t
  misc_feature (366)..(366): n is a, c, g, or t
tccacgtttggattaccgtattaccgcacggttcccgtcaattccctcggggcatttaccatgccaccaccagcgccgccactggtatgtaatcgcagcccaatcaattatccccatgngccctatctttgattatatgggcggtcataactgtggggggcgggacacacaggagttcgtgaaagaccgttcgccgtccatcatcgtatcgtttgatccgcgcgtatcgttgggccgtccccaaattcgttcggncaccagccattgtcaccacgtaatgtattcacacttatccattnttcgtgnagtggaatgccngtgnanaccttggcttttataaccatataggcatatatgnatgtggtntcacaccgcgtggtcg

SEQ ID NO: 559245 - DNA, 692 bp, Homo sapiens
tttaattcggctcagtctaatccttttggtattcacccataggccaaacttagggctaggatgatgataaataaaagggatgacataactataagtggcaggtaagttgtttgtagggctcatggctaggggttaaaagggagggcaatttcgtagatcaaattaataagagaggtaatagctactaaggaagaacattttatggagaaagggacgcgggcgggggcatatagggctcgaagccgcactcgtaagggggtggattttctctattgtagccgttgagttggtggtagtcaaaattgtaatacattattagtagtaaggctaggagggtgtctgattattaaaattaaggcgaagatttatgcggggaaacgccatatcgggggccccgattattaggggaactagtcagttgccaaagcctccgattatgaggggtataactatgacagaagattattacaaatgctgtgggctgtgcacgataacgtttgtacatgtggtcgttacctaaaaggtgtgcctctggcttggcccagctacgggcccgaataacgggaggctaagagccgtgcctaggaccccaggtcaatgcgccgaataaaaggtataaggttcacaggccttgggggtggccaagaaagtccagccgaacttgtcgggaaccgaccaacgtgagcaacgca

SEQ ID NO: 559246 - DNA, 260 bp, Homo sapiens
gagctctcgttctgaaagcccatgaaggcacaccccagcagcaccgtcagtgccagccagatcttcaacacgccgcgggggcctttcttcaaggcgtggtgagcgatggtcacggtgacgctggaactgaccagcaggatggtattgagcagcggcaggccccaggggctgatggtgcccttgggcggcggaaagagtttcgggtcggggttgttgagcagcggccagacgaattcgaagttcggcgggtcccgagctcg

SEQ ID NO: 559247 - DNA, 739 bp, Homo sapiens
  misc_feature (389)..(389): n is a, c, g, or t
ggagagagcaatgtcccagtgtcatgacagattgggagagaggcagagcgtcaatgcatataacttgcctagacgctgataagaaggcagctctctcacgcgactgtccagcgtatgatggtggaaatctgtgtgtaagctgtgacaaccgtctatgcgcaacagatcatgatagcgagccttggcttgcgtagtactaccacagtggcactgaagacgctgggacatgccagatgtcgtcctagtgtacttcggacggaaccgttccgtaggacgccactgagtagacaacatcaccatcagaccagacttcgtagtcgaggagactttgtttacctacacgtacaggggccctttcgctcaactgtggtatcaaaacttattgcctnaacacgcaaagtattgtgctcgtcggctgtacatacagatagggcagctacgactacgagagcaaaccaccatacataggtcgattgtctactgacgtctattgtggacggcaatgtgtagagtactacccgagaggcatacatgcccagcgtcagattatcctcggatccactgagaggtatcatcgcacaacaactccttcgccagtgggtttggactttgcaatgaagacggcgcattgcacaatcaatgtgcgtaccgtcgtcgcccattgtctcataaccaagcggatcgccccgttgcaaggattgtgctccgtaggggacaacattgccaggagtattgaaca

SEQ ID NO: 559248 - DNA, 113 bp, Homo sapiens
gcatatacacagcagactcaggagcaccatgtcggctttctgtatttgagacaggtctccttaagttgcccaggatgctcctgaactctagggctcaatgagaaaatatttgc

SEQ ID NO: 559249 - DNA, 935 bp, Homo sapiens
  misc_feature (307)..(307): n is a, c, g, or t
agttcccttgctgggaactctgcgcgatttttcatggacaacttttccatccggataaggccgtttactcccctccgtttacacaaccttgctctccacagtatcggtaaatatggtctgggaacatgagttcccaaaactattgggccccttatcccccgatgctattgcacaacaaacctgtgtgtgccgcacaaagacaattaaagatgttcttccctgagacttcccttaagaagtttctcttggaagactctcttagtgcacacccatgcccaacccgtggccccccaaattaactgtgggncaccacgttacaggccggtataaccgcaaggttggcccagagcttgttaaaaacttcgtgttgaatttacaatcccttaaagagatttggtccttttccacgcctgttccgcagaaacgaggattattgttgtcccccacatcccttacaatcaagtgcgtacatcatagtcacaccagcccctgtaacacccgggcgtctatcttttcatgaaaccataaatatacatctgtgaacgagggggtgtaccctctgctgaagaaaaaacctcgctgcgattctgttgacaccacaacccccctcccattgtttgggatacactgtcccctataaattcggtgttccgacagccggtttcctcactatacatgatcccgttccaatgcatgcacccgtagtccgatcgcacttgcttaagagatatcccccgttctctaacggagatcgtcatttattctggcggacgtatatattgtttttgcctcactggttttttatagacactcaaaagatggtcttgtcatgaaaacatcccaggggcgagaattaggcgtagaaaataaaatccttttagagcaacataatcttttaaaaagacaaattaaaaacaccttttttgcccaaaaca

SEQ ID NO: 559250 - DNA, 443 bp, Homo sapiens
tgtgtgtgaaaaaaaacaaccccggagaaaaggggggggggggaaaaaagaaaaaaaaaagggaccagggacaaaagttctcccccccccccctttttttgaaaagggggagaaaccagggggtgcgcccctcactagaggggaggcgttttcatttcagatgaacaacacgaggaacactcctgcttaaaataacaccccagaaaccactccacagaagcactcggcaccatgaggacaagaaaagttagcaatatatcaaaaaatcgaacaacatctacgaggaaataaaaggacacatagtataaacatagtacactaacaatacaaagaaaataaacaagacaatgagaagcacaagagaagacacaatcaatcagcaatggtacatacagaaaaacatgaccacactgaaagatcatcaagcccaacaaagtaaccaa

SEQ ID NO: 559251 - DNA, 238 bp, Homo sapiens
cagagtgagaccctgtctcaaaaaaaaaaaattagccgggcatggtggcgggaacctgtaatcccagatactcaggaggctgaggcaggagaattgcttgagcccgggaggtggaggttacagtgagctgagattgcgccattgcactccagcgtggcgacagatcgagactctgtctcaaaagaagcagtggcgtcgtctgtggtttctgtgcgccctgtctgctgtgtgtgaactt

SEQ ID NO: 559252 - DNA, 302 bp, Homo sapiens
caagatgaaatgtctgcatgcaaagcaatggaacaccaaaaacattaaacacagatagataaggagtaaaagcaaatctaagacaaacaagttgactatcagagactatttcttaagacacaaccaggaacgcacatatattctgatataccataaactgacatgatatacatggataataccccaactctggataataactaaaataagctgcccttccaaaaatgtataggcataatgtaaaatcttacaaaagcaaaggtaagaccccactaaaagaggagaaatatagtctggtctgt

SEQ ID NO: 559253 - DNA, 1366 bp, Homo sapiens
tacatagcacccacagcctaattatatagcatcatcccgtctactattttttaaccaaatcaacaagaacctatttagctgttccccaaccttttcctccgacccccataacaacccccgtcctaatacgtaactaccgtgacgtccatacccctcacaagtcatggcaagccaagagccacttatccagtgaaccactatcacgaaaaaaactctaccgtctctatagctacatctcccctaacagaatcgtcgcgttaagtttatacagcagtgtgcacagcacgagccagcaacgtaactcgatagttgtacactatcctatgctgtcggaaacaccgacagcgtgtatgccgccagcctgtggccgtcatcaatccaccccagatgcacggacaaacgcaaggaccagacacacgcccgtgaaaaccgcaagggtcaggagtaaaattgcgcctatatgcttaacagcccctgaggttagggatacacccttgccacccctaaaatacaaattctgcaacctaacatgtataccaccgtgccagcacaacaccacgctaggccatcagcatgaagaacacttgctagcttcacattccagtttcctcgacacgtgggccccagacgaaaaagccgcaacccaaaacctacgcctgacggcacccaacaaccaccatgaaccgtcactgaccgtaagcctagaagcagccacacgcaaggcaaaagaaacaaagggtacacaacgcacataccgcaaccgccacaccgagagacgtgccaacgatcagcagaacccccaccataacgggcccccaaggtacggaacaggacgccccacaatcggactcggggcacacaacagacgatcaaccgcagacacagaccagaaacctccatggcaacacacatagggacggggacgtacatgggaaagaaaagtaacgggagcagagcaccaacaataccagtaacatccaaacaacaccccgatagaaccaacaaagcaacaaataaagacgggagacacgccacatcaacgcaatcggcaacaatacagtatcaccgcatagattgagaaggggcaactcacagctgaaggataacgaccagaggagccaccagaacaatgggcgcacgtcaagcacaccgacagcagcccacaggagcgcgttaacacacaatagcgaggagaacacgtaggcgcacggaacgaccaccataccgagacccacgaaccagcaacagcagagagagacgagagagataccgtagaccaagcgaccagaattccgacacagagcacgaacacacagaaccacgggaacagcgacaacagacacagggaaggacagatcacaatcga

SEQ ID NO: 559254 - DNA, 314 bp, Homo sapiens
tgcatcacctagggtcgtttgcaggtggtaaggccatttaccaagatagttgtaggtaaagaagggcagatttattagagaaattgtgaaaatatgtagcagtgggcagctcagctagagaaggggctacctgcaagggaggcaagggctggaggaaagttttatagggtcctgctgaagggtgctacgtgtggaatgaggtcattgtgcccgcaggtggtttgtgattagctgtctctaacaattgttcatacaataattgttcattattgttctcaacttggggctctccccaacctggggacccttcctta

SEQ ID NO: 559255 - DNA, 222 bp, Homo sapiens
gtcgacggcgtttccgagcgcccagcgtatggtctgtgcatgcgcatccacggggggaagggttcaaggagtgcatcatctgcgcgttcgccgaggggctgcgcagtcgtccgttgaccactttcggcaacgtgaagaccgatgtgctgaaggacaaggatgcgacgttcaagccgatgaattttgtcgaggtgattcggcgttcgcttgggctgaataaac

SEQ ID NO: 559256 - DNA, 379 bp, Homo sapiens
  misc_feature (98)..(99): n is a, c, g, or t
  misc_feature (104)..(104): n is a, c, g, or t
  misc_feature (106)..(107): n is a, c, g, or t
  misc_feature (113)..(114): n is a, c, g, or t
  misc_feature (117)..(117): n is a, c, g, or t
  misc_feature (121)..(121): n is a, c, g, or t
  misc_feature (124)..(124): n is a, c, g, or t
  misc_feature (136)..(136): n is a, c, g, or t
  misc_feature (140)..(141): n is a, c, g, or t
  misc_feature (146)..(146): n is a, c, g, or t
  misc_feature (159)..(159): n is a, c, g, or t
  misc_feature (168)..(170): n is a, c, g, or t
  misc_feature (172)..(173): n is a, c, g, or t
  misc_feature (214)..(214): n is a, c, g, or t
  misc_feature (222)..(223): n is a, c, g, or t
  misc_feature (225)..(225): n is a, c, g, or t
  misc_feature (227)..(228): n is a, c, g, or t
  misc_feature (230)..(232): n is a, c, g, or t
agacagtctcactctcttgaccaggctggagtgcagtggtgtggtcttggttcactgcgacctctgcctcctgggttcaagtgattctcatgcctcannctccnanntagctnngantgcnggnttacaccaccangccnngcaanttttgtgtttttngtagagacnnngnntcaccatgttggccaggctggtctcgaactcctgacctcangtgatccnncngnntnnncctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgcca

SEQ ID NO: 559257 - DNA, 124 bp, Homo sapiens
ctgagtgatgctcagcctctctggggtgtctgtcttcaacaggaggcggatgagctgcttggcatcctcagagactttgaccactcaggattgtggaagccgtactggctcaggctaatcctac

SEQ ID NO: 559258 - DNA, 633 bp, Homo sapiens
  misc_feature (154)..(154): n is a, c, g, or t
  misc_feature (457)..(457): n is a, c, g, or t
acaacaaccaaaaaaaaaaaaaaaaaaacaaaaacggattacaattttaaacggaattactttctaaattaatgttggggctaaatttgggcgttttcttacaaccttaattccacgcaggcaggcaggttaattaccccatttagatacgaangatttggagtacacctatttttcccacaaggaaaggtcatttttaaaacaccttctaccaggttgggatagggtgaaattagggtaaattaaccctatttgggctccttgggtaccttaattcctagatagattggacctggtaactacgggtccatttacaattattggttatattccccttattctcagggtttcttggcccaatagagtggctcattttttaagataattaacgcttgaaaaagggtaggggtataacctcctttcacattatttgggggaatatttcctcagaattggntcattttttcttcccacttaggaaaacctttccatttaacaatatgtggaatcgtggtctccgggggttacatttggctgggggaccagggaactctcaccaattttcccacatttatttttcaccatatccgtggataatctaatgggtcacaaattttggcttttaacaaactc

SEQ ID NO: 559259 - DNA, 295 bp, Homo sapiens
cccctttgtctgtaatgacaatcagaaggaagataacttttcttattatagttgactattataaagtgcagattatggaatgtcaattcagttatagttttttttcttttggaaacaggtttttgctcttgtgccccaggctggagtgcaggggcataatctcgggtcattgcaacctccgcctcctgagttcaaacaactctcctgcctcagcctcccgagtagctgggatacacaggtgcccaccaccacacctggctaattttggtatttcaagtagagacaaagggaaaca

SEQ ID NO: 559260 - DNA, 880 bp, Homo sapiens
ggtcattaccccaaaagacacaatcccaaaagccactatccggaatgtcaaaatcctgaaagatcaacatccctaaagtctaaaatccctaacatctaattgaatccctaaaccataatgacagatttggaattcggctcaatcaaggcttctaaaagcacatttcaagtgttagcaaataaaggttgtttttttccattcagcccaaatgcatttggcaaaaaaaaaaaaaaacattccagaatgagtgtggttgggccaggcagtagtggttagttgacaaaacctctcgatttaaaacctgctttatttggccgtgccccggcattttcttcccagcgtgagtgaaattccttaggagagcccagtgtttcctaagggataagaaagcacttatccgtggaaatgagagcactccaaagatagtcatggatcgtgaaagccgggccagccttttcgggaccatctcgtgcaatggctctaatctatccctgaatagatccctttaatacacttggtcatctgtggaatcctttaagttaagttctctcgtggtcgtcgtcgtttccccatctgtcaacacttttctcttttgtggagacgagtctcttctgtccacccaggctggagtgccgggggtgcgacctccggtcccattggacctctgcctcccaggttcaggcattctcctgcctcagctcctatagttgggcttacggccccgcattgtgggtaatcgcttcagacagcaggtcccgttgcaggccgctaatctgactagtacgcctggcccagtgtggtaggtggcccccgcctgttatacggttggtctgtcctcgctatgggaactggcggagacgcgtcccagcggacaaacttg

SEQ ID NO: 559261 - DNA, 134 bp, Homo sapiens
ttgtgggtgtgtatatatctgatttgggaagaatttaaaacaacacatagctttttaatttgtttgaaacagactattctgcctgttacatttttgcttttaaccaattaaagaagccacatggcatttaggta

SEQ ID NO: 559262 - DNA, 747 bp, Homo sapiens
ataagacatatagtagtaggccgggcgcggtgtttcaccctccaatcccagcactttgagcgaggctgaggcgggtggataactgaggtatgtgtaaaatcggcctcttatctattataaccctgaggtcagtgagcataaccaaggattaattgtcaacttattttcactccaccttcgtaacattaaaattctggacgttcgaccttaaaaaaggcatttccaaagatgaatacatgaacacaccatacttctcaaaggacaacaaactacaactggttgtttagaagtgataatgtcctttatggttcccgaaccctctaaaattatgtgtaggggcaggctcatgtggggcttggcgacatgggtctcagaagaggcccataggcccaatagctttcataagattctctgagggttcctgtccgctgggtttgccaagtttcttactatatgatgtcctctttcccagaataatctcttggggaaaagacattgtacagttgtggaagagcccccttgcgcaaaacagttgttctctagcctaaaatccatccattaaggaaagtattcttaaaaaatggtggccaagggggtgcccaggctgggatccctaacatggacgaggggctcccaaaacgactgcagatcagctgaacggcgtgtacaatttaaaaccatgcggaggtgacaaaaaagaagacaaaaacggaagaaaaaaaaagagaaaaaacaaacaaacaacgg

SEQ ID NO: 559263 - DNA, 141 bp, Homo sapiens
acgcgcaggtctaccgacctgaactggatgaaacctgtctgtttaatacctggggcgcgggttacaaaatcaataatctctacgacggcaccttcgtgctggatgaacattttcgtccgctgtggggggcgtttcgcagcg

SEQ ID NO: 559264 - DNA, 604 bp, Homo sapiens
  misc_feature (1)..(1): n is a, c, g, or t
  misc_feature (114)..(114): n is a, c, g, or t
ngatgcagttcgcaaatgtacgatatgcggcccggcgcatgtgagtacaataaagtcggtctcatcaagcttatggtcagaaaacgtcactcatataaggcctgggctgtaatnatggtcctggtcttgatgtgggctgtaaggaccatcaatccgtgggatagactgggtttcatacatctccagaagacatgatgtaagagatagcagcgaactggtctgactctcgtatattgtgcacttctcatcaggcgcctagccaacggtggagggctgatctactgacatggcgttgctggttgccacgtgctggttctataacccaattagcttctctgattaccagcgatgtactaagcctgctggtttcatcagggcagcaatgaacgtaatcatgaggtaacattgtctagatgtagttcacacatcatgtgcagataactaagtgtatgtacccggtccaaagactagcatttcgcctgcataatctcaagtagcatttcccggttctgttgcgcagatattatctatgaacccatttgcacgaggagtaaccgatctcagctactctccaagtgagagagtgatggaacctgcatctagg

SEQ ID NO: 559265 - DNA, 157 bp, Homo sapiens
aagaaagacggaagggcttgactgtaatttcctcgattttttgttacgtggatttatttgccaagagctggttaaatactttttgaagaatttactttgatgtaggtcccctcactctaaatattcattaatttagtatgagtggaccgtaactcaa

SEQ ID NO: 559266 - DNA, 106 bp, Homo sapiens
ggccgaactgggcaaggtcattaatgatgggctcttctactatgagcaggcactgttggctgaaaagtttgaacctgagtattcccagatcaagccagaagtcgaa

SEQ ID NO: 559267 - DNA, 597 bp, Homo sapiens
  misc_feature (74)..(74): n is a, c, g, or t
  misc_feature (379)..(379): n is a, c, g, or t
ttgggtttcccttccccctttcggggggggagagggggggggagtgggggggacccctgggggcctggggcccntggcccccccgggtttttatgccccccgcgagggttttttttttggggtccggggaacacccccccccgggaaaagacccctttcccaccgtttgtgcccctttgggccggcggttttgtgggtgcctcccctttcccccccccggaggggggaggggtttgccccccccacccccccccccccaatggtgggttttgttcccccttttttcccaaaatcccccgggtggggggggtggttttggggggggaaaaaaaacccccccccccccccggggggggggggggccgcccccccctttttnttttttttttttttttttttaaagggggccggccggggcccccggggggtggggggtaacccttttttaaagggggggggcccctccccccgggaaaaatttcccccccccggggccgggccccttttgggccctttttggggggggggggttttttcttttttcccccctttttccccggggggtcccccctttttttttggttttttttttgttca

SEQ ID NO: 559268 - DNA, 508 bp, Homo sapiens
  misc_feature (364)..(364): n is a, c, g, or t
tggcgtattgttttgttaacgaatctggaatgcagaggcaccatgtaggtttagtggaacctgtgcctacggggactgagcgattcttctgcctcagtcttccgagtaggtgggactacgagctcatgccaccatggcctgttcattctttgagagtggagaagcgacagcaaatgagagtgttaaccacgatagccttgcattacagacctcatgacacatctgacttgttctacctaggctatgataatacaggtgtgagtcagaccacccagccaatccttatgtttagaatgttaaccttatatgtaaaacgtacatttggcaatgtgtatctaagacagtggctacattaaactgctgngtaggaggattatggaagagtgtgacccattactgagatgccgagcatacaaacggctgtctccgacttttctgtccgaatgtaacactcaatgccaccatcgctattttggagagagaaaacacacattctgcctttatgcta

SEQ ID NO: 559269 - DNA, 210 bp, Homo sapiens
tgcaactgtgcaagacaggctggttgccgggcgccgcgtcggaacatctggggccagcaggcccagactgtatccatccaagttcccgtgtagtccagaggtcgttagagctggtgtcataaagggtaattccccaatcccttccttatgagcatgtatagaacatgggctaggactatgtgccgcccagtagcgctttgatctggattc

SEQ ID NO: 559270 - DNA, 172 bp, Homo sapiens
tggactgtatatgtataagctctcaaatccttcccaacaattcaacacacacacacacacacacacacaccactaacaaatgcaagttggtaaataaacttataaatgaggcataacaaacaccttgtatatatatatatatatctaaggtgttgttgttattgggtgatcc

SEQ ID NO: 559271 - DNA, 82 bp, Homo sapiens
ggagacagagttgctctgtcgcacaggctgagattgggccattgcactctagccttggtaacaagagcgagactctgtctca

SEQ ID NO: 559272 - DNA, 165 bp, Homo sapiens
tctgcaggatccttaatatgctgtctcattccagcgtggtagcatgacttcttcatgatccttagggtgagaagctatggtgtccttgtaaggcagactttccgataacgtcgtcccggctgagggcattcttcattccaattgaccgttagaaaaggcaccagc

SEQ ID NO: 559273 - DNA, 115 bp, Homo sapiens
aatggcagccattagccaggtaatagccctctgggtactcaagtgaggcagccgtgaattgagatgtgctatgaaagtccaatacacctgctattgaaacttctaaaactagggc

SEQ ID NO: 559274 - DNA, 390 bp, Homo sapiens
ttagtttttgagtctggctctgtcacccaggctggagtgcagtggcgtgatctgcaacctctgccccccgggttcaagcgattctcctgcctcagcctcccgagtagctgagattacaggtgcgcgccaccacacttgggtaatatttgtattattagtagagacggggtctcagcatgttggctaggccggtctctcctgacctcagggtgatcagcccacctcggctcacaaagtgctgggattacatgggcgtgagcccatcttgcccagcccacatcatacagtttttgaaatgaaactttgccacaaccagcctttgtgtagcacacacatatatcactgaacctggtttgaaagaataacgttctttttccttttttcataaaa

SEQ ID NO: 559275 - DNA, 404 bp, Homo sapiens
tagagatagcccccagctggaacaagtacaaaggcttacaaagccttacctcttgcaagtagggataggtttactcaattcttgtaggaagctgcatcataccctgtattcatggatcggtgcagagacttatagaaatagctctcaccaaaagctttaattctccgcctaccttactcagatgaactcctacttttagaaaaccaagcggggacagcagagtcgagacatgttaaagagtcagaagaggaagaattatgaaaatcaagagggggaagtagtacggaaagcattgagttcctcttcaaagatccattgtcctctatttgcgaagcctatcttccttgccttcttgcccctagttgtggtacaaattgtccagcccttcccattctgtaatccaa

SEQ ID NO: 559276 - DNA, 399 bp, Homo sapiens
  misc_feature (114)..(114): n is a, c, g, or t
  misc_feature (126)..(127): n is a, c, g, or t
tttggctctcaatatgggccacgggggggggggggggccccctttggggccccccccgggttttttctaggggggtttttgggggggggtttttaagggtttttcccccgggcngccctttttccnngcccccccttgggtttgggggccccccccttttggaaggggggggcttttaaaacccccccccgggggcccccctggggtccgggttttgtttggggaaggggggggggcggggttcccaaggggggggcccgtttttttaaaaggggccggggggcccctttttttcgggggggggcccccctttttgggttccccctccccctttgggggtccccccccctggccccccctttttgttttgttttaagccctttttttggccccgttcca

SEQ ID NO: 559277 - DNA, 233 bp, Homo sapiens
gatagatcgagcttgtaccggtgagcggtgacaaccgggagggagcgtgatttacagcgccgacgtctgccctgcacggcgatgacctgattgaaaaccgggccagctttatcgaagcggacggtgacgccaccgtggaagcgcgtcgcctgaacaacctgcgcgaagggctggtgattgagcgtaacgccgagaagagcgactacaaatggcaccgctacaactactactgg

SEQ ID NO: 559278 - DNA, 242 bp, Homo sapiens
actctacaggatctcgctgatccgcttacgcaggtataaaatcttccacatgcttcagtcctgttgtgtgggcagacatctgacaccattaatgacagccatcaagaagtatccaggtacttcacagttctgtcgaagcatttccattgtgatggcgcggtcgcgctcttgccccggggaggaaacgcgtcgggcatgacgtcatcatacgcgacaacaccgattggccaaaccttgtcctg

SEQ ID NO: 559279 - DNA, 93 bp, Homo sapiens
ggcccccccccccccccccttttgggggggggccaaggggtttcccctgggtttttgggaaaaaaaaaaaaaaaaagggggcctttcccccca

SEQ ID NO: 559280 - DNA, 521 bp, Homo sapiens
ctgaatacttactagtccctcaaatattagctaggccaatacctatacttaagtgacatatatcacaactcaaaatcacctagttaaagaccttccctagcctagtcctaataaaaatcagatcccccgacattctctgtctacctcaccctagcttcatattcctcactgacccttaccgctatagtatattatattcatatgatatatttctaattatgacctgattccattcactgaaatgacaatcccgacaagaacaggaatatttgatctgattttacttcccgaggaatatctagggttgccaattttagcaaatacaaatacaggaatacccaattaaatttgaatttcagacaatgaatgctatctcttagtagacagacgtatgtccaaaatagtatgtgggacagacataaactaagaagttattcattgtttacctgagattcaaatttaagtggacatcctgtatttatatctggcaaccccagctgtatccccagatcctagactgg

SEQ ID NO: 559281 - DNA, 177 bp, Homo sapiens
aaggttccggccccccttttttgggggggggggggggggggggggggggggggggtttttttgtgccagggggcccccccccgggggccggttcccctttttttttttcccccggggggtttgccggcccccccccttccgggggggggggggtttttaagggaattttccttttta

SEQ ID NO: 559282 - DNA, 608 bp, Homo sapiens
  misc_feature (333)..(333): n is a, c, g, or t
ttcccacctcccgggaatttgttgaatcttttttctgtgaaagccaggttctgtctccctcacgcctggttaattcccttctgctccttaactgtcatcgcatggggttaatgagaggaggagagaaaacgtctgtggtttcgttttccttcctggatttcgacaatgtggatgcgtccttgggggaaaggtgggctcgggatccaggcatagaccgtgcgggggcctctccaggagccagtgtgggggagtccagcgcagcagggccagggccaggtggggcagagtgaagacaccagggcaccgcggggccagtgagtttgttgcctcagntgagacaaagtctcagcaaatcatcagtgttcctcttctgtgaggtctttccacgcaccaggccagggtgtcatcaccagacccctccggtgctgaaggatctccccggaaaatagatattaattgcttttcaatcaatgtattccatgtgtatcaatatattccacatgtatcaatatattccacgtgtatcaatatattccacgtgtatcaatatattccacgtgtatcaatgcattccacgtgtatcaatgcattccccgtgtatcaatgca

SEQ ID NO: 559283 - DNA, 313 bp, Homo sapiens
tgggaagctgtggctggacgcctaccttcacaaatgaagccacagcccccgggacaccgtggggaaggggtgcaggtggggtgatggccagaggaatgatgggcttgtgttctgaggggtgtccaaaaggctggtgtatgcgctgctcacggaccccatgttggatatttctacctatcgtcctcgcgtttatctcttcacatctcccacatagcaccgtgccctgatgggacctgagctgcctcatgcgtcagccatcagccatggtacctgcagagcctgctagcaacttcttacaaggagcacagaggag

SEQ ID NO: 559284 - DNA, 866 bp, Homo sapiens
  misc_feature (12)..(12): n is a, c, g, or t
  misc_feature (835)..(835): n is a, c, g, or t
acacctcccagnaacggcggaacatctctgagcacaatcacgccatttctcttgaaacgacgttttccgcaataccctgcactgggggagatctcgaaagggcgcatttacaccacggcgacggacgtcccagacgccaccagaagaaccggaccggacaacgcgcaaacaccgacaaacgcccgaacggcgacatcaccaacagacgaacggcccccgaggcacggcgcctcaccgacaggaagaacggctccagcagcgatcaccccgtgaccatcgcgagagccaccagagaacataccagaaaccccgcgacatcgcaacctaaagcccacggagccatccagcagcaccagcaggaaacccaggagagcacgtaccacccgactgccacaccggaacgcggacaaaccagcacctcgactggctgcgcaaccaggaacacgcagcacggccaatctaacaagccgagaggcccacggaaagaacgatgccagcgagaaagagcatcgacatggcccacctggacccaacggaccacacaacaaccctcgacacggaaccacctcaaaccaccaacgcaggcgcaccctcacaccatcaaacgacaccacacacccactcacaaatgatccacacaatgccgcactacccacacaactcctactatcacacacacgctaataacaattacagcagccacaaaggcgaacgccggcaactacacttctcacggacgcggaacccgcacgtacatacacatcacacaccgctcacaacaacaaaggccacacagcatgcaccatccatacaccgacgccacaacaagcacacngatgcgctgaactacgcccaccgacatcgcc

SEQ ID NO: 559285 - DNA, 113 bp, Homo sapiens
gggcagctagttgtgccagtcttccagcagcaggcaacacagcaacagtggcagcccccaacagctgtgggggttcaagtccagcagggcattcaacctcactggcatccacc

SEQ ID NO: 559286 - DNA, 912 bp, Homo sapiens
cccagagctgaaatagtccttgcgctaatccttacgccccgtggcaccgctttccggcatagttaatcgtggagcgttttaccgatgttcggctgcttttcgcgcgagatttccatgtgtcgacgacgatatagtctcccgtggccccacgcacgtgtgtgggccctccccccctgtggggggatcccgacacaactgtgggcgcatgattacttggctgagccagacagaggactgtaaaagttttgggttacaacaccgaggcgtttctccctcgggtgtttacccgccaaaattttctacgggggtttcaaccccttgcatgatgtttcgccgggtttgtccgttggcaacttgcgcggccccctgtttccaaagatggggcccccacggagggattcatcctcctaggggctttttactgcccgttggcgaccaaaactgcggtctttgaacgccgtgcggtttcattcccccggcacctaagcccgctgttatcaaaacccgtgcttatcgctagtacaggcccgataggctgtcggttccttaggccccacagagcttccacactccgcgggtaaataaactgcatcaccctcacaccccccttgttggttttgcattttcattttaatggggtcttaaacataaaagacgccaccccttctgccagttcacacccacgttgctctctaaggccactttaccctggcacccacaatttttcaaaaaatgctggcctgtatcaccatcggtttttttcattattagggttacaaaacccaccgttttcaccatcagttcagcccacacacgccctggataatataacttttttgggaaaatccatctttcttaggagaatttttttccaaatttcccaaaaaatttcttctttcaaactttcataac

SEQ ID NO: 559287 - DNA, 377 bp, Homo sapiens
ccaaggtgaggaccattgttatggccggacttggatggaattggacagcctgggtaaaatgttcgtccgaagctttgcctggcaaacccgatgtggttgaaatcgagaaattgactaggttcaaatggaggaagaccgagacgtaagggaaaaatccactgcctttcaaagaaccgtgggaacaggtgaaggatgcagggaagtcgaaaagaggggtgacctgccattgtgaattgtagattgaaaacggatggcttaatgatttaactccttttagttgttaaactttgtttgatgcatactgcctctgaaggccctagcctgcctttgcaatctgcccatctactagggtgactgggaaggaatgacttgactgc

SEQ ID NO: 559288 - DNA, 440 bp, Homo sapiens
ctctcctcagcagcgatggtgcatgctttcagcagtacagggcggtcaggtagaaatagtcaagttcttgctgtgcgtgaaaacttatgtggccctttcaatatttgaactgctatacgatgacatctataattttgtcatttttaaatctcatacaaataaatatactttgatatgtaaatatgcattaggttatgctattatttatatctatcttaagatttaaattgtaggtgtgtcatggaaataatttaaaggcactctgttcacattgcctgtgttcatgctttctaaggtttatattacatcagatgtatatttttggtttggcataagctactgttgtaattttcttggctttttgttcataaagaattttctgaaggaatggtaacctttcaaggattgtgaataaacatttttacaattaaaaaaaaaaa

SEQ ID NO: 559289 - DNA, 191 bp, Homo sapiens
aacgataggaggctgagatggattcatcaggtaggatgtaacctttaaagaacagatgattccaatattatttaagtttgtcatgaaaaaaaatttttatttaggagacaggtctagcgcggacacccaggcaagaatacagaggtacgatcacgggttacggcagccttgacctcccaagctcaagtgat

SEQ ID NO: 559290 - DNA, 186 bp, Homo sapiens
tcttcaacaagttgacagtacgcggtagggcaggcgggtggtatacagggactcgggaccacgacgcggggttcttactactaacactgacggcacgcgggacgactacccctgaaacgacgggacggtgagggacggcgtgacgtacgacgacgacacacaacgacgacgcggacgacgacacga

SEQ ID NO: 559291 - DNA, 373 bp, Homo sapiens
acgatctatgctctggtatacatgtctgaatgttggaagagggtttggatgccattcgtgacctgggaaagtcctttaccgtgtggcctctgctctctcatttgttccaccacctgtgacagccttggtgtgtacccatgcagggaattcctgccattccctgatccctgttgcattgttacctacaaatccgcctctctcttcccaggtgtcgtcatctggggcattaaaaaaacacaggtgttgttatctcacccccagactaatgggatcaaaataaggagttgggggattggagtgaagaggtgggggcattggtcaaggattgatacttctgagaatgctcccaggttataagttgccagtattgaga

SEQ ID NO: 559292 - DNA, 370 bp, Homo sapiens
ccgaggcaggcagatcacctgaggtcgggagttcagggccagcctgaccagcatggagagaccctatctctactggaaatgcaaaattagccaggcgtcatggcacatgcctgtagtcccagctgctcgggaggcagaggcaggagaatcccttgaacctgggaggtggaggttgtggagagctgggatcgtgccattgcactccagcctgggcaacaagagcgaaactctgtttcaaaaaaaaaaaggaaagaaaggaatttgggaacaccttctatctgccagcgtgaaagctactcaattttgcagaattaaacatgtaagagaaatcaaagtcttgctcccaaaagaacgtttcagaagttgtttt

SEQ ID NO: 559293 - DNA, 1034 bp, Homo sapiens
gggaaggtgagtggtagagagggggtctctgaaggcccttggggctgacagggccagtggagactctgccagctgattgcatcattcctgaggccagagtcgtgtcagcaagggacagtagccagagctcctcttcctttaccaggcgaagggtgcatccccatcatgaccttcctgtgccgcttcagtatcttgtgtgccgatcgtgggcacagggtgcaaggcttgggcggtttgtgagtcacatgcagtgctatcaagagtctggaacgctcgagtccctggacaggagtgaggaaagccaaggcatggatgcatgttcccagaagtcgaagtctagaatctcatcgtgtcatccggagtctgatccatttgcgtctgaagagtatatctcatatcagggctctggacaagatcatgatctgttgcacgttaagacttcgcatctctcgctggaacctctagaccactttagtatacgtatgagtacataatacacatagactaacggcgtaggcattaagctacctacgctcctcagattgtagccctgaataccctagagacgccacagggctattaacaagcctggatgactactagattgccacatacagatgaaaagcggggtagggctagagtaccctaaacctacagcagggacgtaccagtacactgataggtctgatgcgattgtgcggcataccattacgtcacggcaagctatcatgttcttaaatggagaactataatttataactcactgttcgtagcataagagcatttgcattccaaaaggctttcgcataacccctccactacccctggtcgctcactaagaatccttggaacgcaagggttccataattcccctcaatttgggcacaatgaggaaacagaatcacacggacgtcaaagcgggccttgatccaagcgtacccacgctacagacaccacaaggccctaagcccagcagaagaacacagtcaactgggataatacagcaatcaatccaaaaagtgcacataatccga

SEQ ID NO: 559294 - DNA, 284 bp, Homo sapiens
ccggcagccatggagagtgtgaaccaggtagagtgagagccagggagagtgtgaaccagtgtagagtgggagtcagggagagtgtgaacctgggagagtgacagccatggagagtgtgaacctgggagtggctgcctgctagagtgactgccaatcagagtgtgaatcagctagagcgggaaccagtgagagtgtgaaccaggtagaatgggaaccagtgagagtgtgaaccagggagagtgagagccagggttaaggtctcccggagggttaaggtctcccgg

SEQ ID NO: 559295 - DNA, 80 bp, Homo sapiens
gtttctgtttctttcttcctttctttttctttctttctttccttctttcctctctttcttttctttctctttccctccct

SEQ ID NO: 559296 - DNA, 945 bp, Homo sapiens
atgagatgcgcactccatgtcgatcatgtacaggttcgccattgccatccgctcgagcaccagataccacgacccagcatgcgcatcctactacagtccgtccagtgccagatggcgaacggcggcgtgcagcaggcggcggtgatggctactcaggagagcacgaggttagtgcagccaagctacggcgtagtctgctcgcttctaggcagcgacacgggccgctgctagacctagctgagtagcgtccctgagctggagcgggtgctgaaggcgccgcgacggacgtcggaaggagaagtacaaagaagtggggagctccgatttgaaggtgatgaggaaaattggcaaatctgtaactgcagacagatgggaaaaatatttgatcaagatatgccaagagtataacagtacctgggcatgggagatggagaagaaggggtatcttgaaagtgagtgtagaatgcaactagcactcttaaagtactatgtgagtgtgagttagaagacactctcaaatcaagaatattattaagtgaggaggatgccgaactatgcagtccccaagccactctgggcgagacacagatggctcacgtacggtaccacaggatcaagatcacacgtccgaagtacatagacgaaccgatgacaaacggcctcaggacaggctgtagaagctcgacggtggctggagccgacgacgaagcaacgtggcagacctgaccaccgcggacagaactctgtcggacgcccgtaacgggcgagactagcggaagaacagtacagaggacgcagaggacaatcaggggaacgagctacaccggggccggtcacgccggacaccacgcgccagcaccggcccggcgcggaaggcaaggagcagcgcgacgacagacaacgacgcgagcaggccagcgcccaccgcagcctcaccgaaacacc

SEQ ID NO: 559297 - DNA, 891 bp, Homo sapiens
aaactggctcctgggggtaagcggtgggtactggactaaatacccatccggagtatgcgcgtcgcgtagcacatgaactggcagtcattacctgtgcaccgtttgttaccgcgaccgaacaaatttgaagcgctggcgacctgtgatagccctggcttcagcgcgcacggcgtcgttgaaagggttggctgcgtcactgatgaaaatcgccaatgatgtccgcttgtgctggccctcctggcccagcgctgcgggaattggtgaaatctcaatcccggaaaatgagccgggcagctcaatcatgccggggcaaagtgaacccaacacagtgtgaggcattaaccatgctctgctgtcaggtgatggggaacgacgtggcgatcaacactggggggcgcttccggataactttgaactgaacgtcttccgtccaatggtgatccacaatttcctgcaatcggtgcgcttgctaggcgcatggcatggaacagtcttaaacaaagcactgccgccagtgggtattgaaccgaatcgtgagcgaatcaatcaattactcaatgaatcgctgatgctggtgactgcgtcttaacacccacattggttaatgacaaagccgccgaggatcgccaaataaaagcgccatcaagacagggctgaccttcaaagctgcgggccttccgctggggtatcttagcgaagccgagttcgacagctgggtacggccaagaccagatggtcggcagtatgacagccgggcgttaatctggcgcgttacggttgccgcccgcgcactggtcccaccgaggcggctgccctgagggtcatcgcgggtggctgaccttggccggctcggattttgcagttcacaaagtccgggctcccgggccttta

SEQ ID NO: 559298 - DNA, 646 bp, Homo sapiens
  misc_feature (47)..(47): n is a, c, g, or t
  misc_feature (572)..(572): n is a, c, g, or t
  misc_feature (581)..(581): n is a, c, g, or t
  misc_feature (588)..(588): n is a, c, g, or t
  misc_feature (605)..(605): n is a, c, g, or t
  misc_feature (618)..(619): n is a, c, g, or t
  misc_feature (621)..(621): n is a, c, g, or t
ggttttcaggttcctgtgtcttcccgtgagtgctcgctccacggcanggaggactaggaatcaggagtcagggccgtatgctggaggctgagccggggagcgcggctcgcctcgcttgcggttgtggcagcgaagggagaataaggaggtgcggctgaagcgatgttgccagggtgtgtgccctggtggccaagtaaatcaccctccgttgtgtgacaaagcacccgttgaaccatgtgtgcacctgtcttacaggattggcccactttataaggcgcaagaagaaggcttggtgtgtgggttggtggggacgtcatcacagagaggtgtggcaggtggagagggtttggttattcaggaccacaaatcatttaacattcggttacccacagagggagtgtggaaaatttgcctgttgtggttggccccaacggctggtccttacaaaacttcgttgggaactcagtgggattccttccacatctgtgtgggcctccccagaaaggcagtgggttattaccccggggattggagccatgggcagttggagctccgtggtaaggtttaatttntaaaaacancttcaangagtcaagataattcanggggaaaagaccnntngcaagggttggtaacttggaagaaa

SEQ ID NO: 559299 - DNA, 588 bp, Homo sapiens
  misc_feature (47)..(47): n is a, c, g, or t
  misc_feature (514)..(514): n is a, c, g, or t
  misc_feature (523)..(523): n is a, c, g, or t
  misc_feature (530)..(530): n is a, c, g, or t
  misc_feature (547)..(547): n is a, c, g, or t
  misc_feature (560)..(561): n is a, c, g, or t
  misc_feature (563)..(563): n is a, c, g, or t
ggttttcaggttcctgtgtcttcccgtgagtgctcgctccacggcanggaggactaggaatcaggagtcagggccgtatgctggaggctgagccggggagcgcggctcgcctcgcttgcggttgtggcagcgacggagataggagtgcggctggagcgatgtgccaggtggtgccagtgccagctaatcacactccctgtttggcagcaccgtgaacactgtgcaccctgtgtcttcagatggcacttaaagcagagaaagcctgttggtgtggcctgtgggagtcatcacgagacggtggccagtggaaggttggttatcggacccaatcattcacatcgctacccaagagtgtgggaaacctttcccttgtgtgtgcccacgcctggttctcaaacctcctgtggactccatggggatccctcaccacctgtgggcctcccaaaaagcaagtgggtatttacatggcatgagcccaatgtgcacgtgaggatccgtggtaaggtttaatttntaaaaacancttcaangagtcaagataattcanggggaaaagaccnntngcaagggttggtaacttggaagaaa

SEQ ID NO: 559300 - DNA, 137 bp, Homo sapiens
gcgtcgaccaatcctcccaccttgtagctgggactgcagctcacagcacacctggctaaaatgttttggttgttgagacggattctctatgttgcccaggctggtctcaggctcctgggctcagatggtcctcctgc

SEQ ID NO: 559301 - DNA, 342 bp, Homo sapiens
taggaaccccccctcctttccatttttatttattaaatagagacaggggctcactatgttgtttgggctggtctcaaactcctgggctcaagggagtccttttgccttagcctcccaaagtgccgggattatgggtgtgagccaccaccactcctggctattggctacctctggcttttttttttttttttttggaaagggagtttcattttgggggccttggcgggcctggggtcgaaatgccaaattttttggccaattgaatactcaacctccgggattcagggatttctcttccctaaccccccgggggggggggtataacgggcccttcccaccaaa

SEQ ID NO: 559302 - DNA, 550 bp, Homo sapiens
  misc_feature (350)..(350): n is a, c, g, or t
  misc_feature (374)..(374): n is a, c, g, or t
  misc_feature (550)..(550): n is a, c, g, or t
gaaaatgagaaagaaagagagagagagaaagagaaagaaagggagaaagcatggtctgaagatgagagaaagaaagagagagagagagaacggaacggaacggaacggaacggacggaacggaacggaccggaacggaacggaacggaacggacaaaaaaaaaacaaaaaaaaaaaaaacaacaactttgtgcggcgccgccctgcgcgccccttaaaaaaaaaggtctttaaaaaaaccacttcgtgttgggggcgccgcggccccactagtttaatgatgacaaccgggtggcccaatgaggtggctcccaagagagaaaccagcgggccaagtgaaatttaggggcngcgttggttctcctccaaccacanatataaaaaaaaagccgcggggggggacaaaccggacggcgtctgtccgtgaacacaaacttcccagagaggagagtctcccgagggccaacacagagggcgatcctacaccaacacgaggctgttccaaaaggcgagcacccgattataaaataagaccccggggcgggggaagn

SEQ ID NO: 559303 - DNA, 398 bp, Homo sapiens
  misc_feature (19)..(19): n is a, c, g, or t
  misc_feature (51)..(51): n is a, c, g, or t
  misc_feature (53)..(53): n is a, c, g, or t
  misc_feature (310)..(310): n is a, c, g, or t
  misc_feature (318)..(318): n is a, c, g, or t
  misc_feature (330)..(330): n is a, c, g, or t
aaaccaaatataaaaaatnaaaagttaaaaacataaggcaacaaacacaananatgaatatgtaagcactacataaagcattgattttgttaaaaaagaaaaggtatttaggttccaaaagccagttttgactaagggagggcggaagtcacgaaggtgggggcaacacacagcagggacaccacaactagtagacacaggatttgtgcacaaacttgagagcttgcacaagtttcgcaaaggagacctagcttgcccaaagctgaaattctccaaaactggagcttgcagggaaatgacagtgggctgnaaattttngagtttaacttnccactcccaaaaaggcctgctatcccctcccactccccactccggccttccttggcttggctttttta

SEQ ID NO: 559304 - DNA, 192 bp, Homo sapiens
taatgttaattgtttttaaaacggggttttttttccttaaagcaatttttttcttttcgatttaatgaaggattgctagctgaagcccgtttgccatagaaagaggtcagattgttttgaaaggggggcagcctgatttaaaacccaaccctgaacccttttaaagaccaattaaacatttttttcccgcca

SEQ ID NO: 559305 - DNA, 343 bp, Homo sapiens
accactaacaacataaaatagaagtggtagggagatagactatgggaaagagaggtaagaatacagcctaaagaagaactactatacagtaaagaatagctagtaggtaaataaggtacaaagaaggagataacaggaataatggctaggtaacaacaaaatataaaacaggagtaacaagggaggcatagtagtacagggtagaaataatgaacgtagataccaggttacataatacactagcagctagtaaaaggcgcgaacctataaatagcactagtaagactatactactaacaaggtaggctatacctacaagagtaataaaagtaggcagcgtgaa

SEQ ID NO: 559306 - DNA, 408 bp, Homo sapiens
attcggcacaggcccaaaggagcatctcggaggagaccaagcagaagctgaagtcagccatcctttctgcccagtctgctgccaacgcgaggaaggagagcctatgccagccagccctggaggtcctggagacatcaccaggagtctcgctggagacagacagacgaggagagataatggacatttgaggggcatgagccacgcagcccaggggacagcaggctggaatgcccctgcaggaccctgggcaggaccagaggccacatggatgccactccccacacagcccccaggcctgcccagcccacctcctcatggcatcctccctgtacccaggtcaggctgtccacaccacatgggagcccagaggaggaggggcccgccttagccatgtgaaggtggattggt

SEQ ID NO: 559307 - DNA, 138 bp, Homo sapiens
aagcttcattcccctttttggtgtatcttctatccgctcctcacactgttccttcacccccgttcacctgagttgaaaactaacgaccagagacatgcagaccatgttcaagaccctgtcgagaggatattagcggca

SEQ ID NO: 559308 - DNA, 1258 bp, Homo sapiens
caagaggaacaaatggaaactgagcagcagaataaagatgaaggaaagaagccagaagttaagaaagtggagaagacagcgagaaacatcaatggattctcgacttcaaaggatacatgctgagattacacacaattcactcacaacattgcatcacatcttgatgtgaacagcatgccattgaggccttggcatgaacttgcttcacttccaggtcacaatgccaaccaagctccagcaaaccacacagcagcatgcattcactaccactgcacacacaaataccggcgcattcacaagttcagtcaaggtaatccatggcacacacagtctaccaatgttgtatcaaccacagtttcaagcacacatgttcttggttggtgaaggagattccgtgcatcacccaagtgctgacatcacatctcttgctgaacaaagacagcatgcaggcaagcgcaataaaaccacaagatcaagggcacacgcaacagggccaaaccaaaaagctcagaagaaggcaacaaaccagggtccacagacttctacaatggcaggcatctgcatgctccaacgatggtcaatcagccacaaccataaccggggagcagcaaatgaaaagaacagcaaagacacacatgcaagccagcacgaagaaaaagccatccagtgaagagagagagactgaaatattctctgaaagggattctacactagattaataggttggcattacttggaatatacgagaaaccactaggacacagtcggcacgggggtttcccattcgcacactcaagcaccggtcggaacacctacaacactctcgtcctcagcactagcgctccggactgtactacaccctcgctctgcaccggacacacctccccttggctctcacacgtcacgcacaacacttctcgccaacggcttcttgtccacgtgatttaacacagcacactaatatacagctacacgtgtgagcacatacacgccagtgttaagcaaaaggtctacactgcgacctatcacacaacgtgtcgcgacacccatttttaatactacgccgagtccaaactaaacatcgtctccctacgaatcacaccaacagccaactcacaacggtgatcgatgctaaatgaaaccacacttctcacaacatacgacgtaccagccaatactaacaacaacacccacaatgcaacctagacaaaacaagaagagatgataaaccaaaccgtcacgcaaaatcgacatcaca

SEQ ID NO: 559309 - DNA, 760 bp, Homo sapiens
cacgtagtacgtcgtagctcacttgcactatgtcctatcaagtaggagctgtattcgcatgcataggaaggctgtcatttcactgattgtccgctattctcaggcgtagaccctaggacaaactacgccaagaatccatttcagcgtagtcatattcagtcggcgtaaaatctaacgtttcgttcccacaacagattgctcggcctatccggaatgccccgaaagttactcggactacccgatgtgatacaccagatggagtacgatcctatctatctgtaggcgtcattcatttctctaacagcagtagtgattaataatgttgatgattagagaagccttcgcttctgaagcgaaacagtcctaataagtagaagaacccatccataaacctggagggactatatggatgcgccccatcctatcagacattcgcactgaacccgtgatagcataagcagttctagaccgaagcaagcaacaaagcaaccgcagcaccatcagaaactctgagggagcaagtcctctgcccccagcaggaagcattcagaaacacccaactgtcgaggagccaaagcacccaataagatggacatcaccttggttgaccgcaggtaccgagagagcacgaggaaccaagacaggaggcagtcaatcaccgacactacagacgacagggagccgaacgatgagagacacgacaacacagccggggcagcgaccgaggacaacgcgagatccacgaccgtcaagcaattgc

SEQ ID NO: 559310 - DNA, 103 bp, Homo sapiens
atttggagccacatgctgccattcggataatcatccaatagttggatgatcttaaggaagtagttggacttccaggtcgccctgtcttcccatgctcatcacg

SEQ ID NO: 559311 - DNA, 488 bp, Homo sapiens
ggaccagatctccgtgtctggattcgtgcctgagaccccttgaggactacaaggcgcccacgtgctccagttcaccacccgcacggcgcagtgccggaacacttggcggccctcgaggaggctttggacgtggacccgatggttctttaccaaatgaagaaatccgtgaaagccatccacagctctgggctggctcacgtgggtaaatgaagagccgtgacaccccggctctggagaagtttggcggcaactgtgtatgcagagatgaccccgatttaggaagtgcgttcctgaagttctcagtgtttaccaaggagttgacagcacttttccaaacctgattcagaatatgaccacatatatctccttccctttggaccgatttctgaagggggacctgaaaggagtgaaaggggatttgaaaaagccttttgataaagcttggaaggactatgaaccaacaataacccagatataaagaaaaaaaa

SEQ ID NO: 559312 - DNA, 838 bp, Homo sapiens
  misc_feature (195)..(195): n is a, c, g, or t
  misc_feature (199)..(199): n is a, c, g, or t
  misc_feature (802)..(802): n is a, c, g, or t
cctaagaggatccatggcgtttactctctgaagacgttgaatcagactgcctgggaattaagtgacaggaggctgagtttgtggggatgtcttatgccttactgaaactgatgggataagtggaaatctgcttgatgaaaggaaactgcagagaagagaataatttgcaacccattcttctgaggcccaaattanctcnataccaacacaacataaggacactataagaaaactgtaagtactcttcataagcacaggtatgataatttttaaattaaaatttaataaatgaaatccaacaatacacaaaattgattctacattgcaactaagaagggtttataccaggaatgcaaggttagtttaccattaaaagaacaaaatcagaaaagtatgtggtcatctcgctagaggtttaaaaaaaagcatttaagaaaaataaaaatctatttatttataaaaatagcaggaatctggggaagaaattcaatgttctcagtctcaagaagggcattttgaaaaaaatatacaagtaaaatacttatttgtaaaagaatgaatctttttccatttaagattaagaaaaaagtcagggatgtttgcactcacaaattcttttcaatatttcagtataaaaagtcaagagaaatacataaaagccattcagatttagtagaagctggaaaacagtctttttggctcataaaatcatgtatatataaatcctatgaaaacaacacaaaaatacttaaagtaataagtgtttttgtattacctaataaacccggcagcggccgggccnggctcgcgcgaacaatcacagtatatgaacattgca

SEQ ID NO: 559313 - DNA, 86 bp, Homo sapiens
aatgcaatccctgaacgtggaatatgtttccattttttggtgtcctcttcactttctatcatcagtgttttacagttgtaattcca

SEQ ID NO: 559314 - DNA, 246 bp, Homo sapiens
acctatcatttgtatgaattgacaaggaatttgcgtgaaagtgtgcagagatacattagttatagaaactgaactactgggctgtagtgaggaaggacctgcggatgcatattacatcatataccgatacgtgtttctggtgaggcacccaccgtttctgttttcttctgttctccttccagagattttctatgcctaaacaccatttgaagccatgactgtatcgtgatgaggggttattacagt

SEQ ID NO: 559315 - DNA, 899 bp, Homo sapiens
tcctagaaggtcgtgtcacgtggaatctcttaatctcagcatccggaactccaggaagtgaaaatgtccgtcagatagaattctatatataccatttctttggaaccttcagtcctcaagattccaacatcatgacctcagtttcaacgacagtttgtccttagttcctctagtgtcactgctcttagggtgctgcctggtttgtgcgcaagcatgtatgaagccgcgatgcatgcacatcgacgccttttgtgaagagtgatggttctcaggcattacaggcattagtgcctgctaggggggtatatgcacgagaaagagaaaaatggacagtatgtgactttgcaaaggcctaactgaggtaaaagctcaccctgaaaacctttgcgcttaaggaggctaaaacctgagattggtggtgtgaaagtgttccatataatcatgtcaagataatgggagctttgcacataagtcattggttctccatgagatgggcaactagcatactgtatcgcttggccaaaaaatgttttctttgccatgaaatgttgccctgaaaaatgcggctcataaattggcctcgttcggttgtcacggaagttagatggctggattacctagtaagtatggcatagtcctagaatttcctcaagctgtgacatatggagaacgagttctgcccggaatctaggaaatcccctgggcggttaatagcggaccctatcggggagttttactaaagtgtggggggcccccctgaataattgagtcgcgatggggaggaactttctggagacctaagctggtcatcacggggatgtgcaaaaattcgggcggttgaaaatagccgcgggtaacttcgaaaaccctgtgcagagaaggagacacgacgaatccgg

SEQ ID NO: 559316 - DNA, 215 bp, Homo sapiens
  misc_feature (93)..(93): n is a, c, g, or t
  misc_feature (109)..(109): n is a, c, g, or t
  misc_feature (133)..(134): n is a, c, g, or t
atccccccgcggctcatgtctacggagcctactctgaaaatgtggacggaacacactcgctcgctcctttaaaggagatcaccagcacactcnttaacaagctcccgtntgcttgtctttttttgtgcgtatnnagtccactgaccaagtcacccttaagaggggctgcctggggctcctgttttttagctgcgtaagacattaccgcgttggct

SEQ ID NO: 559317 - DNA, 444 bp, Homo sapiens
agggttgaagtgatgattgggtaagcctcggtggacattcagactgactagcacagagaaatccatgtgcacaggaaacagtgctccgacttcactacaccaccaactacattttacactcgtacaatcacagatactgccccacacgtgcctgagagggtctctctgagaggcaaggtactcatcccatctggtcctttttgctagtctccttgtcctcccagattgtgatgcagcttgttggctttcctctccttcattcctgggctgtagagactgtttatccttgtctgtctggcatcaactgcactctcctctctctctttctctccagtgtatgtccatccaggtgtatcccctggacaggcacttcattcttgacttttggaacttcacgccctcctacagcttcaaatatcaccactaagcaaaaaccgtcactgt

SEQ ID NO: 559318 - DNA, 849 bp, Homo sapiens
tacaacagatcatttgtagttatttgatcatttcaggccaataaccaatgaatacccagactttgagtgcaaatagtcaattcaaacagcacactgtctggaagtgtgcggccgacttgctcatgcagccaaatgtacaattcatattgctaaatcttaggatggcttcactgggcaaagctacgatcaagtgatttttttttcaaataaaaaacttattcgaatgactacagtatctattaaaaccatgttagcacaaattacaattgtaaactccatgataaataagatagacaaacttgaaggctcctaggcttgataacgcaaatggataaaaatgagatgtgacatttgtcactctaataaaatcgtaattgcagggctaaataaaacaatacacccccaaaaatgtgcatattaatacaagcaaaagtacattattaaggtgcttcagtttcaattatgactctgaaaaattagaccaaaagccatatcataaaacgcgtgttggtatgcgaaaaatataataacccagaacttgacgaaaatagacataataagaatcatcatagcatatgttaacttagtatgtataaatactacaatagccgataacattatcgttgtttcatagattagtctatttggtattaacgtaatatactagatgagcaacgtagatcaataatcgagcgattgtatacaaatgggtaaagatcgggcccgagacgtcccgatatacctagaccgttaaatgagtattgcagggaagaattatgtcatgcatcttgctaaaataattgaggagattatatgagttcacacgataatgcgtaaaacatatatccg

SEQ ID NO: 559319 - DNA, 414 bp, Homo sapiens
  misc_feature (118)..(118): n is a, c, g, or t
cctccaccagttaacaggcattgtggaaggtgaaggcataaaatgcgcagtgctcattgaagtgttattgagtgctcaactagcaagagaacctttgaacacaatgggagctacgaantacggtcatgcttactctaatatctgtgacgtgtggacaacttgccacttcaacagttctggacacttttaagctcccccgaggagaagataggaaacttggacaccctgtgtgggattgagaatcacaaaggggcagtctcgcacctggtcaagataaagctgaactgaactcttcattcacaagtaggattctcgtaagaggcaggaaagcagggaccgtctgtcactacacacagcaagaagaggtgaaccttaatgagggaagaaaacagattctattaggggaaaaaaaca

SEQ ID NO: 559320 - DNA, 753 bp, Homo sapiens
agcgggttccttcgccggcgccagggtagcggtgtagctgagcagcgtcgcgcgcgctaccgacacaggttcggcccgtaggcgtctggcagcccggggccatcttcagtcggagcgcctatggccgcagccgtgcgggccgggagtcggtcgggtactgcttgcgtcctcggtcgttgcattgtgtttgctgctgagccgcgggccctggccctggggctggagacgatgcctgacagagatgttgctgcgggatgtgataagctcttaccgctccactatgaccgctataccagctctcgcgtcaggctggatccgcatcgcgcacagtgtgaaatgtgttggaggcgacaggctgggttgtgattcttataccaccaaaagtcatacagtgtcagaacaataggctgggatgggtatgatgtacagtgggaatgtagagacggacttaagatagttgtcatacaaagtttggaaacatagctgtggtgagctgtgaaggctatgagtacctctgaagaccagtatgtactaagaggttcttgtggcgttggagtataatttagattatagagaagcttggcctgcagagaactgaaggagtctggaaagcagtgaacggctttgactctattctctgattattattactaagtggtcctcggcggattcctgtaacatgagtggattgagttaccatcgtggtactccttgggatcgcctgttgtaagtctataagctgtacctgagtga

SEQ ID NO: 559321 - DNA, 333 bp, Homo sapiens
tagtcggacctctctgctccagattcgtgtagggataaactctgttgtgatgaaagagaaagaacgagtgaagccaggcgtggtggctcacgcctgtaatcccagcaccctgggaggcggaggcggaggcgggcggatcatgaggtcaggagatggagaccacagtaaaaccccatctctactaaaaatacaaaaaattagccgggtgcggtggcaggtgcctgtagtcccagctactcgggaggctgaggcaggagaatggcatgaacccagaaggtggagcttgcagcgagccaagatcgcgccactgcactccagcttgggtgacacagc

SEQ ID NO: 559322 - DNA, 1349 bp, Homo sapiens
  misc_feature (256)..(256): n is a, c, g, or t
  misc_feature (426)..(426): n is a, c, g, or t
tcagtttgtaaatgatctaatagactctgatcttgtgtggacacgagcagaattggctgtgtccctggatcagtctgcatactggtatggtccatagttggtcaatagccctattctgatatctgtctgttctggatccttgtgagcgcaattctcgtctcacggtcacgtcgtatactatcagaatcttggatgacgagcatagtgaggctatttacgttaactcgaatagggcagtacacagtagaggaccganacgatgtgtgcgtaatgagcacgcttggcgtgatagtaagagtgattccaggaaatagtaaatgtgcatcttaattgacgtatgtcagtggacacagtttacttttcactattcacttttggtaactctattttgtgtgattcctctagagttgcttgctactgatctcnttgtgacggtccgcgtttagtgaaccgggcctacacactatttgctaattgatacccggtagtatcgttgtgtaattttctgtgcaattgggtcgctagatggtacatccaagcaagtaactctcgtgtccatgggcacttatgagttcctccccgtcacggagacggtgttcgacaaacgattgcttcaaaaatctcaaactatctatgtatacttacgtctcggggtattacatgggggatctcgtaagttggccaatctggccatgcactgtagttcctataaatacctaaataaatctcttataggtatagaattgcttcgagcgcacacattggagaagggcctagattgtatgccttttccttttaggaggtttagactgcaattgtaattggaagccacgttactgtggaggggcgcgtcttaattaggtagtctaattcctctccaagcgacatttcgcggaagtttattcgatacctttgtgccccatttgtaccacggatcaatttaacgggttcttgccccatatttaaaactacgcaaccgtggaattccaaaggtttgacctcaaagtttcccaagaacttggttggaaagggttccctttgtagggcgcccttacacctgtctggtgttcctttcgtctttgagttccttgaggaaatagggggcgttcacacgttccctttcttgtgggaagggtgttcctcgggcgcgggaaacacaagcctttgggcggggagagcgcctcctgagtctgtcgggcaccggactattagacgatttctgctccccccgtctggttggctgtgtcggagagcgcgtctttccgcgacttagtgtcgcgccgccgggcgtgagcaacacgcgcgtggggtggaccccacatcacggtggtctcgctatggttcataac

SEQ ID NO: 559323 - DNA, 1123 bp, Homo sapiens
cgtgtgtggacaagaggtggttggtgggtggctgaacggctaactggcagagcttagcaccccactctcccaagccaccccctgcaagcagcacagccagggcatataccagctcacgcgcaatgcccgttacctggcttccttgcctggctctgctttcttccaagctttgcctggggcctagccctgctacgaggctacagcactctctacaacgcaacggtatgctttcttccagcccctagcgctgtgggcactgtatacaagtaggaacttcctttcctctcacttcccttttaacccctagctcacgagcatttcagcccgtcttgctacctcgattcctcctgctgctcggacagaggctggggcgcagtgcccagcctgcattcttccgaccctacctgccacttctgcttccccgcctatcagatggcatggcacagctttcgctgcgcctattgataggagtggaggactggcctggcgggccttctcccatctacccaggcctgggcacggacttccccccctaccgcacaaaaaaaacagcccgcccacccccaacgcactccaacccccccacccccgaccgccccacaccacccagcgcacggcacagaacacaacgaaacagccagacacgaccacaccgcagccacccgccccgccacccccaaccccacaaaccaacacacgtaccccacccccccccggccccaagcaccacacaacaacaccaacacacaccaaccgacacaccccacggctcccacaccacagaacaacacgcccccaccccacccagcgcacccccacccacacacgaaagcagaacgcaccaccgccacgcagccgcgcaccccgcgccccgccgccctccctctccaccagcacccctccacccgcgaacacgagaaagcgagcgcagacgccaccggctcccccccccccccgggacgccagcaaaaggaggcaacgagggggagacggagacctcaccctccccgcctctcccccgcccccgccgccaccacagcggaccacagacagagcgggaacaaaagccagccccacccccgcgccgccaggcaagacaaaacaagcaccgacaaccacaccc

SEQ ID NO: 559324 - DNA, 212 bp, Homo sapiens
cgtgtccgtgtatccggggccgcctatctgttagtgttctcatgtctggatgagagctcaccgactatagtcgcagtcactcttgattctgaggcagggtgctttcgtgaacccggaggttgcggctgcgtgagccaatgatcaccccactgcactccagcctcggtgacaaagtgcgcacccggtctcaaaatcaaccaaaaaaattacaa

SEQ ID NO: 559325 - DNA, 238 bp, Homo sapiens
  misc_feature (44)..(44): n is a, c, g, or t
  misc_feature (53)..(53): n is a, c, g, or t
  misc_feature (164)..(164): n is a, c, g, or t
gcgcattcagcagcgcgatagatcgtctgtgctacatgtcgtgngttgcggangaggtgcagcgagatgccatgtgctgccctgggacactctgtgtaacgatgtttgtactacgatggaagatgcaaccccatattagaaaggcagcttgatgagcaagatgnacacatgcagaaggaacaactgggcacccagtccaggaaaccaacccaaaaggaagccaagtattaagaaatca

SEQ ID NO: 559326 - DNA, 230 bp, Homo sapiens
ggaggttgcagtgagctgagatcctgccactgcactccagcctgggcaacactgaggctccatctcaaagagagaaatacattctacccagagaacctgaaaagtcaaagggttgttcatagggagcctggatttcagttggagttaaggtaggcagaggagcccaactctctcattttaagcccctctatgcttttccatttgtacaacgtggtatcctctggtccagt

SEQ ID NO: 559327 - DNA, 544 bp, Homo sapiens
  misc_feature (58)..(58): n is a, c, g, or t
  misc_feature (72)..(72): n is a, c, g, or t
  misc_feature (325)..(325): n is a, c, g, or t
gtattaaccaacttatcactagacatggttttcacggacaggtaatacgttgtagccncttccactatgtcntatcaataggagctggtatttgccatcataggaggcttcattcactgatttcccctattctcaggtacaccctagaccaaacctacgccaaaatccatttccctatcatattcatgggggtaaatttaacttttttcccacaacactttttcggcctatcgggaatgccccgacgttactcgggctaccccgatgcataccccacatgaaacatcctatcatttggagggtcattcatttttctaacagcagnaatattaataattttcatgatttgagaagccttcgcttcgaagcgaaaagtcctaatagtagaagaaccccccataaacctggaggggctatatggatgcccccccccctcccccccatttgaagaacccggatacataaaatttagacaaaaaaggaaggaatcgaaccccccaaagctggtttcaagccaaccccatggcctccatgactttttcca

SEQ ID NO: 559328 - DNA, 983 bp, Homo sapiens
  misc_feature (294)..(294): n is a, c, g, or t
  misc_feature (538)..(538): n is a, c, g, or t
  misc_feature (552)..(552): n is a, c, g, or t
  misc_feature (638)..(638): n is a, c, g, or t
  misc_feature (642)..(643): n is a, c, g, or t
  misc_feature (649)..(649): n is a, c, g, or t
gggactcggcgggtcctcctgggagtctcggaggggaccggctgtgcagacgccatggagttggtgctggtcttcctctgcagcctgctggccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagcccccgggccccaggagatgaggaagcccaggtggangaacctcatcaccgccaatagcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtccccccagcctatcccctctaagcaccattcctccacctgatgatgcaactaacacttgnctccccactgcagnctgcggtcctgcccacctcccgtgatgtgtgtgtgtgtgtgtgtgtgtgtgagtgtgtgtgtttgctaaactgtggtctttgtggntacnntgtgtntggatggtattgtgtgtagtgagactgtggtctcgctttacccagggcagggctgaccatgtggccgtgtgcatcctacactgtccccgtgtggggcctcaaacactactgctctagaagcgtggtgtgccagagacagccgctaccggataagggatgcgaggggaagacacggggcgaggcccagcgctcgggaccgggagagccacttggacgagcttaggaaacttgagcattaaacatggtgcttcactgagccgggaggttcacaggaagcagagggggccagaggaagacaccggatccgccaagcagcgccaaggggagggaaccg

SEQ ID NO: 559329 - DNA, 328 bp, Homo sapiens
  misc_feature (91)..(91): n is a, c, g, or t
atctttgctgctcctcttcaagtatacccagatctggtgctgctctggcacagcaggtgctcactatatagagttattgatgaatacagtnagtacttatcaaatatcatcagcactgttgagttcttggctgggcgcggtggtgacacctgtaatcccagcactttggcaaggtcgagagggatggatcgcgaggtcaggagttcgggaccggcctggccaacatggtgaagccctgtctctactgaaagtacaaaaaaattggccaggcgtgctggtacacgcctgtaatcccagctactcgggaggctggggcgggagagttgct

SEQ ID NO: 559330 - DNA, 629 bp, Homo sapiens
tggcgggtccggcgggcggtttggctatgagcgggaccggagctgaggcaggaagagccggcgccactggtggacgaacggaggaggctggcggcggcattagcgaggaggaggcggcacagctatgaccggcagatccagcctgatggggacattggaggcccagcaaactggctgcagggcctcatcgtggtgcttctatgatcggcattgaaatcggactttggaggctagaaaatttgctcaacgaatcttcattcttgggccaggcagttgacaatggactgaacccaatagctagtgatctaacgacacagggtaaaactcccagaaggataccccgggaagactccgagtatacctttggattccatggtgacctatggggggtacttggtattgggccctggcagacattaggggagccttaggcaaaggaccctcctaataggggacgccgatgtcttacaagagattcctatccaaactccgccacattgggcttgggcaactcgttggacaagcggtgtggacgcaacttggacgcggcactaattactgaagcaaaatgtaactaaccccaggaagatctgtagtttgagactagtaccgacatttccgactttgtc

SEQ ID NO: 559331 - DNA, 114 bp, Homo sapiens
attgccagatcgtcgttctgcttctcatgatctcgtattccgacaccctccaacatggaggacaacagcagcagaaagtccaatcttagagctgctccgcattccctgttgctc

SEQ ID NO: 559332 - DNA, 123 bp, Homo sapiens
caagtaaattgtagccaccaggtgaactgcactaaaagtaaatactcaacaccatcatcactccaggcaacaacagcacacacacattcacatcccagcatgtgcacagcttcaaacagcacc

SEQ ID NO: 559333 - DNA, 742 bp, Homo sapiens
ggcccagcaacaagcatgaagtaactgggctgggtgctggctgatctcctctaagtaaggaagatgctggagaatatgagtgccatgcatccaatgcccagggacagggttcagcatcagcaagaaattacagtggttgatgccttacgatgaacataccaggtgataaggaaaggtgaaggtgccgagctataaatctccagaatattattagttctgcatggttaacaaagtatgtcatggatatactactattatccggattctgtgctctagataatgctttctggtattgaatccaatccatcgtaacacttctagttatattgcactggttttacacagagaataatacaaaataaagattcacacaatcaagatctaattcagagaagataaatctaaatatactatacacacaaaaaaaattactcggcctaatccggaatgccccgacgtatactcggactaccccgaatgacatacaccgagatgagacatcctatcatctgtaggctcatggcatttctctaacagcagtaatattaataaatcttgcacggatctcgagaagccttcgcttcgaagcgaacagtcctacatagtagaagaaccctccataacagccgtggcagtgactatatggatgccccccagcgctacacacattcgagagaagccgtcatacattgacctctacgaccaaccacaggacggcatcgaaccgcgcaaagctggtccc

SEQ ID NO: 559334 - DNA, 224 bp, Homo sapiens
taccgcttactggccacgcatcagttgccgaggaaatatccatgttcttgccgtcggtcaggacttgtaagtcacaggtaccagaaatcatcgtggtgcgcggcttgtagcccaggcccttgaggatctcgctggtggtcgcggtggtgacggtgatgtcggtccagccgacatcggagaagttgacggtcttgcactgttccggttctgcggcgtgtgccacg

SEQ ID NO: 559335 - DNA, 130 bp, Homo sapiens
  misc_feature (99)..(99): n is a, c, g, or t
  misc_feature (101)..(101): n is a, c, g, or t
tgtgggttgctgtgccccagccctgccagcttacgaggacacactcaagccgtgggtgctgtttacgggtgtgtcctcgtaaacagcaccacgttgagntngggcctgccaggaggcctttccctagccg

SEQ ID NO: 559336 - DNA, 1467 bp, Homo sapiens
gacagaatatggtcccgagatttgtggagcccagcgatttgtagagaacacccctggactcctaccgctgcacaccagcctgtgaccctggcatatcagacccacgccaggggggcggatgccaggatgtgaacgagctgtgaaacactacagggctgtctgtggagctgccctgaagtgaacactgtcgaaggctccttacctctgtgtctgccccaacagcccggaagagtatgaccccatgactggacgctgtgttccacccacgaacttctgctggcacagttcccagagctacgcagaccccaggcacctgactagccccgatatactgcccagccaggaccaccctaccgacaaccccatgcaccccagccggaaccaaggcacacctacggcacgggacccatgctggcagacagtggacagccagaggagtggcatacattgtgacaacaagcaggccaccgagaatgccatgctgcacgaagcattccctggccctcaggacagtgtcgacaattgcgcccgtgatcgtgctggcatgcatcacatgctgggatagacagggcgtgcgcgcacagcacagcggctatgcaccggccattcccagaccaagagacgacacggcggccacacacgggtacaccaacacagactgagcacagggaagtcgcatccagggctgtaccgaagccaggacaaggcagccaacagagcgcgatgcataagccacaacagaaagactagctgacgacatgaaggaacgtcacacacgacccagggagacaaccgggcgggcgatgacatccagacaggcataccgcacggcacgcacagcacacgcaggactagccccaaccgcaaacacacaacagacgagacagcacagcgggaagcagagtggcccggcactggcagccacgcaaacgacggcacacactggagcacgcgacgactgacacacgaggccacacaagacaaacagagagagcagggaggcagtgaagagcaaacgaagaatcgaccaggcgcagcacccgttagaagacgcgcgccacatcacaacaggtgcacgacactagcatagcagcaaaactgggatagccaacaccagcaaagtgagagccaccgcccccgggggacgcaacacgcacacgagcaaccccaagcaggggcgcctggagacacgcagctacactcacacggcgcagctcacaacgcccctaggaacaaggtacgtcgcaacagcagacggacgagagtcaagcacacacgaggggcaactcaggagccgcagagacctcagccaccacagacacgcgccaccatgagtagcgccaggccaatcaagagagagacgacacgcagacgacgaatagggaaggagcaccacgagccacagcgcaacgcagaccacgagcaccgtcacagcgggccagcgctgacgcgcaggcgacgagacga

SEQ ID NO: 559337 - DNA, 85 bp, Homo sapiens
ggtaaaagattcccataagactgaccacaaatttaagaaaccaaatcctgtcgaaggtaagcatatgcccttctgtcgtcttctc

SEQ ID NO: 559338 - DNA, 1773 bp, Homo sapiens
tgtggttgtgattgcggaggtggtgtgtgtgtggtcggcctgtctttcttgttttttgtggctgcctgcggatgtttgtgagtgctggcgatggatgggagatgggtggttgtttgtgggtggtggatggtgacccgctgtctgctgtgttcggggtgatgggtgaggggtggctgggtgctcgtgtgagttttggttgttgggttgccgccttcggcgtgtggggtgtgttgcgtggttggttctgcagtgtgggctggtgtgtggctgctgcttgcttgcatggagaggtgtgtggggttggggttcgtgtgcgtccgctgggttgtcgtatctagtcgggtgtatcgccgctcgttgtgttgtgagtccactccgttggtgggggtgggttccgcaccacccgggtggtgtgttgtgcgtcctcgggtcgatcgttcgcgtagttttgtgtgttttactagtggagtggggttgttgtgggtgttgtgatcaacctccccgtcgtcggtgtgttggagcgtcgtctcagctcggtcctgctggtgtatttatttggtgtggttgctctgccaccccggctggtgcgggggtggctgttggtgtaggagagactctcttgtgtgaacaaccccccctccgttgttgtgtgggtgttttttgatgtgtgggttggggtgttctcccgcagtgcgtgccgctttataggttgggtttgtttgtgtttgtggttggggcggcgggtcgttatattggtgggttgagtgttgctagccccttggccagagtgcggtctatgtcttgtgtggtggtcgcccgatctaattatggctgggtggatattgtgtttgtgtggtgatacctgcttttggtggccagcgtaatgttgtgtggtgtgttcggctacgctatcgatctgctctctgttgggggcggtttgtgtgtgtggtgtattatgggtagttgtttttttttttcgactgtggtgggtgccgctgcttgttgttggtgtcgccgtccctttttgttgttgcttttggcggtgtggattgttgtgtttgtgtggcgggccgttctgtggctatgggtgggttcttcttcgctgcaacccacgtcttgtgtgtgtgtagtggcgagacagctgttgttgttgagatggtgttctgttgtttgggtggtggttgtgggttgggtgtcccccccccccctctcttcgttgagttgtgatctgtgtggttttaaagatggggtatattgtgttttatcatgctggtgtgtccccgcgcgccctcgtccgcacccccttcttgtgttgcccccccgtcgtcgtcgctgtataatagcgcgggttgtgggtgctgtgtgttgttctctctctctgtgtgtgttcggggagagagagtggaagagtgtgtggcgccacacaggtgtccactcgctatatctctgatgtgtggtctgtggtacacactcgcgcgggctcgctgagctctgtgtgtggggcggttctctttcacacactaggcagttctgaaccacgaggtttcaccccctgcgggactccccgggtgttgccacaaaaagagggggatatattttatatatttgttgttggagggaccccacacacaagagaacatcttcttggtggccgccgcctttggtggtgtcccttgctgttggatcaccattttttaaaaagagaggtcccctttgtgggtgaatttttttaaaaaacgagggttttaatttaaaataaataaaataaaaaat

SEQ ID NO: 559339 - DNA, 430 bp, Homo sapiens
  misc_feature (199)..(199): n is a, c, g, or t
  misc_feature (218)..(218): n is a, c, g, or t
  misc_feature (251)..(251): n is a, c, g, or t
  misc_feature (296)..(296): n is a, c, g, or t
  misc_feature (319)..(319): n is a, c, g, or t
  misc_feature (323)..(323): n is a, c, g, or t
  misc_feature (413)..(413): n is a, c, g, or t
  misc_feature (416)..(416): n is a, c, g, or t
aatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggnttcttttttaacagcttgnatagtcttggggcccttcaagctgtgaaaatgnccttggactcttagcttctgcatgggatctgggtcaagtagaaangactgggggatgggggaccattnctgnccatggatttggggaaaggaagaataatcctaaatccaggtggggtccattgaatgtgattatttagattaatttaggctggtctggganaangagatggtgcggtc

SEQ ID NO: 559340 - DNA, 969 bp, Homo sapiens
gggagtgggccaggacgccagtgctacggacgcgccgggctaatcctgaagtggggctgcgaggtcaggctgtaacctgggtcaatgtgtggaatatttggggggctcgtgctgcagacttgtgccaaatggacgggactattacggaggctctgtcggtggtgagcgacgaccagtccctctttgactcagctgtacggagcggcagcccatctccccaaggccgacatgactgcctcggggagtcctgactacgtggcagcccacaagatcaacccctcccaacacagcaggagtggatcaatcagccagtgagggtcaatgtcaagcgggagtattgacacatgaatggatccagggagtctccggtggactgcagacgtaagcaaatgcagcaatgctggtggtgcggaggcagagtcccaaggcccattgaactacaacaagctatagtggaccgagaagaacttgggaccgcctccttcccaaacattgaccaccaacgagaggagagtcatcagtccccgggagaaccccaacaacatgtggaccacaggagcatgtgatggcaactggctggacgtgggccatacacggagtaccagggttgcatgggagactctgaaaccatcccttgatgatgccgaggaaacattgggattgagcacaggaaacctagtgtaacaaattgaacaaagggagggaatttaccttacagggagaccaagtaggctctcgtaagcgaaacacccgggaaacgttgcaatagaaaaggcacaagacgcttcacaaggtttacgccttcaaagcggacaacagttcacacttgcttgagacccttcattaagttacgaagcctgtccacagagacgcgtgccgcgcaattccgtgccacagaatatgaacgtggtcccaggaggacaggcacccgtctcttgtcacgcaacctccaagattccagaacagaaa

SEQ ID NO: 559341 - DNA, 199 bp, Homo sapiens
tcagatgtcagtgcaggtgacttctctcctcctggaggacttctctaactctccagacccaagcaaaggtcccctcttctttgtcctcatcaaagcacttaccatgctgagggattgtataactagttaccaaggctgtctccgtttcttgaccacgcctgtagtgtcacctccatttgggcaggtgtttcaccttttc

SEQ ID NO: 559342 - DNA, 1198 bp, Homo sapiens
  misc_feature (465)..(465): n is a, c, g, or t
  misc_feature (471)..(471): n is a, c, g, or t
cattgagcacctgctgtgtgccttgcagtgtctgaggcacttctagctattatttcctaagggttccagcagcccatggataaacttcaaagagtgtaagctcctaaaaattgttcgtattttctgcacatttttgtagttttggagaagagagttaatggagttcttgccattctcagaattatttgatccctttaggaatgagcatctctagcctctgcctgttcatctgggacaatctgcacctgggcgtggacctgctgcttcagatcagtaggtatcagaatgaactcagttggatggggcagttcaggacccctggcctccttttagtctggaccccactctcattcctcatattctcaattcactctttctactgagttactatcctagtaatgacaatgcctcctatcatctagagacttggtttgatacaatgcattcacatacaactgctcgttntgattnctataactggggaatacagaaagcaaatatgcggtgcaatggaggatgtctccattaccccagataactccaaaattctcacctagttaccagtgcaggaaattcgttcgaaggcagaaatggaaaatgaataagaaacaatttggatgtgttccaaaaatggagagttgtcaggcactatatcatacaacctgaaatatcaatggtgaagtagacagttcacctccacagggggcaggaggttggacccagggcaatggatgttttatatggatggttaaccggtctgtggccatgaggtggaaagctgtgtacacctgtgaagccatcatcacaatcaagttagggaacatatccatcacccaaaaaagtgttctcatgccctttggtaattcctccctcctaaatgtccccaccctaccccacatcccagtttctatgcaaaaaccgctgaccaactttctatcactatagatttgtttgtattttctagacttttatataaaaagaattatactgtatgtacacttttttgtctgtttttttcacttaacatatttattttcagaatcatctatcttgttgcaggtgtattcctttttattgctcagtagtattccactgtatggatataacacaatttgtttatcattcacctgttgagggacattatacttgcttctaaatttttactatcacaaataaagctgctgtaggcattcaaaaa

SEQ ID NO: 559343 - DNA, 624 bp, Homo sapiens
attgagcctgtggtcctgccgctgctctggtttgcagagagcggggccatggagggggagactcttcacacattctacactcagctggttgatgcccaaggtgatgcactatgcccagtacgtcctcctggcgctgggctgcgtcctgctgctggtccctgtcatctgccaaatccggagccaaggtcctgaggacaccgtgagccagccaggcctggccgctgggcctgaccggcccgcggaggccctaggcgccgcgtctcccggatctcccagcggagagagcaccagacccacagactgagccatcccagcaggccatgtgcgctgaaggacacactgaaacacacgccacatggcagacatagacaacatgcggtgcaggcatggtgcagacactcagggatggagctggtgctgaagggacttgtagggagaggctcgtcaacaagcactgttctggaaccttcatctccacgtggcccacaggcctgaccacagggagctgtgagtccatgcgtcacccttcctcagggtgagcctggcctgtcccgtatcagacgttgggcccaggcatactccacctccaaggtgaaacactgcaagtccggtgtggaggtcccc

SEQ ID NO: 559344 - DNA, 152 bp, Homo sapiens
ggttgtttctagaggatcccgatgctcactctgtggtaggtgcttgagtcagacagaccaatggttgtgaacctgtgcaggtaccactggactggtcacactcgtggggcgtgggcgccagagtgagactgtctgggtaactgagctcgaat

SEQ ID NO: 559345 - DNA, 757 bp, Homo sapiens
tgggcgtctgggatgtactttattggacaagtggtggcccaagtctgttggtctggaagcactggggccctggaacccaggcactgagttggaggaggcccagaatttacagggctgttgggagcgaggccacaaagcgtgttggtgaggtgagccaaggaaagaaaggttctgcttgtcggacattggagagctcggccaggcgactgctgctcctcgtgctctagccggcttggccgctgttggaaagcagccagggggtcatcctccagggcatagtgctccagcagggttcgcacgtcctccagacgattcagtgcaagggtcttgaggaaggcaagacagatccaacaagacccgggtcatcagagttgccgtcccaggccgctagggaaccggccggtaaatagggctagcaggcggaaggctaccttctggcagtccacaagttactactcgagctggggtcccccgattcagacttgaaatattccttgacttgggtgtccatcccatgtatctgtgtgggacgtacccgaaatagggcggacaggagatgaacgccatgggcggtccccactatcactgagtgtggaaaggcctgtcatgccagtctctggacgtaaagatgaccgttgcactattacggggcacgctgctggaacaggtcttcgattgcctggggcttttaaaacttccagcaggggcagcgacactcaagatgaggaagaccgccgttattccaaaagaaccggtg

SEQ ID NO: 559346 - DNA, 369 bp, Homo sapiens
ctgtacatcccagacctttgagaggcagaggcatgttatttacatgaggccgggcagttcaagacaagcctgttccaaatggcaaaaccccgtcacaaaaattagctgggcatggtggtacacttctatagtcccagctactctggaggctgaggcaagagaatcgcttgaacctgggaggcagaggttgcagtgagccaagatcgtaccactgcactccagcctgggtgactgagcaagactttggccccccaccaaaacaaaacaaaacaaaacaaaacaaaacaaaacaaaacaaaaaactcaaagaaattgctctctaagtacactaggatttgtggaaggatatctttctgggcaatcaagctt

SEQ ID NO: 559347 - DNA, 137 bp, Homo sapiens
aatccaggcatgtaccctgcctaaccccctagcagccaggtgacagaaatagagaagatccaggccagagccggctaacattattcaaacagctaatcctaaacctgctcaacctgcctcgcccattccctcccaca

SEQ ID NO: 559348 - DNA, 1952 bp, Homo sapiens
cgagtgattctcctcgaatacctcctgccggacgcggagacaccggggacgggggatcctgccgcaagcataccatcccctatcctcactctcccccgccacaccgagagaccctatagtacctatccactatcacaccaccacacacacaacgacagggcagagaaactaggagctccacagaagaacacacgagcatacagggccacacctgacacgacgcgcacaacgccacaaggaaacgagaccaacaacgacaagacgtcgagcccgcagaaagacgacagaacgagagagccacacacagccgcacagccccataccagctcagataccccacgcatcacagccaacaaacgacaaacaccaacaaagcaacacacacacccggacacacaccacacaaacacacgagataacagcaccaagacgacacaaacacacaacacaaaccgcacgaccaacgcaggaaacacaacacacaacagaacacgagcgaccacaacgaacatacgaaccccaccgcagtacgaccccacacacccccaacaccactccacagagaacaacaatgacctacagacgaaacagcgaagaccaaacacgcgaagacacagcgacaagaggaccacaccacacagcagacaccagaccggcagctcacacacactacagtacaaacctaaaacactgcgaaatacggcacaaccacaccagagcaccgcatccgcacaaacaacaaagagcccaacctaaaacagcacatcagtacgagcaaacaacgatgaaccaacaagaacgacagacacaagctacagcgacgaaaaactatcgctcagcaagacgcacagcagatcatagcagacacacttaacacacctagagcacggccgctctgaccagcgccaacacagcaaggaccgagacaagagcagcagcaagaacaatacataagccaagaacagcaacagcatcgaaccacccagaccacatagagagctatcacgaccacaatacacgacgaccacaagcccgctcagtacgcagaaagcagagcatcacggaaccaacaacgggcccacgcaacattcagatgggaagcacgaccatgaagcgacaagaagacagaccgctgagccaccagacgcaaagagagccaaaacactcagagaaactaaaggcaacacacagaccagcaaacaagaccacatggggagtctacgctaaccagccataagcaacccaagcagatcaaccaaggaactcaatataagagaggaccacagtacctcaccaacgaggcacacgaacaaatgcacatgggcaactaacaacactgacaagagaacatcaacagagaggcacaagatgcattagacgcgagggcataatagcgacacagcacacgtagtgaggagggacatacgcaaacagcaccgagcagcagctccaaagcgtagtctctgaccaacgatgagcgcgacagagacagctacaaaccgaagcagcaaaagtgcgagacagcaccagagagcagagccaagcatcctcgaaccaccagaagacagaacagcgacgacgcatagcactccagcaccggcatctcgacagcgggacagcagagcacaacggacagatacgtgaacgatagacaagagcaatgacatggatagagcacgaaggacatacacgcagcgaccagagcaaacacagagaacggcaagcagagaaaggaaaagacaatcaactacagaggagagatcgggctgctcgacacacacatcctgagtaagagcaagacaaaagcgatagacagagaatcgaaggacgagagagcaagacaacaaggaaccagaaggtcgaggaagaaacacaagagacgaaataatacagacacatccgaagcgagagaagcagtagtagaagcacagtactagacgatgaagcgaaac

SEQ ID NO: 559349 - DNA, 126 bp, Homo sapiens
tcccctgctgcgggggcccccaccccgattcctctccccaaaaacggtgggatgggcccccattaactgcagcagcatgctgaggtgtccatgttgtttgcctttgtataaaaaaacagcctttga

SEQ ID NO: 559350 - DNA, 342 bp, Homo sapiens
attttttttttaaaatttttattttttaaaattggaaacccctttccccctttgggggaaaaaaccaagggaaagccccgggcccccggttttttaaaaaaccctttttagggggaaaaaaaatttttttggcaaaaaaaagttgaaggtttaaaactgttttttttgggggggggggcccaagtttcccccggccctttaagggtttttagggggggggcctggggggggggggaaaaaaaacccattttatgtttttttttttttttaaaaggcgggttgttttttttttttttttttaaaaccccttaggggaaaattttttttttgggggtaaaggga

SEQ ID NO: 559351 - DNA, 529 bp, Homo sapiens
  misc_feature (127)..(127): n is a, c, g, or t
gttaattcccaccttggccccagtgtggttcctcaaagtaggacaaaggcaaaagtgtcccccagtttttgtttccctttgtttacgcccaaacccaaggcccccaagttggagaacccttcccgcngggtgacttgccccatttcagggaagcccctgggcattttggacttaacgcccgtgcatttcaccccgttaaacagttccttggcccgggtggggtttttcccccccaacgagcgttattttttttccgttaccccgaacagcttaaaaaacccccccccctgggtttttttgggcccctttggggttgtggtcccccttaaatgggtggaaaaatttttttggaaaaaacatggtggccccttttattggaaacaaattcccagcccccgacttttttttttttcagcgggggggtcccggttttccgggttccggagtaaaactccaaacggaaaattcccgcccggttatccagccctaagtttttgggggagcccaaataacccggtttgggtgccca

SEQ ID NO: 559352 - DNA, 671 bp, Homo sapiens
  misc_feature (595)..(595): n is a, c, g, or t
aaaagaacataacacacatgctgtttttattatagacaattttcctgttttttttttaacagccagtccctacttccccaggtaattatctagggggcatacactggattttctggttatacaatcctatgtagacctacatatacataaacaaatgcttggctatcattttacagatttttttccttttaatgcaacaatgtttcattaaaatttcttcaaatcatctagtttaactcagttcaatctttttaaggggctggacaatatctggtattaaaccataatgtatttattcttctataggggggcattactttatttctagttcttggctactataaattatgtcaagagaaaatattctcatatatatgttggtatgaactggtatttttttcttcttcttctcaggattagaatcggtgggcaacaggataaatatattttttattttatgggagattacccaggttgtttttaggaagacttgaacattttccatttccccccttaatgttcaaggatattttcttaaacttttttggcaccctctaaaaaatgaaaatttccaggcacccaccacaaacctttntgatcacgtttgggtaacattcaggagctatattttaaaagttcccaatgaatttgagtggtattgaagccctgtt

SEQ ID NO: 559353 - DNA, 1093 bp, Homo sapiens
ataacatgtataagaatcttcactctttggattttcacgtcactatgtggggcgtggactcttggaggttcaattaaatcctgagtattgggtcagtggcccccatctccccttaatgtggcgctttccaactgtgtcccaatgtgctatgcgacttgggcacatcatcggagatccagaaatttcacaccggaattgactggggaaatcttagcaatcaacttacagagctgtcttaattgaagggttacctgggacccatctagtgcacgtggggtgcccaatgcagaggtccggtgaagcatgcacctccgtcacacccactctgttttccagccggttccgtcaggtgttttcgacccacctcggggggcttggtacgtggaacaccagtaaggggagaccatcagccagaggctgccactgtgacttcgaggcgtgccaccgccacgtactgatgaggggtgctccagcaccaagagcacggacagcgggcaatgccagaggatacctttgccgccacctcctgcaccgagaaacatatgaagaatatggatatgatgatacatacgcagaacaaagttacgaaggctacgaaggctattagcagccagagtcaaggggactcagtatattcatcgactatggacatggggaggttgcaagattctgtgatgaagcttatggccaggacgactggaatgggaccaggccgtcgctgaaggcccctctctgctaggccagtgaagggagcagtacagagagcaccacataggcacgcgtcatgaaagaacaaacatgagggggaaaatatcagcttatgagcaaagttgttagctgatttcttgtatctcccaggattcctgattgcttaacccagccacagacaagtaattgtctaagtgtttttcttcgtggtccccttcttctcgccccaaccttataccattcttaactctgcagtcgtggcttctgtagtgtagtatattaaaatgagttaaaatagatttagggatatggaattaattttttaagtgtattaatgacgctgtttctttgctggtgataggagataccggaccttagaattaag

SEQ ID NO: 559354 - DNA, 432 bp, Homo sapiens
gaaagcacggtgagtgaggtcccctctcgccgctccagcaacatggttacctgacgaagtcccactctcccctgtgagattttctccagcctcgcaccattcccaactaggcgccctccaaggctctctgagggcaattggaggcttctgcttggatgaggctaaatccctaatggcttggttaatgagctgctgggatggagtagttaatgagcctcagaaatgttaagaaacaaatgtcctacgtccagcttacaaggagagtcacatcagaatcaaggctaagcgaaaacatttaaaataaaaggtttatgagcatgctaatggccctgtcctgaagtttccagcagctaattaatgaccagacacagcataaagaagctttgtcacagattcaggcctgtaattccatcctgttgagcggaacgccat

SEQ ID NO: 559355 - DNA, 158 bp, Homo sapiens
ggctttctagtattataaaaaataatctattctatgagaaaagaggcgtctgtatattctgggaatcttctccgtttcaagcattacgaacacttttaataaactttttttagagaatggttcaaacaacaacacacaaaaacaccaacaaacacaac

SEQ ID NO: 559356 - DNA, 200 bp, Homo sapiens
tagacctgtacgaaatatgtgtctaatgctagtgtaaccccaaacccagctaaaactgttgctattgaagaatggtgaaacagcacaatgtggaggcagaattaccagtctgccacaaagagaaagaattctatgtgagtgaaaacgctctaaaagaggtgatgctgattaattagttatactctcagccgagaggactg

SEQ ID NO: 559357 - DNA, 228 bp, Homo sapiens
gggacggaaaaaacccggcccaaagggggccccccaaaagttttcgtggaaaaaaccctaaggggttgctccccggaaaagaaaagggaaagctatatatatgggccgggatgtggccaaccccccgtaaaaaatgggtgccccgcatgagggcaggactgtcaaaaattttttttagctgggaaaagggttttttttttaaaggttctttgtaaaggggccccttta

SEQ ID NO: 559358 - DNA, 148 bp, Homo sapiens
  misc_feature (31)..(31): n is a, c, g, or t
  misc_feature (88)..(88): n is a, c, g, or t
tgatctagaggatcctcatggtgatgatgtnacagactgagatgagtctttcacaggtaggactgagtgttccaatactttttgaagnctagaagtcatttatgtgtctgagatacatctattcaaggacataccaaggaaatgctca

SEQ ID NO: 559359 - DNA, 686 bp, Homo sapiens
  misc_feature (344)..(344): n is a, c, g, or t
aggcacacttgctgtgtacaatgactgagccctttcttgtatgttgcttccttggccgagaggtgtgcatgcgaccgtggcttttcccaaagtttactgactttgtggtttaccctcttcaccttccagggacgcagtcgttacgaggttagactgtggcagctctgtgcagtgtttgagcctacagacacatacatagggccaaatggagattaatatactgactcgttctcctggaatacggctagacctatgctgacaggtttgttgctgtggacgagggcccctatcgaggggggcgcctatctcatctttgacacatgcattcgggatgcgactacaancagtgtgactggatacgctggccttgtagctgcatctctctggcaggactactgctcacactgtcaccatggcctggatttcttccaagcgagccttgaccacaggtgtcctcttgatggctcctggccagttgtatgtaatcgttaaagggaacgttaaactgacgtccgacgtccctattctgaactcacggtgtgatcgatctccgaccctattacctcgcacccgaactccctgctgcacttgagttcccctcattagaaccacggcccctctgtatacggacagggcctgcctctggtgctatgccttgaacaggctaattgcccgcgccctttgct

SEQ ID NO: 559360 - DNA, 166 bp, Homo sapiens
acagaagaccggacgctctatggctctcacaatggctacactctattgacaacaggcgtccgtacactttcacagtccccgtgcgtcagggccactccagacatccccgatctcatgccctaacgctcgcatggctgacgtacgccatgcccacgcatcttgccgg

SEQ ID NO: 559361 - DNA, 216 bp, Homo sapiens
  misc_feature (13)..(13): n is a, c, g, or t
  misc_feature (46)..(46): n is a, c, g, or t
  misc_feature (48)..(48): n is a, c, g, or t
  misc_feature (107)..(107): n is a, c, g, or t
  misc_feature (109)..(109): n is a, c, g, or t
  misc_feature (114)..(115): n is a, c, g, or t
  misc_feature (128)..(128): n is a, c, g, or t
tcactaagaaagncagtaactttactgaattgtctgcaaaatacananttataccttatttccagcaggagaaacttttgaaaatttccacttttattcactacagncncctgnnttaagtcccttcngatacacagatgtgggcgaacttagttataacatcttgtcatctagtggcgacaaagtccagcttatgccgctgtgagcctctatttg

SEQ ID NO: 559362 - DNA, 118 bp, Homo sapiens
ttgtcccaccttatgccgtggttgcttacctacctataatgtggtatataagctgctgtcctggacactgcatacaaattccaatgtgtacttcatagtgtaaaaatttatattattt

SEQ ID NO: 559363 - DNA, 847 bp, Homo sapiens
ttttggcggttttccccccttgggggcttttggcggcagtgccatttcggcccccttaggtggggttgaatttgccccctccgctgcttcgagccaaggccttttcttggccattagggggccacgattatggggaattatgaggttgacctgtttaaccgacccgaggagggcgttattagccttgcttccgagaagaacctgccatgggacttgaattaagctcccgcggaaaggccaattgtccctctggaggctctgaatgaacccagttcaaggacatctgctagagagaggggtgtctgctttttccacgtgggagaaggagttgccaccagatagtttttgatcccccggtacattacttctccatccctaagagagaaaaccaggtgtttgatccagtatgtaaagacccgggccagaggaagaaccgccggggaaagaaaaataaaataatgccagcccaggaagatttccaaacaatgatggaagaagccaaatttaatcccagagccacttttagtgaatttgccagcccagcatgctaaagattccagattccaagccattgaaaagatgagaagaccgagaagccttgtttaatgagtttgtggcccctgctaggaagaaagagaaagaagattcgaagacccgaggtgagaagattaaatcggatttctttgaactattatctaatcatcacttggacagtcagtctcgatggagccaagtaaaagaccaagtagaaagtgatccccgttaccaagccgtagatagttcatccatgagagaagaccttttccaaccgtaccttgaaaaaatagcccagaatttagactccaga

SEQ ID NO: 559364 - DNA, 759 bp, Homo sapiens
  misc_feature (9)..(9): n is a, c, g, or t
  misc_feature (129)..(129): n is a, c, g, or t
  misc_feature (206)..(206): n is a, c, g, or t
  misc_feature (215)..(215): n is a, c, g, or t
  misc_feature (219)..(219): n is a, c, g, or t
  misc_feature (243)..(243): n is a, c, g, or t
  misc_feature (247)..(250): n is a, c, g, or t
  misc_feature (253)..(253): n is a, c, g, or t
  misc_feature (272)..(272): n is a, c, g, or t
  misc_feature (276)..(276): n is a, c, g, or t
  misc_feature (280)..(280): n is a, c, g, or t
  misc_feature (298)..(298): n is a, c, g, or t
  misc_feature (303)..(303): n is a, c, g, or t
  misc_feature (313)..(313): n is a, c, g, or t
  misc_feature (325)..(325): n is a, c, g, or t
  misc_feature (347)..(347): n is a, c, g, or t
  misc_feature (362)..(362): n is a, c, g, or t
  misc_feature (373)..(373): n is a, c, g, or t
  misc_feature (383)..(383): n is a, c, g, or t
  misc_feature (408)..(408): n is a, c, g, or t
  misc_feature (416)..(416): n is a, c, g, or t
  misc_feature (469)..(470): n is a, c, g, or t
  misc_feature (477)..(477): n is a, c, g, or t
  misc_feature (505)..(505): n is a, c, g, or t
  misc_feature (514)..(514): n is a, c, g, or t
  misc_feature (523)..(523): n is a, c, g, or t
  misc_feature (527)..(527): n is a, c, g, or t
  misc_feature (575)..(575): n is a, c, g, or t
  misc_feature (577)..(577): n is a, c, g, or t
  misc_feature (584)..(584): n is a, c, g, or t
  misc_feature (597)..(597): n is a, c, g, or t
  misc_feature (601)..(601): n is a, c, g, or t
  misc_feature (638)..(638): n is a, c, g, or t
  misc_feature (673)..(673): n is a, c, g, or t
  misc_feature (735)..(735): n is a, c, g, or t
attcaaagnatcagcgacattttgcgaatatagaaaagattgatgtaaaactattgtgttatgacgtgatttagtctctatagtcaaaattgggtattttttctttgtcttgaatttcatgaagtatcngcctgttcattaaaattttgaaagttcttacgtccacgtgagtatgcatcttgaagcttagcaggaacttgtgttcnagggtcctngtcngggtcttttcataaatctccttgnacannnngcnattttggtctgtagctggnggtnaatnctttgagcgaggaatganaggcnactgtctgcnaggcttcctggnatgcggaaatgacatcacggcngctattgtggagttnaggccacgcgnagcacgtccngttcctgtgggggcagagactttcngctggcanggtttctggcgctttccatgccacgtggcttacgtgtacgaagagagggaggnnagggccngctgtgcggttgtggtaatgctgggggngaaagagcnttttgtgcnatgntagcgtgagacttcccacttaattgtcccaagaaatattcgtgctggngnggttagngtccgcgaagagngacnaagtagacggttttctcctgaatggtaataggtgaangaagggtaaattctggggaggtctggaccatagangacattcagggtgactgggtaactgcggatgccaccatatcgggcctgtatttcacattganagggtcctgtttcatttctcgtga

SEQ ID NO: 559365 - DNA, 129 bp, Homo sapiens
tactggtagaagtagatttacgccaaatccatttcgctatcatattcatcggcgtaaatctaactttcttcccacaagccacggtcaacccacaagccacggtcaacccacaagccacggtcaacccac

SEQ ID NO: 559366 - DNA, 419 bp, Homo sapiens
  misc_feature (29)..(29): n is a, c, g, or t
  misc_feature (95)..(95): n is a, c, g, or t
  misc_feature (101)..(101): n is a, c, g, or t
  misc_feature (120)..(120): n is a, c, g, or t
  misc_feature (147)..(147): n is a, c, g, or t
  misc_feature (170)..(170): n is a, c, g, or t
  misc_feature (207)..(207): n is a, c, g, or t
  misc_feature (215)..(215): n is a, c, g, or t
  misc_feature (236)..(236): n is a, c, g, or t
  misc_feature (366)..(366): n is a, c, g, or t
agccaaaatcatgggatatcttttctcancccgtccattcttcttgtgtctctgctttcttttttctggagacagtctctcaggaagctttctcntgggcnccaactcatcatgctgtcnatgatgtcacaggctcacagcccaaanagttccttgtaggaactgagagnttccagccacaaagagattttattcctgctgaacagnttggctangctttttgaatcgtccgactnagaccgccggatccgagttggcgtaatccgccacggtcactcggccgagcaggcgtcgtgggcccggaattgagtcgctttctctcttgggcatggcgaccgtatcggggcgaggcctgctagcggccgngccccgggccatgtctccgccggagagcggccccggagccgcaagccatcgcc

SEQ ID NO: 559367 - DNA, 590 bp, Homo sapiens
  misc_feature (584)..(584): n is a, c, g, or t
tccatggccggtaccagccgcgtggggctgccaggactgccttgggccttatcagggccggcccaaatgtggttgggggaaacctgtaatttccttcttaccaggggttggaattaccaggggattaatacggttctggaaaaaatggttaacctaggggaaattaaggaatttaagggtttaatttattagacgggcccaacttttatatttttagaagccttttggtaacctaattcctttggatcactatttggcatcagtcagggatactggttttcctttggggctgtaatgattaaccattgccgggaccactattttaaatccttacgttcaggggttggtaactgggccttataattaggctgaattatggtttcagggcctacaattaatgggaatggttcacagcctagctcctattaacattggaaattccggatttttaccaacttggaatccttttttagtaatatgttggccttccttttttaaatggtccaaacctatttttaaatggccaggttactaaccactggttcagatccttgcaccaattccagggtttttccgtaatgttnttgggg

SEQ ID NO: 559368 - DNA, 132 bp, Homo sapiens
agcctatcatcttgctcatcaccatgcggattatctgcggtcacatcgtcataggttgtttctggtcctctgttttcacaacggtccagcgataggcactgtactctgacaatccttcttggcacagtaaat

SEQ ID NO: 559369 - DNA, 430 bp, Homo sapiens
  misc_feature (324)..(324): n is a, c, g, or t
tagatgagcggcctatgtctcgacgttatggtatataggaatgctgtgattataccacatgatttggatcttgagatttgctgaagtagcttatcagcttaaggagattcgggcgtgagagaatggggttctctaaatatacaatcatgtcatcggcaaatagggacatttggacttcctgcttttcctaagtgaataccctttatttctttctcttgcctgattgaccgggccagaacttccaacactatgtggaataggagtggtgagagacggcatccctgtcttgtgccagttttcaaaaggaatgcttcccgttttagnccattcagtatgatattgggggtgggtttgtcataaatagctctcattattttgagatacattccatcaatacatagtttatggagagttttgagcatgaagggct

SEQ ID NO: 559370 - DNA, 692 bp, Homo sapiens
aaaccatgaagagaaagaaaaagttaaagcggaaaactggagtggcgaacgacaccttacagctgttgtccgttgcctctgggctgaagtctcaatctaaacgctgctgtgtcagctacaccaactcgcccaccatccaggagggggcaggacaagtacctgataaaactaggaagtacttcaggcagcagaggctagcgacgaacatacttactggtcccacgtgtttcacctgtttcacaaacgtacttggcaggccagccgattgccagctgaaatgacacgttgcccgagcttttaactctcctatatgaccgaaaacttcctcagggttaccgatcagatagatctgacgtgttgaattgggatccacgagttcataagcatgaccccagtctatcaaaatagcagattgcttgagtaacaagacgtacaccctgaagaaacgatcatggagacttagcttgctgagcctgtccagaagatgaggctctcatctccaggtgatgaagtgcactggatgggatactggatgaatctttgcttgaaacctgtccaattcagatcaccattacaagtttttgcacggactgggtggactggctcttattgctgaaagactacccatgctatatccagaagtaattcaacacggtgcagtgctccagttgtaacatctaccactcaggaaa

SEQ ID NO: 559371 - DNA, 786 bp, Homo sapiens
atgggtccgcactacctttatgagctgtagcactcagcatgaaggtctgcagctttactgttgaagctagtgagaccacaaacccagtaggagaaacaaccattctggacctgccacctttgagagctgaacagggtgaaggtctgcagtttcactccttaagtcagtgagaccatgaactcacctggaggaaggaacgactcccgacgtgccacctttaaagagctgtaatactcacagcgaaggtctgcagcttcactcctgaagttagcgagaccacgaacccaccagaaggaggaaactcccgacacatccgaacatctgaaggaacaagctctgaacacactgtctttaagaactgtaacactcaccgagagggtccgcagcttcattttcgaagtcagcgagaccaagaacccaccggtaggaaccatttccggacacaatacattgtagtaactctgtatactgtccccttcctctgtttatttggtggctggctagattattttagtatagtctgttctccctgcttcccctcactatgtcaagctcctcactgtgtccagctcctcaggggaagagactgctgctcctgaagggaaaaagctgagtgtccactgtcacgccaggttgacagcggttttagctaatttcttagttccattctcttattttgggagttcagatatgttctcttactaaaacatacgacaatactttttaaaaactgaaaaaatatgaaataactattggcttcaatattgacattctgtattcaatatt

SEQ ID NO: 559372 - DNA, 142 bp, Homo sapiens
tatgttattcagtttgcggctctcttttcttgagtttgagtaacctaattttaataaagaaataaatggctgggcgtgtatggctcacgcctataatcccagcattttgggaagccgaggcaggcggatcacgatgtcagga

SEQ ID NO: 559373 - DNA, 177 bp, Homo sapiens
tttctaagatcccagtttatttttttaatagtgatggggccgccggggcagtggctcatgctgtaacccagcactttgggaggtcgaggcggtggattacttgaggtcaggagtttgagaccagcctggtcaacatggtgaaaactcccatctctaactaaaacgcctctagcagtg

SEQ ID NO: 559374 - DNA, 339 bp, Homo sapiens
  misc_feature (324)..(324): n is a, c, g, or t
catggtagcccaccctgtaatcccaacactttggaaggctaaggtgggcaaatagcttgagcccaggagtttgagaacagcctaggcaacatggagaaaccccgtctctacgaaaaatacaaaaattatctgggtgtggtggtgcacacctatggtcccagctactcaggaggctgagaggtaggaggattccttgagcctgggaggtcaaggctgcagtgagccatgatagcaccaccacactccagcctggacaacagagtgagaccctgtctcaatatcaaatttagcaaatataattcattcttgctatgtctggccggncgtggtggctctgcc

SEQ ID NO: 559375 - DNA, 565 bp, Homo sapiens
tccgctgttcaatctggatggtgggtgtgagggttgagttaaatagtaggatgccgccgggcacaggggctcatgcctgtaatcccagcattttgggaggccaaggcgggcagatcacctgaggtcaggagttcgagatcaacttggccaacatagtgaaactctgtctgtattaaaaatacaaaaagtacccgggcatggtggcttgcacctgctgcttgagaggctgaggcaggagaaccgcttaaacctgggtggcagaggttgtggtgatctgagatcgcacgactgggctccagcttgggcaacacagcgagactccacctagaaaaaaaaaaaagagtgggcgcagtggctcacccctgtaatcccagcactttggaaggctgaggcaggcggatcacctgaggtcaggagtttgagagcagcctgggaaacatggtgaaaccttgtctctactaaaaatacaaaattagccaggcgtggtgccaggtgcctgtaatcccgagtagctggcttgttcaccttcatctggtttgacctgttccttcctgaagccttatag

SEQ ID NO: 559376 - DNA, 185 bp, Homo sapiens
  misc_feature (181)..(181): n is a, c, g, or t
aaggtaggcgtgtctgtacaagtggttaaatgtgacttggagcagctgctaggggctgaatctgactcagccatttactaactgtgtgaccttaggcggagtctcactctgtagcccaagctggagtggcgtgatctcgactcactgcaacctccgcctcctgggatacaagtgattctcngtgc

SEQ ID NO: 559377 - DNA, 434 bp, Homo sapiens
cctgagagggggctcctcttggcatcgtaatgagcaagcatagcacaaaaagacaaggtgcagacaggtacatgacctcaatgaagaggaagataaaattaggcacaaaagatgaaaccaaaagaagaacaaaggtgatcccatgaaacaaaactggaaaggaaaaatacacaagagcaagattcagtgaacaacaactgctcctctgagaaaagagctggacaaacgttaactgacagaacgagctggaaaccccattcaagacataccacaacatcaacctggaatctacacgcctaacactcaagcagggggtgaataggtgcgacaacagcggaagcagacacagtgcagacaagacccacagggaacaagggggcaaaaaacaagaggacgcaacaagaggggcaaaaaggccccagagaaacgacaag

SEQ ID NO: 559378 - DNA, 506 bp, Homo sapiens
cctaatgcagatatgactttgctgaccagaaacttataacacccaagtccctttgaatacctgaaaagccttccctagaaggatgggtacaaacaagcccagagtgtgaagactacaataaacacctaactcttcaatgcccagacattgatgaacgtccacaaacatcaaaaacagccagcaaactacgacctcaccaaatgaattaaataaggcaccagagactaatcccagagaagcagatgtgtgacctttcagacaaagaattcaaaataactgtgttgaggaaagtcagagaaattcaaggtaacacagagaagggattcagaatcttattagataaatttgacaaataattaaaaagaatccagcagaaattctagagttgaaaaatccaagtgacatagtgaagaatgcatcagagtctcttaacagcaaaattgttcaagcagaagaaagaattaatgagcttgaagacagactgtttgaaaatacatagaggagac

SEQ ID NO: 559379 - DNA, 740 bp, Homo sapiens
cctggaatgacggatggtcctctttccttgcctaacgcagccatggctcgtggtcccaatgaagcatctgaatgcgggtggcagctccaaatgcattgtgatgcttggctaaacttgacctggtgtgttttgctcctcgatccataccacctggtccccacaatgttgagcagacgtgtctccaccctcatcatttgtcctgcaggaacatgacttaacgtactgcccatgacaggacgatgacagtaacagacgactttgccatgcacgcgtgttcattacaactcgagtggccacggtcctgaactgcatatacacctaccctgactggattcatggcatgtcatcagccattgacaacgacgggagagaatttccgtctgatctatgacaccaagggtcgctttgctgtacatcgtattacacctgagcgaggccaagtacaagttgtgcaaagtgagacagatcttagctgggcacaaaccggcaatccctcatctggctgactcatgatgcccgccccatccggctaccccgaatccctcatcaaggtgacatgataccaccccacgactaggatcacgagcactggccacgcactacctgcacttcccactcaacgtaccgccacctggctatacccttgtgtactgcgttgcactgggcgaggcagctcaaaccttcaggccacgaacttcgggatggtgattccatcccatagcgctcgtacgaaggccaac

SEQ ID NO: 559380 - DNA, 147 bp, Homo sapiens
gaaaatgcagaatttgcacactgaggagtaaagagcgggatgactttatcacctggtttgactgtagtcaccccaggtgataaagtcatcccctctttactctcagtgtggaaaatgcagaatttgcaaaaacccagaaagcaacta

SEQ ID NO: 559381 - DNA, 354 bp, Homo sapiens
ccgttcagcagggtcttgatcccctgtgccgtcgactcttactttttcgacggctcccccacccgccttcaggaggggacctagccgggagttacaacgaccaccgccaggatggatagaattaacaaaagatcctctttcgctttaatctattgaagcggattttggacccagcagatgagcccagatgatgtccttgcaaagcgacttaaaataggaggggcatttaggccatataacgtctttaaaatttttgcatttttcaaaaggaagggatttttgcaaatattttaggtgcccacaataatttcccccccccacaaaattgtcagtttttttcataaattattttag

SEQ ID NO: 559382 - DNA, 125 bp, Homo sapiens
accaaccagaacgattcatgcaggactttatttcctattctacaaacagaggatcagtagctgctaaggaaatttaatggacatcatacattatgatccaacgaacgcaagaccgctcttacctg

SEQ ID NO: 559383 - DNA, 177 bp, Homo sapiens
ggccatgctggatacctaatagactgactgatctatctcccaagaaagtctgcattcatgttacaatgcagatctcactgccgtaagcataacggtccagcgctcagtggagaaatgtatacagccagaatgggagggaagggtgagtgggtggtagatcagaaaagaagggggatg

SEQ ID NO: 559384 - DNA, 114 bp, Homo sapiens
tgcaaggagaggggttctgcgctccttatattatttcatatggactaaccattgttatatatgtgcattatacctaatattgagtattaaaggataagtcttaatgctcaaagt

SEQ ID NO: 559385 - DNA, 367 bp, Homo sapiens
  misc_feature (159)..(159): n is a, c, g, or t
  misc_feature (178)..(178): n is a, c, g, or t
  misc_feature (201)..(201): n is a, c, g, or t
  misc_feature (206)..(206): n is a, c, g, or t
  misc_feature (218)..(218): n is a, c, g, or t
  misc_feature (227)..(227): n is a, c, g, or t
  misc_feature (253)..(253): n is a, c, g, or t
  misc_feature (263)..(263): n is a, c, g, or t
  misc_feature (267)..(267): n is a, c, g, or t
  misc_feature (289)..(289): n is a, c, g, or t
  misc_feature (326)..(326): n is a, c, g, or t
  misc_feature (333)..(333): n is a, c, g, or t
  misc_feature (337)..(337): n is a, c, g, or t
  misc_feature (347)..(347): n is a, c, g, or t
  misc_feature (350)..(350): n is a, c, g, or t
  misc_feature (357)..(357): n is a, c, g, or t
ggccgatggtgaaactttttgagaccccctatggcctttttgtcaaaaccttccctggagctcaaaaaaagcctttttgttgtgttatttgcagggcagatgatgtttgtgtaaccacataatggttattcccccttttttgattttgatttttgctgngttatcaaaaacttgaatnctgtgagaaaaagtgaattttcngttgncgaatcagcctnttgttcccntggtgataaccctaattgaatatatntatgagggcntgtnttagttaatggaaaaaaaaatncccccctaccatacatagctgcaatgtgtccaatggntgatttnattnaataaaatgnccnagtgttnaatgaggcca

SEQ ID NO: 559386 - DNA, 419 bp, Homo sapiens
  misc_feature (159)..(159): n is a, c, g, or t
  misc_feature (178)..(178): n is a, c, g, or t
  misc_feature (201)..(201): n is a, c, g, or t
  misc_feature (206)..(206): n is a, c, g, or t
  misc_feature (218)..(218): n is a, c, g, or t
  misc_feature (227)..(227): n is a, c, g, or t
  misc_feature (253)..(253): n is a, c, g, or t
  misc_feature (263)..(263): n is a, c, g, or t
  misc_feature (267)..(267): n is a, c, g, or t
  misc_feature (289)..(289): n is a, c, g, or t
  misc_feature (378)..(378): n is a, c, g, or t
  misc_feature (385)..(385): n is a, c, g, or t
  misc_feature (389)..(389): n is a, c, g, or t
  misc_feature (399)..(399): n is a, c, g, or t
  misc_feature (402)..(402): n is a, c, g, or t
  misc_feature (409)..(409): n is a, c, g, or t
ggccgatggtgaaactttttgagaccccctatggcctttttgtcaaaaccttccctggagctcaaaaaaagcctttttgttgtgttatttgcagggcagatgatgtttgtgtaaccacataatggttattcccccttttttgattttgatttttgctgngttatcaaaaacttgaatnctgtgagaaaaagtgaattttcngttgncgaatcagcctnttgttcccntggtgataaccctaattgaatatatntatgagggcntgtnttagttaatggaaaaaaaaatncccccctaccaatacatagctgcaatgtgttagttaatggaaaaaaaaatacaaccctaccaatacatagctgcaatgtgtccaatggntgatttnattnaataaaatgnccnagtgttnaatgaggcca

SEQ ID NO: 559387 - DNA, 405 bp, Homo sapiens
gttttagtgtttctaagtagagacaggtttcaccatgtaggccagactggtctcgaattcctgacctcaagtgatcgcccgcctcggcttcccaaagtgttggtattacaggcgtgagccacctcacccggctgtgttttcatttctttataaggcaggtgatgtcggctttacatatacagtagtactttacaattatctttttttttacgccaaacaaggaagtcagttttcaacgaaaaatataaactagctgtgtacctggctgtggttaaaaaaaaaacaccaccccccacaccgtgggtattacagaaggtttctgacttaattattacggacaatcatcggttttatggattctatgtcaaggctcacttactggctcattcccattacatatgtagc

SEQ ID NO: 559388 - DNA, 161 bp, Homo sapiens
tgctgcgcgtctcggtgtgactctcagttcacccagctggcttggatcaccaccccccggaaagagggaggcttgggcccctgaacatccccctgcttgctgacgtgtaccagacgcttgtctgaggattacggcgtgcggttaacgctgtgaagtggagg

SEQ ID NO: 559389 - DNA, 196 bp, Homo sapiens
tcagttcaaagaaatcagctattaccagacagtgccagttcgtgtccccagtgcatgtattaccatgcagtgatcatagctcaaagcagctcgaactcctgagtgctactagtgatcctctcgtgccttagcctcccatggtactgggcttataggcgtgggccagtgcacctgattggccagcaaggaccttctt

SEQ ID NO: 559390 - DNA, 378 bp, Homo sapiens
  misc_feature (114)..(114): n is a, c, g, or t
  misc_feature (256)..(256): n is a, c, g, or t
  misc_feature (311)..(311): n is a, c, g, or t
  misc_feature (368)..(368): n is a, c, g, or t
  misc_feature (370)..(370): n is a, c, g, or t
cggaatctcactctgttgccaggctggagtgcagtggcacaatctcagctcactgcaacctctgcctcccgggttcaagccgttctcctgcctcagcctccagagtagctaggnttacaggtgcgcaccactatgcccagctaatttttgtatttttagtagagatgggtctaaccatattgcctaggctggtctcgaactcctgagctcaagcgatcctcttgcctcaacctcccaaagtgctggggattacagntgttgagccaccgcacccggccgcattcttctaaaatcacagtacatctgggttnccagtggcccaggggttttcaggggcagaggggttccagtggtgattcaattttggnanggggcctt

SEQ ID NO: 559391 - DNA, 181 bp, Homo sapiens
  misc_feature (79)..(79): n is a, c, g, or t
  misc_feature (82)..(82): n is a, c, g, or t
cacctccccacactgacaatctttgccacccccatcctgtgctgtccacctcctctcagccagaggaggctcttgggcntgnagaacacgtgtgtctctgtgtatgtgtactgtgtgtctgcgtccgtgtctgtcagactgtctgcctgtcctaggggtggtctaggatctggtctgacca

SEQ ID NO: 559392 - DNA, 268 bp, Homo sapiens
gagcaatagagctagagtctgtctcataaaacagaaaaaaaaaattagccaggtgtggtggcatgcaactgtagtaccaccatactctggaggctgaggctggaggatcacttgagcctgtaaggtcgaggctacagtgagtcatgatcgccccacggtactccagcctaggcaacatagtgagaactcatccttaaaaaaggaaaataaattagctgggtgtggtggtgcccacctatagtcccagctcttatggcccaggctggag

SEQ ID NO: 559393 - DNA, 478 bp, Homo sapiens
aaatttttctgtatatagaaaggaaaactagcttgggcaacatgatgaaaccccatttcctctgcaaaaaaaaaaaaaaaaaataagaaagaacaaaacaaaccccacaaaaattagctgggtatgatggcacgtgcctgtagtcccagttactcaggatgattgattgagccttggaggtggaggtaacagtgagctgagattgtgccactgtactctagccagggagaaagagtgagatcctggctcaaaaaaaccaaataaaacaaaacaaacaaacgaaaaacagaaaggcagcctgcaagagaatgacaagctggggacaggacaataaaaataaacaaggaacagtgtttcctttatatttgaatgacactatgaatgcctctaagtccttgaattacacttaaaatgagccaactttttttttaccaacttccctcctatttccatgggaaaaaataaatattcatcttct

SEQ ID NO: 559394 - DNA, 409 bp, Homo sapiens
acttatccctgagaggctgctgtcaggatgcctggtccctttctggcaagcagcaggtagctaaagaaaaccagcaggtagcaaaggatgtcacactgcatcaggccttgctgcggctgccccagtatcagactgatcttttgctcaccttcaatcagcccccgtgtcacagcaggtctcttggccctgaaaatctgtcatgtccaccttggagcctgagtaactttgaacagctggtaactagtttgactcttcatgatcccaacctctttggtccccagtaaagaaagttgagacacaacgtgctactgaggactcggggacccagttatgagagggggagtttctttctgcttcttccctggatgtaaacataagacacttcctctgcagaaataaacttgcttta

SEQ ID NO: 559395 - DNA, 282 bp, Homo sapiens
gatctggttggcactgctgtttgagaaggcgcgtgagctgtgctgtctggtgactactgagcacttgaaatgtgactagtgcaactgaggaagtgaatttttaattttgtttgtgattaatttaaattcatattcaaataggtacatggcactagtggctactgtactggacactgcagctagagaacatttccatcatcacagaaagttctcttggccagcactgctctagcaatctcattccacgactcccattggactcgccgacatctctgaacaagt

SEQ ID NO: 559396 - DNA, 145 bp, Homo sapiens
ggtcgcaagagtcccggccaccggtggcgtcaagaagccccaccgctgcaggagggttgcgaggcctacctggtggggctatttgaggataccaagctgtgcgccattcacgccaagcgcgtcactattatgcctaaagacatcc

SEQ ID NO: 559397 - DNA, 490 bp, Homo sapiens
  misc_feature (220)..(220): n is a, c, g, or t
  misc_feature (425)..(425): n is a, c, g, or t
  misc_feature (486)..(486): n is a, c, g, or t
taagatcaaaaacttttaatttccaaacatatattgagcaaaaaataattaaaatcccagcagcagcccttttttcctagaggaaaaaaaaaaactacaacgtatatctaagggagagaacatggcggtgtgaggtgaaagatggcagtttatcctcagcttcttccaaccaagcatgaggacagggaatctcctcatccacagctttgaaggccaaagntcagcccttcctgaagagctggggtccctggtgtatagagagggttacctagcaggacaccgtgcctgcctacaactggtcgtccagtgcctgcagccctcagagaggctccctgggcaggaggagagggaggcatctgcagcatctttgagacagagttcacgcctctgtggtagcccgagcagaggtgaaaacacactttttnctgtttccagccgcttcttcctggaaaagggggagcaatggttcatgggagtgacttagcntcct

SEQ ID NO: 559398 - DNA, 1044 bp, Homo sapiens
cgcgtcatggggaacgagcagacatcttcaacgaggaggacctagacgactagcaggactgcgccttcttcaataagaaggagcttcctcaagctgtattcgcgattctatgaggctgggccccaggctcgtgcccaatggactacaggaagagccccgatgcgtccaagcgatgcccactgaagcgccatcaatacaatccagatgccagagcctcgcgcgcgtagaatcccgttgcgaaccgcacagagcgatgcgtgcggcgagccgctgtattccgacggactggtgagaggagaaccctcaacatttcacatcggatctttgtggacatgtatactcgtgatcatgcggagatcgttactcccacgatgcagcttcaagagacaatacttattgcgcttcaagtatctatgaacttcaaactgcatgtacatagcttcaatcttgctagagggaaggacctggagacttgactgctggccccggactcactaaagtcagagctggctagaggacgggaaaagtcggtgcttgtcgtagctcaccacaggtcattagaaatgactgctgacttgagacggtgaccgggaagctgggctttgctgactcccgaggacttgattgccaatgcccctgactttcctcatacaactttccaccatcccggatctgagagacactgccgagggctgtcggggggactacgaaatgtcactcataccctgccctgaggttcaccctggggtgtgagccttctaatgctcgccaggaaagcaggagaacttgccttctggggttttactcctccaaatagtattcctgtggccgttttagcaagagaaaccttaccgggacgggcctcgaaggttagggccttccccagacccttggcgttcaccccgaccatgcactacccggccccgcaacccttggtccccatcttttgcaaattggtcggcgcacacgagacctaactccagaggctaactaaacgcaaccgtcacctggaacaccctagatacttatcagtcacctcctatg

SEQ ID NO: 559399 - DNA, 181 bp, Homo sapiens
gatctaacaggctcccggtccaggcactgcacagcctcccaggctccggcagtcctgctcctggcttttgccctgctctgcctgccctggcttccaagcaggctggtgccgtcccaacaccggttcctgttcacccaggcttccagtgcctgcagggtcacgcagctcgcacattctgtca

SEQ ID NO: 559400 - DNA, 157 bp, Homo sapiens
ttctctgatgctccagaagcagaggtgagtgggtcgagatgcacactgcactcagcctggtgacagagcaaggttcatccagaaaaaaaagtcactgaatgaattccctgcctgatggcaaaattaaattacagactgtctggctgtgaggttgaca

SEQ ID NO: 559401 - DNA, 245 bp, Homo sapiens
  misc_feature (35)..(35): n is a, c, g, or t
ggagcacctgctgtattaagacctctacttttgcnatatgtagcaaattagattcttgcaagatgagctaacattaggaaaggtcctattatatttgactttttttttttttttaaataaaaccacttttgcttggcctcggatgtatcagttctggataactttaaagctggtaacagaacaaactgtgttcacacacaggaaatgtctccaaacaaaaagtgggtgtgcagtttacagtttaa

SEQ ID NO: 559402 - DNA, 376 bp, Homo sapiens
tcctccttcagctccatgtccctccctggtgccccaactgcatcgcctggtgctgctgcctaccctagtctcaccaatcgtggatctaactttgctcctgagactggacagactgcaagacaattccagacacggacaggcaaaggtgggggtgtcttgccccagtggcagggccagcagcctcatcatcgttcaagttctagtgagcaacatgttcaacaaccgccagcacaacaacctggcccgcctgagggctttcaagaaaatccggcccttcctggaaaatcaaaccaccagctccaccattgaaaaattccctgatctaactatgtttccccccttttcagaatagaactattggggtgaggataagggg

SEQ ID NO: 559403 - DNA, 477 bp, Homo sapiens
aggtgggccaccccctcccttcggggtggaaattttcccttcttggggagtggcaaggagcgtggtttctgggtttttgtgtcccctcatggccaattcccttgggaattagggtgggttccctgtaaccgtttccataaggatttgtcccgtgttttactggggggtccccgcccataaaggccagtggggttttttggggccctttttggggggggggtgtccccccaccggaaagcccccttctcgggaccccctttcccggggaaagtgtcctaccattttggggaccccttttgggggtggggtttttcccccttccgggttttggccttcccccaaatcctttggggtttgggccttcccccccccccgttggggcccctccccttttttgggcccttcattaaaaagccttttccccccttgaaaacataaaaatgatttggtgcctaaaataaatacaaatgtccccca

SEQ ID NO: 559404 - DNA, 113 bp, Homo sapiens
gcccccccccccaggggccccccccccccctgggggttttttttgggtttggggggggggggggctttttttccccgggggggggatttttcctttaggggtttggcctttta

SEQ ID NO: 559405 - DNA, 1096 bp, Homo sapiens
tagcaaataaagtagacatgatttggatagttggtggcagttctgtttataaggaagccatgaatcacctaggccatcttaaactatttgtgacaaggatcatgcaggactttgaaagtgacacgtttttttcagaacttgacttggcagaaatataaacttctgcctgaatacccaggtgttctctctgcagtgtccaggaggggcacacacatcaagtacaacattctgaacgtatgtgagaaggatgacttacactatgaaggtgttttctggctttaaggttgttcccccgtccctctgagccaccaagtcatgcagtttctccacattcagcaaccagcgcgacttcttgttggacttccgtatctcatgcgcatacgtccattgctctgaacgcaacgtgctccggcagtgtcctgcactcactccttgcgctcatatccgcatctctcatttcatcgaaccccatctccttgcgtcgtgccctggtcgtctccgcagagccccgccctggagtcccgccagcgccgtgcttaccgctcgagctgcccattccactcccactcacatgtggctcctcttgtccacctccttgacccttgtcacggcctctcctccctgctccgcgctccgttctctctctccccgattcgacgatgccgcgtacccctctcagcctcgagcccgtttcccctagcttgcgccgctaccaccggctccggtacatgttgtatccccgaggctccgctcgacccatgttgccgccgtcctgcgcccccgggcaccctcgcccctgcccggcactgtccccttgatggggcacacttgactcttctctcactggctctaccactcggcgcgcaaccgtatgcctctatttccagtactctgttgatctcgctgttgtcatcctcacttatcacacccacgttcgatcccctacgccccctccctcgccctcgtcgccgaccgcgcacctggcccgggccacgccgctgtacatcgttgcgctccgtctcccgcctcatgccccccctccgccaatcctcagtgtccgcgtttcacctctcctatctgcccccttccgcatccc

SEQ ID NO: 559406 - DNA, 1303 bp, Homo sapiens
ggagaaatacaggtacctagcagctcgtcggtgatctggggtgagagatgtcaccttataagagtggctctgtgcatgcttgtgtggggatacttcgctgtttagcacagaccacccgtgacctagccagtgagccacacagggccccatgtggctctttcatgtcctcttattccgttgcctcctctctcatggaagcacgagggtgcctctattccttgtccttgccgttctagtcgacacccagcgtgtggcgctttctgaggctcttgccatcatgagggctgctgagtgctcggtagtgtcgcgtcccacgacaagtacttgaagcggagaccagcaggaaaattcgagagttgtggctggtcccaaacattaatgcaggtgacttcattcgtttactagcaatttacttctcgatgcaattcgtatttgtggatgactcgatctcgaccgggacctgaagaatgcgctgtggcagaccccactatgagtagagggaggattcgctttcacctttcacccttgcgtacttcctttgtgcctttgttcctcctgcttcttctacaaatagctctatccgttaaagacgattctacattgcgcctgttgcaggcatggggttgtcgttggttgaagccagttcctgtggggatctccgtctccgcagcccatttgtgaattggagaaaagtggctggaggtccaatgcttccctgggtcgaagcatcgggcatcagttggcccctgggctagattggttggggcctgccgcatggacgcaaagtggtttggtttgcctagaaccgcaacccaagtttatcctttggttggactttcggaccgcacgtgtccacccggccgaggggccccccgcaatctttgcgcggtttgaataaggggacactctgtgtgcaggagcgttttcggttattcgtggtccacctttggggagttgttctaattgccctgcgtcaattattgttcctcttaaactaaaaattgtccccgaccaaagccttttttataagtcgtggagacattgtcttgtgaatttatttgcgcttgggggaggacgaagagaaggcataaacgacagaattgcggggtccagacatttattcttggcgaccaggaaagcaggtggtaaatatagggagctgggcgcgctctagtgaagttgcacaatagccatatatgagaccctctcctccgaaggagatgattatgagcgggagtttttgaggtttacaagagaagagacactatatagggtaggagagtatataggcaagaacaccata

SEQ ID NO: 559407 - DNA, 1045 bp, Homo sapiens
  misc_feature (368)..(368): n is a, c, g, or t
ggtggtgtgccaggcagttgggtatgcatcaggcgtggagcagtagaccgacgtgggagggagccatgaagcattacagaggtggagattctggatgcgagagcagcatgggagcagacgctggtgtttcttggatcgatggtggagtctgcatgccatcattgtggtagatcatgaatctcttcattattaaccatccgtagtggtatccccgtgcgccagtactcgtacttgccatggcactgccaaaggtgcccagttgcgccatgagatggatgacgtgatgatatctgcaaaaatgcgttgcactcgatagtgggcaaacatcgcgatcaaacatgtatcttaccgaggagactgtgggcgtnccaagattcaagacttggggtgcacagtggtcttcctatgcagagtattgctgggaggtccatttgtcatttatctgcatctattctaactatccgatgtgccctctcatcgaatagggccggaagactaatagaaggtttcactgttcccatgcttggggcactatccatgtgtggtagtcaccctcgactcgtgtcagtctgttcgagctctagtatccaactacaatacaaagtggcctgcctgggatgacgcatcttcgtgcactcggcttctgccatggcaataggtcttttgccgcaagatcttcgacgaacctgtgactactacgtgtaggtcttcgacggagtggattagcctatgtacatcgactcttccctctctacatcccaccttagcgttcggcagctcaggaggtgatgacgtggtgctcggcgtcttgtgtgatctgacagttcggcctgttctttccatccacatggccctgcggttgactgaggcctgctttggtcttggacggggaagattccgtacttgcacttgagagcccttcatgtggtgttctggtgggtctgccgacttcctaagagtggggccggatccgttccgcactggggcctgttccgggccctttctgttgggttcccgatacttggccggcaccgcggccctgggt

SEQ ID NO: 559408 - DNA, 162 bp, Homo sapiens
atagagtgggctgcgagtggggcattagtgcctgtttgagcggggctgcatgagtggggcgccgagtggagcattagtgccgatggagcaggggccagtgccgatagagcagggtgcctggggcctgatggagtgagtgtgctatgtgctgactggagcact

SEQ ID NO: 559409 - DNA, 279 bp, Homo sapiens
gctgacttagagttaccaccaacattggcctcgaccatgtcaagaagaaggtgctcgacgatgccgacaaccgcaaggcgctctggtcgcggttgcagttctccctcgagggcgagcccgatccctggttcgagttcgacaaggcgcaggtcgacgcgcgccagttcgagccgttgtccgtctgagcccgccacccgcatcgagacactggagctgcatcatgagccaatggaaaccgatctgccgcgtcgagaccaatgttggggggtcctctagagt

SEQ ID NO: 559410 - DNA, 443 bp, Homo sapiens
taattctggcttgttaattaccagatatatatctatatcatcttttttgtttgttgtgtttgttttgtatgagacggggtctggctctgtcacccaggctggaggtgcaacggcgcgatctcagcttaactgcaggctccatctcctgggctcaagcaatcctcctacctcagctgcccaagtagctgggagtacaggtgcttgccaacttactcctaactaattttagtattataagtagagatggggttcaccatattggccaggccggtctcgaactcctgacctcaggtgatccgaccttgacctcccaaagtgctggtattacaagcgtgagccacgtgcccggcctattacatatttaaagatggaggatagagaggtaggtactcttccagttgccagcagaatgttggttggatcacagtcaagccaacctaaca

SEQ ID NO: 559411 - DNA, 292 bp, Homo sapiens
  misc_feature (137)..(137): n is a, c, g, or t
  misc_feature (158)..(158): n is a, c, g, or t
  misc_feature (194)..(194): n is a, c, g, or t
cgggctgtttgtttgattcctgtgcctagtcgcggctctatattttgttttttccccgtgttcacaatgttttcagtggggggcccctttttgggtccctttttttgcaattacttgaagacccccacgctaaaaantgaatgttacttgtgcttgcngcttgggtccaccttggggccggtgtttgaattaantaagttcctttaacggtaatatttccggcaaaatcccatggttgggttttgtttttaaccttgtaacgcttgcaatcccaataaagcattaaaagtca

SEQ ID NO: 559412 - DNA, 271 bp, Homo sapiens
gctgacttagagttaccaccaacattggcctcgaccatgtcaagaagaaggtgctcgacgatgccgacaaccgcaaggcgctctggtcgcggttgcagttctccctcgagggcgagcccgatccctggttcgagttcgacaaggcgcaggtcgacgcgcgccagttcgagccgttgtccgtctgagcccgccacccgcatcgagacactggagctgcatcatgagccaatggaaaccgatctgcgcgtcagccaatgtggtgtccactact

SEQ ID NO: 559413 - DNA, 275 bp, Homo sapiens
ttgcgcacagaagttagttaggtgagtgatcccgtcgggcttgctaaataatatacgagtctagcctcatattttctcatcagttctacagtctccttcctatcgtcatcccactaaagactgtcaataatcatttcctcaagctgctgctgtcttagctcaacgccatgctgcgtgccatcccactggttcttgaccctttccaattttgcgtgtaattgctgttctcatatctgacctgaaagcttcatttctcaatttctgtgcccgttcca

SEQ ID NO: 559414 - DNA, 181 bp, Homo sapiens
tggcaggatagcgggtgacggtccggctgtggatgatctctaccctgggatggtgggtgggtatccctgtgacgaggtagggatagggcggcggcgggggcgcggcggggatggcgccgtagccgtgcgggccacacgagtagtcgccctggccggcctccaggttgtaggcgggcggccg

SEQ ID NO: 559415 - DNA, 417 bp, Homo sapiens
gcccgagcaagattggaggaaatactataaagtggggcctcttgattttggcgggactcagaaacagaaacaacttttcattgggggagaagcttgtctatggggagaaaatgtggatgcaactaacctccctccaagattaaggcctcgggcaagggctgttggggagagactttggagttcccaagaagtcagagatatggatgacgcctatgacagactgacaaggcccccctgcaggatggtcgaacgtggaaaagctgccccccctctttatgctggatattggaaccctgagaacatgtaaaaaaaggagggggaaaaggccccagccatttggactaccatccactttattttggaatcatgtaaaataagaaattaggctgttttttgaataaaaaattttatgatgga

SEQ ID NO: 559416 - DNA, 101 bp, Homo sapiens
aatttaaaaaccttttatttcctttttttgtttgattacattaactagggcttccaattatattaaaaaccattttttttttttcacttcaaaacccccca

SEQ ID NO: 559417 - DNA, 137 bp, Homo sapiens
ttcctcccccaccgcccgtcagccgtgcgtgcggtgacagacttttcccacaccctcaaagcgccttcccacaagtgctaccgaactgctcacaccccttgaacgaggctgttcctacgtccttttcgggtctatcc

SEQ ID NO: 559418 - DNA, 327 bp, Homo sapiens
  misc_feature (197)..(197): n is a, c, g, or t
cgcctcctgggttcaagggattctcctgcctcagcctcccaagtagctgggactataagcatgtgccatcatgcctggctacgtttttaaatttatttatttgttgtttgtttgcttattgggacagattctcactctgtcactcaggctggagtgcagtggcactatcatggctcactgcagcctccacctcctgngcttaagcaatcctcccacgtccacccccttagtacctgggactacaggtgtgcaccacctcacccaactaatttttgtattcgctatgtttcccaagctggtttcgaattcctggggtcaaatgaacca

SEQ ID NO: 559419 - DNA, 347 bp, Homo sapiens
gcccaggttggagtgcagtggggcgtgatctcagctcactgcggagtccgcctcctgggttcaagtgattctcatgcctcagcctcccagttccttgggaggctgaagtgggaggctagcgtgatcccaggaggcagaggttgcagtgagctaagatggcgccactgcactccagcctgggtgacagagcgagacctgtctcaaaaaaaaatactgaggattcagggttaactagatcctgcaggccataacctccattccagttgttactttattggtgttttagcatgtataggtagtaattatgggtcttgtccagttctggacaggtttcaaaacatggggtt

SEQ ID NO: 559420 - DNA, 814 bp, Homo sapiens
gggggggcggggccgggccgtgggacgggcggaggcgcccgagtcccgcttccccgggcccttccaccccgagcccgactcagcccgcggcacctggccccgccctgtcggccggcgccctgagcccagcgcctgcgagcctgttcccctggctgggcttggctcctgggccccgggaaggcagcggaggtgttcaaccttagcggcgagtgggctccagtctccgctgggaacagaagctgcgcggcccctcttgggcctcggccccggggatgggggcttccccgggcgggcggtccccggaaggcatttttccgcggcgcgggagtgagaaggcggtgccctgaagaccccgggcagaggtgattggcacccagccccccgggggccggacaccaaaacgcccggggaaggactaccggacggtggtttgctggagccccccgggaagcgcggcaaagacagccgtggcgcggggaaacgcccccagggcattcggcttggaaaaaacggggcggtgggccccggcaggcggaagggctcggaggagcatcccgcctttggaaggggagccttggcgaggctggcacacaaagcaaagggcagcgttcagacgatgaacaccccatgaaaaacaggattttacacgtggagaagggggttctcgtaaacattgccggggccgtgtctatgatagccactggtctgtccatctctggggaggcgacttccttcttgggagaggccaggggagaaacccccatctccattcgacacacgagcatccattcggaaactcagggactctttagaa

SEQ ID NO: 559421 - DNA, 407 bp, Homo sapiens
agtcataacctcacagtacttagactgtagacttattagtggctgtagatattattagttcagaagaggtctactacagtacagtgggtcgcgaatccaatatggctggtatccttagaagaagggacagaactgggcacagtggctctagcctgtaatttccagctacttgggaggccaaagtgggaggactgcttgagccaaggaatttgagattgcagagaccaaggattgcagcactggactccagcttgggcaacagagagagagaccctgtctctaaaaacaaaaacaaaccccccacttcatagagacaacttggtgcatgcacttcataacgaggacaaattggttcccttacaggcttgaggtggactccacatgactactttaaccagtcattgttg

SEQ ID NO: 559422 - DNA, 418 bp, Homo sapiens
atacattttagttttgacaacaaagtaaatccctctttgcccaatttattctcattataaagtaagaacaagatttccaccttaaaaaaagctctttaatagacgaatatagctaaaccactgttaacgtaggtcttgtagtgagatacctgctagaggctatattatatgaccaacacactattattatgaaactaaggacctcaatatggccaagctgttgtttaatttgtattggggggaaaaggcagtttaaaagatggaaacattgattgactttcatcagaatccatgttattaacagagtttacaaggcagaaatgtagggtttatagtctttgttgttaagtaaattgacttatatgcctcttaaaatggggaagaggtgagcagcatgcatgttcacaggaccataatg

SEQ ID NO: 559423 - DNA, 1002 bp, Homo sapiens
cgaatctataagaaaggtgatattgtagacatcaaggtaaacataaaattgggaaaataacactacagaagatagaaaagttggatttaatctagtgtaggaattcaaatactagtgtatgttgcatctgtaagagtatagaatggatttttttttttttttttttttttgggaaagggagttccactctgtgttggcctcaggcgggagttgcaatgggcatgtgattctcaccttcaaccttccgccttccctctcccggattcaagcagttctcctgtgccatcagccttcccaaattagcggggaatacacaggcgttgcaccattgaataccgggctaaatttggtattttatagataaagaaggtggttttcctccagtgtgggctcaggcgtggtcattgaacaccttcgggtgatctgcgtggactcagcctcccaaggtgcggggatatacaggcatgcaccagttgatcccgggctaatttggtattttagtagagaaggggtttctccatgtgggtcaggctggtcttgaaccacctcgggtgatccgcgggactcagcctcccaatgtgcggggataattacgggtgtgaaccaccgtgcccggcctaaaagggatttttaaagggtgctatcttagcagaattaaatttcctcattacccggtgggagtaacagctagtggacattggggtgggagggggcgacatcatgagttcaccaggtgggcaaggaacgcctttgggcagaggtctattactggggaacattctctacgttggattaaaccctcctagggaaggtggtcttcgtggacggtaaggtgtttggacccggataagagaagggtttgaatgggaaccagtgtgaacttccggctcgtaagctgtgtccctgaaacttaaactcactagagaagacggggcagggatacagctgtaggggcgtacagcacagctcagagtcattacggggtgacacagggtgtaaccc

SEQ ID NO: 559424 - DNA, 202 bp, Homo sapiens
agatggagtctgagggggggtgcagatgactcttctgaggagggggacctacttgatgataattaagatcggggggattaccagcttgagtttatcaaggatgatgaaaaagaggcttatggaggagaggagttacacagacagcgccacttgcagggagtgtactcttaagcacatatgtgtggggtatgaatctctatct

SEQ ID NO: 559425 - DNA, 658 bp, Homo sapiens
tgtgggcgcgctgctggaacctccggctgtcgttgcgcttacagttcctaaccccgaccctgcgcgcagcccgcactatggcagccccgccgcagctaagggctctgctcgtagtcgtcaacgcactgctgcgcaagcgccgctaccacgctgcgatgcccgggctcacaggtactcgggagattgctggaaccggagccgcagagcgtgcccctaacgcgcagtgcatgaccgtactctaccgggatggcagcctacaggagaagctgtgggccatactgcaggccacatatatccactcctggaacctggcacgggttgtgttcacctacaagggtctccgtgccctgcaggcctacatacaaggcaagacctacccagcacacgcattcctggcggacttcctcggcggtatccaggtgtttggagcaataacatcaacaggcagatcaacatgtacctgctgtcacgcgtcctgtttgccctgagccgcctggctggagagaagggctacatccctggacccaggtgggacccgttcccagtgatcactgcggagctgtggtggctgtacttaggctctttgagtatcaccgaaccaccctgaagccctggctgagtcctccagacctaccttatgaggccagcggtggccgcc

SEQ ID NO: 559426 - DNA, 208 bp, Homo sapiens
cgcggtccgggcgggccgcttgcaactcaacgagaagccggtgcaggacctcaacatcgtgctcaaggtggagtcctgatggggctggccagaagcgggcgaggaaaaggggccgggttttgttttgttttgttttgttttgttttgttctgttttgttttttagtcttagtaaagcataggtactggattaaaatcatggcaattct

SEQ ID NO: 559427 - DNA, 190 bp, Homo sapiens
  misc_feature (116)..(116): n is a, c, g, or t
tgtgtacgagaagagctcaggtggaaaaggagggagctactctcaggctgcgtccagcgacagtgcccaggactctagatgtgtctctcacagcttgaacaaggcctgagacagcntgtcttagtgagtggacttgagcatgcagtgatttcgttcactgcctcccactttgtgtacttcaatgagcctc

SEQ ID NO: 559428 - DNA, 84 bp, Homo sapiens
cattggctaagcggatgaggggtgcaggggaacagtgaaaaaaagcatctttaaggtcaagaacggaatcgcctcagttgatag

SEQ ID NO: 559429 - DNA, 458 bp, Homo sapiens
  misc_feature (10)..(10): n is a, c, g, or t
  misc_feature (15)..(16): n is a, c, g, or t
  misc_feature (21)..(21): n is a, c, g, or t
  misc_feature (23)..(24): n is a, c, g, or t
  misc_feature (50)..(50): n is a, c, g, or t
  misc_feature (83)..(83): n is a, c, g, or t
  misc_feature (105)..(105): n is a, c, g, or t
  misc_feature (193)..(193): n is a, c, g, or t
  misc_feature (241)..(241): n is a, c, g, or t
cgtaccctcnacctnntgtancnnggggagcattctataggcgtggaagntaaaggcgtgagccatagtggagctgatagaanagaaaatgtaggcataagtaangataaggcaggcgagaaacctgcccgccgaaagatcaaggtttcctcagctatgctaatcagctgagggttagtcggggactaacgcncacccgagaaggggaagtggatgtacaacaggttaatattcctgtacnattaatctaataaaagtgacggaacgagataactaccgcgtactgacggaatagtacgttaaaggagcagttatagctttgatagtacactgaagcttcggccgaggtgatagagtggtgacaacgtttccaagaaaagcgaagattaatgcccgtaccgtaaaccgacacaggtgattgggatgagaattctaaggcgctcgagagattcatggct

SEQ ID NO: 559430 - DNA, 432 bp, Homo sapiens
aatgcgctgagcgaggctttacaccattacatggctggtaccatgagaactattcctatggcgcgggatcacgatgcagatgggatcacagctgaggacatgtaccacataattgtaacaacacatgcagtcactcttcaccccacttcactgctttgacgatgaggtatccatcttttctttaaccagaggacgcccatggggcagatctgaatgcaacggtctaccttacctttcatgatagcaacttaaggaatagcacataggaattttcttaattcatacaaagtttataatcatatagaattactactgttattacacacacacacacacagtcctctcgcaatcttaagacaaaaggctttcttagaaactggtgtggatctaatgccatccaagtattattggcggcgtttgtatgctgaactg

SEQ ID NO: 559431 - DNA, 339 bp, Homo sapiens
agtcacaccaggaggaacctctaggtgggacaatgacaggatcaactgggatggcaggaagggtaggaaatgtttacacaaggaaaatctgaaaatcaaatcttttttttgggaaaagggcccccgtttaaacattgggggaccgaccggcccaccgaccttttttttaaaaccctttaaggggtgcacccgcctttgggggaccctactaagaatttgggcttgttttttaatttagggggttttttggttttttttggaaaaaaccctgagaaaaagaaatccttcccataaaccccccacgcggccctcctggaattctttattttgatgtttttt

SEQ ID NO: 559432 - DNA, 348 bp, Homo sapiens
cccccctttttgccctgggggccctccactccccttggagtttggatggacccatgggcccggggcttttaaacacccccccttttaattttgggttccccccccctggaaacccccgattggggccccgggggaagcctaggagagccgaatccgtgttttttaaaaggcaggcctggcccaagtgccaaccctccggggttcccgggggcccaaaaaaaaacccagtcccctttgttaaaaggccgggctggcccaagtgcccaccatccggggttcccgggggcccaaaaaaaaccccagcccgctttgttgggatttgtttttttttaaaaaacccttggccca

SEQ ID NO: 559433 - DNA, 391 bp, Homo sapiens
gaaccctgggggaggggggccctttcccccctgtgttttttcagaggaaaaaacaccgggagggtgttggggttttcccgggggggggggggccccccttgggccccgggggggggggttttttttttccccaggggggttttttttttaggggggggaaccccttttttaaaggttttgaaaaagggggggggggggggggggggaaaatccttttttttttttttgtttttttggggtccttttcccccaagggggtttttgccgggggggggtgggggggcccccccaggggggggggggccttttttttcccggggggggggttttttcccccccctttccccgggctttttggccccccccttttttttttttttgcccccccgga

SEQ ID NO: 559434 - DNA, 350 bp, Homo sapiens
agggtaggggacttattttctgagacagggtctcactctgtcacccaggccaagtgcagcggcactatcgtggctccctgcagcctcaccctcctgggctcaagcgattctcctgcctcagcctcctgagtagctggggttacaggcacaccaccacgcccaggtaattttttgtatctttagtagagacgagatttcaccatgttggacaggctggtctcaaactcctatcgtgatccgcccgcctccgcctcccaaagtgccagaattacaggcatgagccaccgctgccagccaaatgtataattttttaaattcacactttggtgaactgggttaactgaggaaaa

SEQ ID NO: 559435 - DNA, 435 bp, Homo sapiens
tatactttggaaattatattctagtagtatattcaccaacacactttgactaacatttaagcagatatcataaatccaaaatagggaaagacaggcaaatacactccagaaactaattttgaattgcatatgtagttttctttgttatttttctaaagcaccattattattactattagaaagtcactaacctgttcatctgaaacagaatttccatttaagtctgaggaagggcttgtccggtcacatggaagattatcatcagagacatcagtattatagccactgccggttggagaatcagaagaattattggatgtcagcactccacccctttctgtgtcactagctttacccataattccaaaactgttatataaaacagcaccagactgtcttcctcctataaaaataaaaaaaagcatttattataaa

SEQ ID NO: 559436 - DNA, 215 bp, Homo sapiens
ggtgactgtgcccttgactgacctgtatatgttgtgtgagtctccacttgtatttaatgaattagtcatcatactgtgcagtacagtttccattagggagttacaaagcgttatatgatgcagaattgcaaattaaccactccatgagtggaaactgagacattatgtagtttttacatactgtaatattttctgaattaattctttcatttcca

SEQ ID NO: 559437 - DNA, 177 bp, Homo sapiens
cggctctagaggacccggtgttatcgatgcaccaaaccagctgcaggacagaagcagaacaacgtggtttggtggagagatctgataacaaaaagttgggaaataggtaaaataataacttgtggttatttcttctttactattacacctgaactcaacaggtggcatcgatgagca

SEQ ID NO: 559438 - DNA, 148 bp, Homo sapiens
gcttgtggagatgaatagatttccactaaatgtgtcttaatctgatctccgtccgagtcgtggcagatactgtttattttaatctcgccttggaagttgtcctgtaggagacagaaattcttagttgtctgtatccctgtggtaaagt

SEQ ID NO: 559439 - DNA, 874 bp, Homo sapiens
ggagaggtgtaccggaacggcggcgacagggtgtcccgaactagagtggggcatacagttatcttgctgctatgcttcgaagctgtagtctgaatcaacctaagttttcaaaccagaaggtgaacctctgagatagaaaatcaagtatatttgtatgacagaagggatgtgggatcaaggcaggacagccttggtagcagtggcccttgaatcagacaacagtggagtgcagtcatttccagcgaccaacaggatccaaggccagatgtgattgggctgcatttggccctagtgcttggattgcccaaagacgaagcttcatgtgacatgcaaacgtctatggtagtaacataccacgcaggatatgatgccaaagtggatcgaagataatgtcatacaagtgtgaagtctggttccaaagcaagtgcaatggggaagtcttccaaggtggattcaaacttcaaccagaatgtggcaaaccaggtagattggggacattgcattcaggcaacgcccccacatctacgccatccagaatcatgccattggatgccagcaagcaaccaggcctcaactggagcacttggttccatccgttctgaatgacaagtaatacagtcatcgaacatggtgggtgaattgtgcccctgacaacaggcatatatgttaagcagaagcaaatcacaactttggtggaccacccgatatattttgtcagtgaggccaggtgaacgcagttgtgactatcatgcatggggctgctttaggtccaccgcacagtggatttcatcctccttattggcaagcaggacctccaggactcagcatcttcccagaatcggagacaaaggcatccttcatcagggatcgtcgc

SEQ ID NO: 559440 - DNA, 171 bp, Homo sapiens
gtcatatgattctttagatttccttaaaaattgatctcctatgccaggcacagtggctcatgcctgtaccctagttctttgggaggctgaggtgggaggatcacttgagaccagcagttccagatcaatcttggcaatacagtgagatcgtgtctctcctaaaaaaaagcc

SEQ ID NO: 559441 - DNA, 351 bp, Homo sapiens
  misc_feature (29)..(29): n is a, c, g, or t
  misc_feature (224)..(224): n is a, c, g, or t
  misc_feature (249)..(249): n is a, c, g, or t
  misc_feature (259)..(259): n is a, c, g, or t
  misc_feature (288)..(288): n is a, c, g, or t
  misc_feature (290)..(290): n is a, c, g, or t
  misc_feature (331)..(331): n is a, c, g, or t
tcccgagtagctgggattacaggcatgtnccaccacacctggctaattttgtatttttagtagagacggggtttctccatgttgctcaggctggtctcaaactctcgacctcaggtaatcagcctgcctcggcctcccaaagtgctgggattataggcgtgagcaccttgcacccagccagccccatctcttaagaaaaataaggtggcaggggagagtaaggntcccagccaggacccccaccatctnagggaccttnggaaaggcctcctgcccagccctgctggngnctctgaggctctctgggagggtctcatgactgtggggactnctggatatccctattggtcc

SEQ ID NO: 559442 - DNA, 228 bp, Homo sapiens
ctggacattcctccagtgagtctcagggacttccttttcttcagccttctgcatctccctgatgagccaggtgggacagagatgacagaagattaaacacagagggattggaccccatggagtcctagctggttttgacagtcaagatctcgagcagggagtggaatggtgagtgaaaggccggacaccgtattgtgcttgcattggtgcagcgtggtgcgatggagc

SEQ ID NO: 559443 - DNA, 111 bp, Homo sapiens
cacgaggtttttttcaatttcagcaacatacttctcaatttcttcaggatttaaaatcctgggggatagatctcgcctcatgacagcccgttcaatgttgttgcgacatgt

SEQ ID NO: 559444 - DNA, 469 bp, Homo sapiens
agcctataaatggaagagcaagcataccaaaagatggccccaggaggcttatggaaaagatcagctgcctgatgaaatggaatatgataaatgttaaatggtacactgaatattaaaatgctacatttgcagaaacaagcttgacttgaagcagttcaacaccaccacttggtccaagttgtaatgcctaatttgttaagagggtgaaaatgtacagactcccacacacattcctggacagggctcataagaacatacttattgtctttagcaaagaggatagagcacaggagatattagttaaatgtttatattaaatcagtgtttctactgataggatgttgaaccaaaccaccaaggcaccctaattagtgaaccagtccttcttcagcctccaagaggaggagtgtttgttcatgaataagctgttgctacagagacagtcatgttggtcatattatctttgata

SEQ ID NO: 559445 - DNA, 809 bp, Homo sapiens
gatcagatcgatgtaccaggtggcatatcatttggtgcaacaatctccttctcatgtaacacagggtacaaattattggctcgagttctagttttgtcttattgtcaggcagctctgtccagtggagtgacccgttgccagagtgcagagaaatttattgtccagacatcatcataaatgtgacaatggaataattcaggggaacgtgaccattatggatatagacagtcggtaaggtatgcatgtaataaaggattcaccatgattgggagagcactctatttatgcgtactgtgaataatgatgaaggagagtgagtggccaccactgaatgcagaggaaagtctctacacttccaggtcccaccaacagttcagaaacctaccacagtaaatgttccaactacagaagtctcaccaatttctcagaaaagccacaaaagaacaccagacaaatgctcaagcaaacggagtacacctgtttccaggacaaccaagcattttcatgaaaaaacccaaataaaggacgtgcaacccacttcaggtactaccgtctctatcctgggcagaagtgtttcacgttgacaggtttgcttggacgctagtaaccatgggtggtgatttagcaaagaagaattagagaaattcaacagtatacagatggctaattcttagaatgatctggcttggtaaagtaatgcatgggggtatagaggggcaggttaaagtgttggagtacaggagacagggaaaggggcggatcatttggactaccttggaaaaactgggaagaggagttcaagtaaaaaa

SEQ ID NO: 559446 - DNA, 832 bp, Homo sapiens
gatacctccatcagagttagttggagtcaacctgagtgttgatacaagcctacagacctcacatgccaagtcagcagattaggggtcttcagatatccgtatgagtactctactactcagctagaaggtttccagagtaacaacaaggaacagtaataacgtcgaatgtccaaggtaagagtgatagataggcatcctgagtggtggcgccacgcagtcttcccattggacgcgctgtatccatgccagatcgttcgagggcactggtcatccgtcgaggaacgtccaaagggagcttctgtacaaatgtggtccggaagagcatccgcatagtgctgggagtttaggttaccgtgtgaacgaattggaggagaaacctggaagtactggcagcgtgacgagatccaccgaatccttcctcgttagcccatgtgggccaactgggggctgtcaactcggagcagagacgcttgcttcgaagaataaatgcatatcagtgaagcagagaaggagataggcctttgtaggagtgtgtctttcttgtgtgtctcacaaaacagtgggaaaatccagaccagactctaagtgtgaccagctcagcaataatccaggcagtagtttcctttcacgacttaaacgtgcttcaagatgagacgtgcgtaacatgcagagaacgacttgattcagaggaaatcccatgtgttctctctggactcttgcctagctcagaaggcttggagaattgtcttcctaaatcggggcaacctggtacagaacgagaatgtttcgttccctctgggtatgccaggtaaggggctcattgctcccagag

SEQ ID NO: 559447 - DNA, 480 bp, Homo sapiens
  misc_feature (374)..(374): n is a, c, g, or t
  misc_feature (388)..(388): n is a, c, g, or t
  misc_feature (409)..(409): n is a, c, g, or t
  misc_feature (419)..(419): n is a, c, g, or t
gcagaagtgctctgccctcagagagaaacactggtcagactgagaaagctagctcatgggaggcagggtccagagacacacgcctccaacttcaggtggttaacagcttgaaagcaaatgagtggccagagacaggcctgggaggtctctccactcatgttggggcctggggacaaggattccttctttccctgtggttggctcctccccctctgtcccacataccaggacaaagcaggaaccctaggaccctcactcctctccccctgctctacccagggaccccaagcttggtgctcctccttcttttgccttaagagcatccctcaaatgtgcagtctccccatttccagctgtcccctggattattagcnctggatgctagggntttgagagccttgtctccctntctcccatcncccatgcaagcctctctggggaagactggagaagactcaataatagggaggtctgtttgta

SEQ ID NO: 559448 - DNA, 525 bp, Homo sapiens
  misc_feature (9)..(9): n is a, c, g, or t
  misc_feature (74)..(76): n is a, c, g, or t
  misc_feature (86)..(86): n is a, c, g, or t
  misc_feature (94)..(94): n is a, c, g, or t
  misc_feature (99)..(99): n is a, c, g, or t
  misc_feature (101)..(101): n is a, c, g, or t
  misc_feature (106)..(106): n is a, c, g, or t
  misc_feature (116)..(116): n is a, c, g, or t
  misc_feature (125)..(125): n is a, c, g, or t
  misc_feature (139)..(139): n is a, c, g, or t
  misc_feature (154)..(155): n is a, c, g, or t
  misc_feature (157)..(157): n is a, c, g, or t
  misc_feature (159)..(160): n is a, c, g, or t
  misc_feature (235)..(235): n is a, c, g, or t
  misc_feature (237)..(237): n is a, c, g, or t
  misc_feature (240)..(240): n is a, c, g, or t
  misc_feature (258)..(258): n is a, c, g, or t
  misc_feature (261)..(262): n is a, c, g, or t
  misc_feature (269)..(269): n is a, c, g, or t
  misc_feature (272)..(272): n is a, c, g, or t
  misc_feature (275)..(275): n is a, c, g, or t
  misc_feature (278)..(278): n is a, c, g, or t
  misc_feature (281)..(281): n is a, c, g, or t
  misc_feature (285)..(285): n is a, c, g, or t
  misc_feature (307)..(307): n is a, c, g, or t
  misc_feature (313)..(313): n is a, c, g, or t
  misc_feature (320)..(321): n is a, c, g, or t
  misc_feature (332)..(334): n is a, c, g, or t
  misc_feature (349)..(349): n is a, c, g, or t
  misc_feature (352)..(352): n is a, c, g, or t
  misc_feature (360)..(360): n is a, c, g, or t
  misc_feature (364)..(364): n is a, c, g, or t
  misc_feature (371)..(371): n is a, c, g, or t
  misc_feature (385)..(386): n is a, c, g, or t
  misc_feature (408)..(408): n is a, c, g, or t
  misc_feature (413)..(413): n is a, c, g, or t
  misc_feature (434)..(434): n is a, c, g, or t
  misc_feature (438)..(438): n is a, c, g, or t
  misc_feature (441)..(441): n is a, c, g, or t
  misc_feature (443)..(443): n is a, c, g, or t
  misc_feature (522)..(522): n is a, c, g, or t
gagcttgtncattcaatatatgaacatttccagcaatagttacagtctttctagttcctttcacagtatatatnnncgcaaagccngggaaggnaaatntntttcnagctatagantcattttantaagaccttgtggntctttaacattttanngntnnatacaaaaagtatatagatggacagggtccctcctaagtacaggtgtgaacctatataaaaacatggtatatttncngcngtaccttttataattatnatnngacacanatnacnaanacntaanatattccctaaaagtacaaaanattganacacaannccccgcccaannnttcataaagatagangtncttctgtntttnctaaaancttgattacaaaannggacaagagttcatcattttcnaaatnttacagtaggaatcaaatatnatcnaangnggtcctttaagatttttcttgggagaaaaaaaaatcagggcttacacccgcatcttccttttgtagcaatatttaaggnaat

SEQ ID NO: 559449 - DNA, 869 bp, Homo sapiens
aacattaattacaattaacaataattttaggtatggaatgttatagatatacctaaagagatgtctctacgctaatgagctcaagtgatcctcccacctcagcctaccaagtagccaggaccacaggcaagtgcaccaccatgactggctagttttgtaaacaggttttggttttcggttttggtttttttagggtgggtaggttgtatatttacaggcggggtctccctatattgtccaggctagaagaattttctcacgtggctctattacacctcccgtttgggcaagtacacttcagcaatacttacaggtccttcgcgtatctcagtagtttctgcacgcacttacaacagtgtaactttcgcaattagaagatgaagctatacgtcactcaagaatctcaagctgaagggcttgggggagccaaagcagcttctcagagcataggcttgacacttaaatctcagtctcagtcacctgcaggactttaggcaccaagtgatttcaccctttctgagccgtgttcctatatgcgtaaaaagtgattatcatcaattctttccacagcgttcctgaggatcaacgtgaactcgtgctcaactgcctcactaacagtaggtgctccaaatatccactcgcatccctaaactcatgcgccattggcttcacccttgcccttttccaaggcgctggtcttaaagttctacggggacacacgggaacccctggttcatggctccggttacgaacacaccctcgtagctgctactagttcacctgcagcgctactctccctcacctttccctggttacatcaactgcgccacacaccagtagaacccagctttcagcctggacacgcgcaa

SEQ ID NO: 559450 - DNA, 172 bp, Homo sapiens
cctgttaggggcctacgagtatccacagtgcgctccatggcgcgcacctgctccggggaggctgtcagaaataccaggggcctgatgcgctgtccgacaggagtggcagaggtagccccccttgtttaccttcctgttgctataggtgatgggcagcttcttcatggtaagg

SEQ ID NO: 559451 - DNA, 112 bp, Homo sapiens
  misc_feature (8)..(8): n is a, c, g, or t
taattttnttgtttttaaaatgtagttctggcctggtgtggtggctcatgcctgtaatcccagcactctcaaactcctgacctcgggtgatccgcctacctcccaaggtgct

SEQ ID NO: 559452 - DNA, 182 bp, Homo sapiens
tacttggttagctggttaggaccagtaactggattggaaccactatgataatattttgaaccaactgttaatgcttgatgcagaattgtaaagcagcatctggtgcctatatcgccttaaggatcaatttaaatgtatcctcaaggaatttaaatagggattttccgtactatgtagactgc

SEQ ID NO: 559453 - DNA, 299 bp, Homo sapiens
ctatccagcacttccctctgatgttcagactgcctcatgagtagctcactcttgatggagtctgaacatcagagggaagtgctggatagacttcatcaaatgcagaggacaagagacgtttaggagaacggggcatttgtctagcctcttcagcaagtgttgtatttctgatggctctgtaagaggaatgtgatctttgatggctgggatattctcataggttcctctgcctgtccggacaattgtcggggctgagaggttccaggagcaggtagaactgttgctgctccgccgcggcc

SEQ ID NO: 559454 - DNA, 564 bp, Homo sapiens
catcacacgaaagcgtaaagtttagtataaagctcaagaaattttcagatagtgaacacaatagtataagcacgaccagacaaagaaagtaaaaattaattagagtgtatgtgtcgaggaatgtatccatttcttctagattttctagtttatttgcatagaggtgttagtagtattctctgatggtagtttgtatttctgtgggatcggtggtgatatcccctttatcattttttatagtgtctatttgattcttctctctttttttctttattagtcttgctagcggtctatcaattttgttgatcctttcaaaaaaccagctcctggattcattgatttttttgaagggttttttgtgtctctatttccttcagttctgctctgatcttggttctttcttgccttctgctagcttttgaatgtgttggtccttgcttttctagttcttttaatggtgatgtgagggtgtcaattttggatctttcctgctttctcttgtgggcatttagtgctataaatttccctctacacactgctttgaatgcgtccgtccagacggac

SEQ ID NO: 559455 - DNA, 100 bp, Homo sapiens
ggtattctgtgagtgaaattaagaaaaggagttgtaatttgccagatgatacttagctggaaagggacagaggtggacatgcacctgcacaagtacctga

SEQ ID NO: 559456 - DNA, 313 bp, Homo sapiens
  misc_feature (20)..(20): n is a, c, g, or t
  misc_feature (275)..(275): n is a, c, g, or t
tcggccggacttcaggctgnattgcaggcgcatgccatcacactgcggctgtttttgtgtattttggtagaacgggatttcaccatgttggccaggctggtctggaactcctgaccccaagtgatctgcctgcaatcaagcctggaaagggcttgattgcacggcgacatgcgatttctagagatatgtcagtagaagttagaattcgtgaaggatgcataagtgtcagagggaaggttaatgggttgatattgctcagggtggcgcttccaatntaggtgcatgagtaggtggcctgcaatcaagcctggaa

SEQ ID NO: 559457 - DNA, 391 bp, Homo sapiens
  misc_feature (138)..(138): n is a, c, g, or t
  misc_feature (290)..(290): n is a, c, g, or t
gaaggcggtcactctttgcggacctgaaaattctttcctcagcgtggaggttctcatctttgtcctgtggtgggaaaaacatctggttcttggaacactaagaagacctccagatcatgtaggtggttacgtgtaatnaaaaatcctgactattcccaaacgaatatctctatcaacttgacacagagttgtggggaacggcgaagtaaaataaagaaagcattcactaaagaaaaaaaaaaaccacttagatatgcatcgcagaatcgggtttgacataacaaataggngacaaaagacacaagctggtgccccgggattttgggacaccacacaggaaaatggaaatccacgaaacacccctaaaataaaaagggggtgctcggtttca

SEQ ID NO: 559458 - DNA, 266 bp, Homo sapiens
cagcccctttgtgtcccgagtggcacttggctccctggacaggcacgagacagagcctcccccgctcctccgggtctgtcctcgggcccactgcatggtgggatcagacctgtggtttggacaccagccttcactgagggcagccttcgggctgagccctgcccaggcctcaggggtacagaaaccaggccagaggcgtaggtcatagcttgttcctttcttctcaaactcgaagctcctacaaatctcctggcaggaagccacgg

SEQ ID NO: 559459 - DNA, 271 bp, Homo sapiens
atggtggatccaccagcagcttgcacactggacctgaaaaagccacaggcattcaactctgatgtgggttgactttgggtcccaccccctgaagctttaccggggcagtcattcttataatcgcccacggacttacatcctcattactattctggctagcaaacttaaactacgaacgcccttccaggcgcattataatccttttttaaggacttcaaactctacttccactaatagctttttgatgaattctaacaaggcttggttaact

SEQ ID NO: 559460 - DNA, 634 bp, Homo sapiens
cgaaaaatttaaaaaagaaaaaaaaaaaaaaaaaaaaaaaaaataaaaacaaaaaaaaaataaaaaaaaaaatatatatacaaaaataaaaaataaaaaataaaaaaaaaaaaaataaagaaaaaaaaaaataattcaaaaaaaaaaaaaaaaaaaaaaaaaaaaattgttgccctctttctcccatttgtttttaacctggaataagtttacttcctggggacttaatagaggcttttggggctttaccccttttagggggactttataaatgtcctggaccctgatttacaagactagagttcggaaaaaccccgggtttaccatccttaatcctgtcggggtaaatccccttttctccaaattgccaaactttataaacgcccccaacatgctgcctttacaaagcttgttggcgcctcttaagggcacaattgaattggatgggtcttaatttctcataaaattcctgtgtaattattgtggtaaatacacactttttttaccacaaacggccagttccgagaaaatcctgtaacagatgcgatcccctccataactgtactgtgataccaccttctgtttattgggggaaagcaccaatttggctcctctcccgcgtttttggggggcg

SEQ ID NO: 559461 - DNA, 181 bp, Homo sapiens
gcccctcttactgttaattattgtcatataaccacccataatgtccgcttctcactttctgaattattgctctccccatgttgtagcctatgaacccggcgaaccttatttctacaattatgtgtaaagtaaaatcagcgaagttcttaatgagaatctcccacctggttaaaatgtaaaa

SEQ ID NO: 559462 - DNA, 1143 bp, Homo sapiens
ttactaccagacaaccttagccaaaccatttacccaaataaagtataggcgcatcagaacattgaaacctggcgcaacagcatcatagtaccgccaagggaaagcatgcaacaacattatagccaagcaataatatcagcaaggactaaccccatataccttctgcataatgcaattaactagcaaataactttgcaaggcagagccaaagctaagacccccgaaaccagacagagctacctaagaacagctaacaagagcacacccgatctcatgtagcaacaatagtgggaagcatttatcaggtagaggcgaccaaacctaccgcagcctggtgcacagctggcttgtccaagatagcaatcttcagtatcaactttcaacattagcccaacagcaaccctcataaatcacccattgtcacactttacacatgttagatcacaaagagggaacagcatcgtataggacaactaggagacaccacacctttgtacgcagcagcagtaataaacatttacacacccatagataggacctaaaagacagccaccaatacagaaaagcgtacaaggctcaagcacccacatacataaagacaaatcaccaaacatataacatgacacctcatcaccacccagataggaccaatctcatcaccctatagacaagaacgtacacatgcacagcacacacgtacaccaatgcaagagacaacaaacatgccacccgcaaatacaagccacgcacgatacaagaaccaaaccacaggcaaaccagcacaacacagacagccaagaacaacacaagcgagccaacaaaagcacacacccccacggcaagccccaagaccagccactgacactaacgaaagagtacaacaaaacaccagcgacacacagaacaccccacccagacagaagaaacaaaccaactaaccataaaacataaacagcacaatccagagcccgaaggccacagaaacaaaataacaggacaagactcacatacagccagcgagaaaaaaaagaaacaaaaaggcaccatagagaccaacgaagacaggacaacagaaacagacaacccacgcaaagaggacacaaccaagacacaagagcaaagcaccaccacaggatacaacca

SEQ ID NO: 559463 - DNA, 1131 bp, Homo sapiens
  misc_feature (1131)..(1131): n is a, c, g, or t
ggcgccgcccggagccctgagcctgcgcgggccccagctgacccgcccgccatggtgtggactgaggactgacgatgagatgctgctgcctgtgtgagctgctgtgatcacagaagccaacctgacctgggcactgaggagaaggtgagcgtggagaacttctgagctgctcaaggtgcttgggcacggtgagcctacgtgcaaggtgttccttggtgctggaatgtgctggtgctgtgtgcactgactgctggtggaacgcttgtactgccatgaatggtgctgcgcaaggcggcgctggtgcatgtgcgccaagacgcaagagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggcccttggaacacctgcacaagctcggcatcatttaccgagacctgaaactggagaatgtgctgctggactccgagggccacattgtcctcacggacttcgggctgagcaaggagttcctgacggagggggaaagagcgggacttctccttctgtggcacaatcgcgtccttggccccgaaatcatccgtaggcagacggggcatggcaggcttgtggactggtgggcctgggcatctggcactcgagctgtgacggggcctcgcccttcaccctgaaggggagacggaaccgcacggcgagggtgaccgagagtctggaagtgtggccccttccctgtttccgcctctgggactggggccgggtcgccgcatgaacttggtgcaccgggaggcgatgtgaaggggccaaaacaaccagtcaggctgcagtgcgcccatggcgcacgagcagtgacgagcacaccactttcacaagggacaacaatgcgggtgcgtccgtacgtacgacgagacataacgacgcagcgacggagccagtacaagcaatcatgacgacgcatataacgaaaaaataatgatgggccggcgtacacctcgtagcagn

SEQ ID NO: 559464 - DNA, 450 bp, Homo sapiens
cacgaggcaggaattccgtcccttccgcgacatcgtgatcgactggcgacagcaggacggcggcgtgcgcatcatggcgctgtccggccgcccgtggcgcgatgcctccggccagatcgccggctaccgcggcagtgcgcgcgatgtcagtcgccaggtcaaggcggaagaggatctgcgcgcactcaatcacgaactggacgagcgcgtgcgcagccgcacctccagcctgcgggccgcattcgaggaactggaaagcttcagctactcggtgtcgcatgacctgcgcggcccgctgcgcgccattcacggcttcgccagcgtgctcgaatcggaaatgacacggcccgacgtgagcggcctcggcaaggcgagtttcgatgcgctgtcgcgcatcctgcgcgccgcgctgcccatggagcatctggtcgacgacctgctcgaactgtc

SEQ ID NO: 559465 - DNA, 104 bp, Homo sapiens
tctagaggatcccgatagtttagccaggctgtggcacgtgcatgtatgtcccagtctacttgtggaggctgagatgggagatgttacttgaacccaggaaatgg

SEQ ID NO: 559466 - DNA, 359 bp, Homo sapiens
cactgtgaggtatatctggggaaaagagcactcttgtttggaagtactaacacccccgctgtgtagaatatatgcgggggacaaacccccaagcgtgccgcggcgtgcaggacaagtgggcccctctctatgtcgactctctcttcggtgacacatacctcccacgccaatattgtgagtgtatgttaaacagggacgttctgtctgtcgaacaccttgggagcaaatggaagaggttcttcgtgggtgggctattattaagagagtagtggcgtttttttcttatcaagtcacttgttggtatcaccaagtggcgatccccaataatcctcccctgcggccccacaatgaacaggcaa

SEQ ID NO: 559467 - DNA, 183 bp, Homo sapiens
ccccgtttcgtgagactcctttgaaattggttagtataagatagcactccaaggcaacctatatatctttgattgataatgagagttttcctttccatttgcttattaactagtaggatttcttctctgtgagtagtcttacatgtttttctcactttaaaattggtataccatactttcatc

SEQ ID NO: 559468 - DNA, 340 bp, Homo sapiens
acctatcaaaacctctgggatacagcaaaggcagtgctaacaggaaagttcatagccttaaatgcctatatcaaaaagtctgaaagagctcaagtggacaatctaaggtcacacctcaaggaactagagaaatgagaacaaaccaaacccaagcccagcagaagaaaagaaataatgaagatcagagcagaactaaatgaaattaaaacaaaaaaatacaaaagataaataaatcacaaagctggttctgtgaaaagataaacaaaattggtagaccattagcaagattaagcaagaaaggaagagagaagatccaaataagctcgattagaaaaaaaaa

SEQ ID NO: 559469 - DNA, 231 bp, Homo sapiens
gaccggcgattatatctgaatatggaacatggttataatcgccggtccgagatctcgtgaccgggcattattcccctagccaaccccttaaacacccttccccatatcaagcccgaatgatatatcctatacggcctacacaatcctccgatccgtccctaacaaactaggaggcgtccttgccgtattactatccatcttcatcctagcaataatcgccggtcacgagat

SEQ ID NO: 559470 - DNA, 509 bp, Homo sapiens
aagatgccctacaagttcccttttagtttgatagtgtttcctgtattcacctagggcaggattctaaaccaattttagatattaggggcctcttgagaatgttgcccttttcttagaaacatgcttggccgggcacagtggctcacacctgtaatcccagcacttgggagggggaggcaggcagatcacttgaggccaggagttcgagaccagcctggccaacatggtgaaagcctgtctctactaaaaatacaaaaagtagctgggtgtggtggcatgtgccaataatcccagctattcagaaggctgaggcaggagagtcacttgaacccgagaggtggaggttgcaatgagccgagatctcaccagtgcactccagcctaggcaacagagcaagactctgaaaaaaaaaagaaagaaagagagagagagaggaagagagagaaagcaagcaagcaagcaagctagctagctcaagcctgggcaacaaagtgagaccccatctgtac

SEQ ID NO: 559471 - DNA, 1170 bp, Homo sapiens
ccacgcgtctgacccactgcgtctggtggctactgctaggaacagagggagagtggggggcatgtgtggggtgaggggagatttttttattttttgttcttgaattgtgcatctcgtcaatgccagcgtctatcttccaatgcgcaatggctagaccaggttggtgaggacgcatgatgtggacttgactagctagtgcaagcgcactattgaaagaaatgacactgggcgggttcccctcacatcaccctctacacctcataagcacgaaatactagcatgacagtcagggtcagcccccgtccctgggccactcgaccatttatcacagagtacagtaccgcgtgcgaaacgttatagagtcatatgacctatacaaactagcgtggtagactcatgctccgagtataaccgtattttacatttctcgtgtattcgtaatctacttagcccagagaaaacagagtctaaaggtatacatttaacaattcactaacacaccctatattatactttaaagactccgcaatcgccatcttgtgggatcgggggaacccctgtggccacaggggttgcgggccaaaccctttttaaatttcctaagagaaaccctgtggggtcatatctacaaaatttacactccacggaaacgttgtatttagggttctccaaagaaccaggggcatttcccccggtacccccgaggtgcagctgccacgcgagggggcccaattgtaagttgtcgggttgaagatgcgtgggcccgaagaggcgtcttgatagcaagcaacaaagaagagttctcccccagtaaagcctcttccccctttcggcaatagggtttctcctctgtaacatatacgtggtgataccttccgtgggttaccatataagttgtatacccccagtcccccaagtttgttgagccaacctcttggatgaagtgttgcttccccgtccattaacaggttacagcgcggttgtgggcaataaggcctaaaattctatggcccgggttcccattggtgagggttattttcgggtagcaattcttcgcgagaaatctcgccactatttgttacctataggggattggcaaaggcgttctagaccgcgtttctccccattctgtggcgcgcctcttagagttggttatctcttacagcatta

SEQ ID NO: 559472 - DNA, 385 bp, Homo sapiens
cctggtcctgagtaatgatggtcacaatttgagtgatatcacttctatgtaattttatcaccatgcaagatgcatccagcacaagaaggtcacacggaatggaacagagaacacggtacacaggcttcctgggatataaaagagaatgactcttccacagtcttagcagtcagttctatgacaccccatctgcaaccttagcaatagaaactcctttataactgtaagttgtccaaccagagcgcatcctccatgggtaatgtctggatttcctggtacttttaaaaaagattcagccacaactttcaaatataattgtgtatcacaaatctgtgttgggacttggacatctgtgtttcaggtcttttttgctgttgtgtctgta

SEQ ID NO: 559473 - DNA, 293 bp, Homo sapiens
  misc_feature (76)..(76): n is a, c, g, or t
  misc_feature (126)..(126): n is a, c, g, or t
ttggggacggatgcgtttcgacgcgtgccccggcaaagaaagaaagaacttcaggatctccatttctgtgtctggnatttgatgacgtcaaagtcaaccaaattctgaagacgctgtcataggtanaagggggtgtggggggcactgatcagccaccctaactgaagatgatgtatgaaggagttggagttgttgaaaccaaggtgtccatgatccctccccactgaccttttctaagaaaattcttgtgcccgcattggtattaaatcctcgcattcagtcttcctggggag

SEQ ID NO: 559474 - DNA, 456 bp, Homo sapiens
gagctgtttcgaacacccagtgagagccaggcccgcgtcgctgtgcagcactctgaggaagtcacctctgaccctcgaagattacaagttcttggcggtgctgtgccgggttcattttgggacgggtgctcctccccgaattccggcccagtggttgcagctgttcgccatcaaggctctgaagtacaggggacattgtggtcccacacgagttggagagcctgatgtgtgatacgcggatattggcggctgtgaccagtgcgggacacccctttctggtgaatctcttcggttgtttccaaacaccggacgcacggtgtgcttcgtgatggagtactcggccggtggggacctgatgctgcacatccacagcgacgtgttctctgagccccgtgccatcttttattccgactgcgtggtgctgggcctacagtttcttcacgaacatcagatcgt

SEQ ID NO: 559475 - DNA, 411 bp, Homo sapiens
  misc_feature (1)..(1): n is a, c, g, or t
  misc_feature (337)..(337): n is a, c, g, or t
  misc_feature (387)..(387): n is a, c, g, or t
  misc_feature (402)..(402): n is a, c, g, or t
nataacagtgctttctgtatatttggcctggcttgatcttccaagtcagtccctaaagtctctctgaagtactgtatgaacagcactttggccccgtgtcggaaagggaaagaaagtagatgagcagtgctaacctgaaaaatcatgagaacaagcaaaggaaactgagaggatcaaaacttggaaagtttctcaataacaatcatttgcctgtgtgatacagctcaccagtggtatgatggtttttccagtgggaaaaaatattttccgaatgtgggcatgtgtccatttgggggacagtgtgggacaagccaaaagctttttaaagatcaggatntttctgtttgtaggtatactgcctaacatacaaagcttagtttctttccngttgggggttgggcnggtaggcct

SEQ ID NO: 559476 - DNA, 139 bp, Homo sapiens
gcaggaatagactgtcactagcattacaagggggtctaaagcatcaagtgcttcaaagccataaaaaatgactacttaattacctgccttatagtgtcaactttataagttaatacaggtttcaatatagtggcattag

SEQ ID NO: 559477 - DNA, 443 bp, Homo sapiens
  misc_feature (8)..(8): n is a, c, g, or t
  misc_feature (109)..(109): n is a, c, g, or t
  misc_feature (130)..(130): n is a, c, g, or t
  misc_feature (145)..(145): n is a, c, g, or t
  misc_feature (167)..(167): n is a, c, g, or t
  misc_feature (202)..(202): n is a, c, g, or t
  misc_feature (233)..(233): n is a, c, g, or t
  misc_feature (276)..(276): n is a, c, g, or t
  misc_feature (324)..(324): n is a, c, g, or t
  misc_feature (386)..(386): n is a, c, g, or t
  misc_feature (400)..(400): n is a, c, g, or t
  misc_feature (408)..(408): n is a, c, g, or t
  misc_feature (426)..(426): n is a, c, g, or t
actttatncttatttcttatcctatattctgtgttacagaaaaaactactaccataaacaaagcaccaaccagccacagcagttgtgtcaagcatgacaattggtctantcttcacattttattagtaantctatcaagtaaganatgaagggtctagaaaaactanacacaaagcaaccagggtccaaatcaccaaggtanatctgtgcttagctaaagggaaacaccgaanatcatattggatacagactatgggaacatcttattgaaagaanctttgatttgcctgttctcaatggctgaactgggcgccaattgttcancatcattcttccggttcacccccccattgaaattaaatttacggaatttcaacacctgctcnctgctggcgctgantggttccntgaacacaatccaagtcncaccttccaaaaaaaga

SEQ ID NO: 559478 - DNA, 273 bp, Homo sapiens
gtccgacgtagctctaggtgtccacctccacactaatgcacaggagaccctacggtatcgttgttacatctgacgaatatgatctcacacgtacgagaatgccacttatgttaaccgttatcttgatatatgacagatgcttgttatcgggctatcactccgctcctgctggcatgtgaaacagtataaattagaaagaggataggctcttagtgacagagctgtccatatgtcattaggattcagatggtcaagcgaactgttctcagtgac

SEQ ID NO: 559479 - DNA, 1069 bp, Homo sapiens
ccacgcgtcgccacgcgtcgcccacgcgtctgagaatttcaaaacaacaaaagttgtttggcttaacacaaatttcatgtgagggaaaacaaaaaaacctattccaaaataagttggtgtaggtttgtagaagcattcgactgtcacttatctctaacaattcgtaggacctatatacaactgtgtgtggtgtccaggcaaaatgtcgatcctggttatttccctctcaacacacaaacacacacgtcgaaaccctatatacgtgccaaataccaaacggtccttcctatcctaaaaaagcttccacacggcgctacactctggtcgcaaaaagtaacatttctgactcacccatgggcgtcatactcaacttaatcgtcgtctcaggtccataaaatccccaaaataattaacacaacaacaaaaaaccaacaacacacaacaacacaggtcacacaactatctgtgatcaaaaccatgtcgactaatacccatggagcgcccccaaggagtaagcccgtataaatatcgcggtaccatgcgctattagtacaaacttcacaaacccgcgtgcaacatgtttacacactgggctaaaccaaacaactgggatatctacagtgttcccccaatgtgatacaccacaacttatatataaaccacacctctcccgacaccacctacagctttgcccctgataaaaaagcagcaaacacactatcaaacaccacgggtaactttcctcacccttccacaaaacgctcactaattgcgagcaaacacgctcatataacgcggactaccgaacacacgtttcatctgacaaccctactgaaccccacccatgatacacaacacccacaagaaaaaaccacacacaacagcggagaaaaattgtctgagaacaagacaacattagtagaaaaaacacgcggtcccgcatggcacattatcgtgacagtaatagcggcacacgaagagacggatcgactcaaacccacaacaaccgggcacaatctcagccactcaccacccaggcacaacaatcacaactcacacaccacacaaa

SEQ ID NO: 559480 - DNA, 137 bp, Homo sapiens
catgaatacaactttgttctgagagccccttcaagtgtgatcctgatgctgccagagccattcgcggatgttttaccaccacctctgtgaattctgcctgcacagcaccaaacagaccgtgttatttgcggtcccct

SEQ ID NO: 559481 - DNA, 770 bp, Homo sapiens
gtaatccagatgacacccagacggacagtgtatggttcttgcctcagaagagctgaaaacttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaaaaa

SEQ ID NO: 559482 - DNA, 1785 bp, Homo sapiens
gtaatccagatgacacccagacggacagtgtatggttcttgcctcagaagagctgaaaacttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcccggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaaaaa

SEQ ID NO: 559483 - DNA, 200 bp, Homo sapiens
tcgatgccatgtgagcttctcgttcagctcatggctccctttaccgcggctcttggcagctgctggtagaggcaggcctgatgttctggagagccccgcgggcatcatgccacagtttcccggaggcgccatccacagtcttctggtataccgtgattcgcatggacttgtgtctcttagttcttccacgataccaatag

SEQ ID NO: 559484 - DNA, 213 bp, Homo sapiens
aggtctcaaatcaccaaactgtcttcacaacatttcaggttggggcgcactcggagccacaacccaacctccgcagcagtcacatgctcaagcattacacccagtccaacagcgcaactcactcatcactccacattgcatcccaatcacacttgcacccacacggcaaccaagttcacccctcagggcatcaaccagacgccaatacctcat

SEQ ID NO: 559485 - DNA, 231 bp, Homo sapiens
gatttctctttacagaccagatcagacttggacattagtatagtcctagatccttaagttgacctaggagtatagccagaagtttataacatctctataggagatagcccatttatagtgcacgttctaacacaacctatattaaaagtagacattgccttctatttattcagttaaaaatggagaaactcttttttgccaccttatgttatatgaatgttagtaaggtgt

SEQ ID NO: 559486 - DNA, 931 bp, Homo sapiens
gtaatccagatgacacccagacggacagtgtatggttcttgcctcagaagagctgaaaacttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatgctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaaaaa

SEQ ID NO: 559487 - DNA, 883 bp, Homo sapiens
  misc_feature (881)..(881): n is a, c, g, or t
gcgcgtcatgcactaaatatatatagcatataccatctcattctgggaatactagtatatgctcacacctcatatcctccctatatgcctagaaggaataatactatcgctgtcatatagctactctcataaccctcaaacccactccctcttagccaatattgtgcctattgccatactagtctttgccgcctgcgaagacagggtgggcctacgccctagtagtctcaatctccaacacatatggcctagactacgtacataacctaaacctactccaatgctaaaaactaatcgtcccaacaattatatactaccactgacatgacttcccacaacacacacatattggagctcaaacaaccacccacagccttatttatagcttcatccctctattattttgaacccaaatcaacaaaacctattaggatgttcccctaacttttcttcggacccctaaatcccccttcatatactaactactgattcttacccctaacaacatggcagcaacgcacttagtccaagtgaaccactatcagaaaaaactctaccttctctatataatctcctaaaaatctccttaattattccaattcacaggcaccagactagtcgtattatctctcatcgacacaagtattaccactgctataatccacgataggaaccgcaaaatgctgaacaggcaatattctaatttacctgtggccctcctctcttgacaatttcccaaactagcacaaattaatctcccttgcaaaatactccgccacttattgtacactttaaacaacttggccactatcctacacgagccgctatctcgaacagtgatacatccacaacactaatataccgcaaaactcaccccatanct

SEQ ID NO: 559488 - DNA, 376 bp, Homo sapiens
  misc_feature (2)..(2): n is a, c, g, or t
anctgcagctctctctgatgcctggcgcttcatctcgcttctgcctcttagcttcatacagggcgcgagtggaggctcgttgaagaagccggacttccacagcaggaggatgatcagccccagcagcagcagacctgaagccacgggcagcagcaccagccacagatcgatttcggccggtagctcctccagcagctccgagtcaatgtccacagagaaccacgtggtcttgttctccatgttgatggtggggatgctggttcggaggaatagggtagcccagccatttacccggactcggtcaaaagtctctgtaatcctcgatgaaggtgctgttccacactcgtgccttcacagtcacgttggtgacaagggg

SEQ ID NO: 559489 - DNA, 1347 bp, Homo sapiens
  misc_feature (167)..(167): n is a, c, g, or t
ggccgggagtcgcgtgtgcgcgcaggccgtgagatgtgcgcgttactgagagtcgtcggtcggaatggagcccggccgccgaccggcggccatgagctacgaccgcgccatcaccgctcttctcgtcccgatcgggagcaacctctttccgaaacgttggatgtacngctgctaggtaggcacgtctatagtaagtgggctcgtacccgcgcgtttggttggttccgaggcacacgatgacacttgtgtgttcgtatgtggtgttgggagaaaggaatctcacgttgtgtcaaatctgtcaggatgcaacatgatagcagtagcggtaatcatcttgtgcgtttgggattgatcgaaccgtcatgccattggtcctttgacgacgagccgtcatccgctcggatgctagagggataagctcgattcatactagagggcccgcgggtgcgatgttgccaagtatggcccgacccgggattagacacgctggggagggtaccccgagatcatctggtgcgcaaggttacaatccactcgcgtcctaacaagttccgtcccatgtacttgcatacgccaagccgtttggagtcaccgaactacggaaggccatattcgcggccgtcagggcccgctttttcgtgccaatcgtcgtcgaccccttcctatacggttggcgacgttgtcgggaccttttgagttgtgccacccttcgcttagaggcgttctatctatggccgttgaacccccgtcgtgaggccaactagtaacccagtgaccctggaaagggtgcccaaatgtgcccagtacgtggccggtgggcgtagccataatgtcagggtgcgggtgatagttcgcttggacagagagagaatacttattatctcgatcgaaaagcccagttggaaagaccccgagtagacttcttgacgccatttataagcgtcggtcgaatccaccggtcacttcctgtgggaacggttggagttcccacgtcaggggttggcaaaaacaaccaatttggtaaactttagcttggtcaatttgaaggggggccggaaggaattccaaattggcccgccttccgaaaggaattttttaaagcatttccgttggacagaagaaaaagtttggaagaaacaggtcaattggatgcggtctgtagagagtttggctaccccacgatacaccggtcatttacacatacttttctgcgcacgcgcaaaataatacatataatggggagggagtgccgcgtcaaataaaagatcgatgtcgtctcaggagacaccacgtgtgagagagatcgggctataatcatatggcggtggtgcgagagtggctccacgc

SEQ ID NO: 559490 - DNA, 503 bp, Homo sapiens
gctgcccctctgtaggccaatgacatgctttccctcctgcagcttgttctctgtgacttccctcttatgctcctgtcgctttcttcataaaccagttgggatctccacggtagtgcccttcattcttggtcactgccaaacagcccaaagccatcagggtcctctgcactgctgccatgtctttgccttcaaagaggtcaacagtctggaacatgtcagtcttgatgaccccatagtccccagccgccttcaggacctgaaccacctactccatctgcttaaataccatagagggtgggttctcgggcaccttcaccggcttggagccaatcagggtacaggctgttcaccagcttgctcagaatcacgccattcttcagccagacctggaagcccaagcgcccagtgtctggagcggaccacatcaggtccacagtgcactataatccattccaccagccgctcctccagctcctcgtcatacttcttctcgatattggact

SEQ ID NO: 559491 - DNA, 183 bp, Homo sapiens
cccacggtcaataccttcttatccttattccgaagttttgatttctacagacgcatcacaatggtcctcgagagtcacatgaattatatatctagaacccttccaatactactgtttccgatctggatgtctgagtgttggcgccacttgacattgtcagtgcatgatcattcttttttgcac

SEQ ID NO: 559492 - DNA, 106 bp, Homo sapiens
gagatctaaagcagcgggcatgaggaggcacaggcacctgcgtggatgtgggttgggaacagcactgtgagtcagcaccctggtgtggaagggggcacatgggcac

SEQ ID NO: 559493 - DNA, 105 bp, Homo sapiens
tctgctgaacgtgttacgacaagaacggtgatgggtttgtggatcaggatgagtatattgcggatatgttttcccatgaggagaatgggataacacgttcgcgag

SEQ ID NO: 559494 - DNA, 656 bp, Homo sapiens
agcggccgctcgcgatctagaactaatctggacctctaaatatacttttagttgtgtttaacttgtttaataaataactttttaagttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacacactacacaaaaaaaataaacacaaatgatgaaaccaacaaagaagaaacaacaacaaaaaaacatcatcgataaagaagaagagccgcagcagacgaccagggacaacatacgacagcagcgccacaccgtgcgacaacaaaccgaccagacacacacacacacccgaggccaccgaccgctggagaaaacgaggcccaccacaccactcccacgggaagagacatatagatgcagcaccgacacgacagcaaacaaagactagctactcagacaacatccatgtagtttggttgctatcaataacaagacacaccctgtcgctgaacagcagtggtgtcaacacccgctgcacacaaaccactcgagccctgctgtccggaactgccatacgcagagtccttagatactaacaaacaaatacaacaaagcagcatacccgtcaaacaggaaccatacacaccacggccccg

SEQ ID NO: 559495 - DNA, 748 bp, Homo sapiens
agcggagtccgtttgtgctagctctgtgccgtgagccggccgaccgctgccggcggccggcccgcagctgcctgcgccgccagcgcgcgcctcgcggtcagcccggctagctcaggtccgcttcccggagccctgcgcctcctccacgctgccccgctgcgctgtccgccggcccatgctggtcccttcgagtacacccgagcgtgtaccggtgacggagaccggcgtacaggattatcatggtcataacaatttgatgactccttacgcctggcttgaagaccccgacagctgaacagactaacggcctctgtggaggcccagaactatgattactgatgccactttcttgagcagtgtcccatccagaggttcactactacacatgacgagaatgactgacactatatgattgatcccaagtatagcttagccatgttcaagaataggaaggatcggtacttgataatttatttacatctagcaggtcagcagaacgcagcgaggtattatatgtacaggattccttagagggtgacggccacacgtgtcctggaccccaacaatactgttctgacgcctggcccccacgtgtgacactcccgagcgtctactggcgtcaagccgaagcctgggtgacctactcctgcctaatgcatcctgcagtgcccagtgcgctcacacactggctgacaatctcccgttccacgaccagttcgcatctcgaccaacgacctcccgcactgtg

SEQ ID NO: 559496 - DNA, 119 bp, Homo sapiens
aacccataaaaccccaaaaagggccagtaaataatcctagggtgggttttaaaaaagggcccaaagggtttggtcaaaaccctggttcccattttcaaaaataaaattctttgtttcca

SEQ ID NO: 559497 - DNA, 946 bp, Homo sapiens
ggagagacctcatagataactccttcaaccggtacacatttaatgaggatgagggggagcttccggagtggttctgtgcaagaggtaaaacgcagacaccggatacgacagttgcctgtcggtaagaaggaggtggagcattaccgtgaaacgctggcgggatacattcaatgcacgtcccatcaaagaacgcgtggctgaggctaaggctagaaagaaaaggaggatgctgaagaggctggatgcagtaccacggtaccgaaggcatgaacgccgtgagtgaacacaagtgcgacactctcagaacgagatgaaagtggcacagctgcgaagtctctacaacgaaggctgggcttgagcaaggagaaactggccatgtcacctacgttgtagccaaataaggtgtgggccgcaagagtgcgccggccacgcttggaacgtcagaggtcatttcaaggtgcgtggactcaaggactgaagacggaccaatagagcacagccacgtacaggaacaaacagcaatagaaactgcaaacgggaagtaagctagagctgccagagcgtcccaggagagcatggtggactaggaccgacagggctgtggcatggctcacgtctgggtcccctttgatttcccggccctagacacttggtcacagtcaccgctgtcttgcataacagtcgaggtggagtgtctattactcccgagtctggtcctgatcggacaggatggtgtcctttctgcctgccttataggtctccctatgaacacactgctgaactgggtttgacactcatgaccctttttgtaaaccgtaaaagcgaacgtccgggttaggagcgatactcaatgtagtaagtcctacactggacgctgtgggccactttacggcctccacacccccatctattctgaataaaccaggatatggacaccaacaaaaag

SEQ ID NO: 559498 - DNA, 361 bp, Homo sapiens
catataaatcctgtatgtaaggatcaattaatacagatgcaaaaaaactttatagagatgtcaaaacaaaactataatggatctcctatttttctttaaatacaaaaaaaacaaaggtaaatgaactattctccttgtaaaagctaaaaattccccattctgtctcatacaggaagactgacacacaacggttttacaacgaacataaatggaaagatacaattgctttagaaggacataaacgacaatggctcaaaccagggtccatccatttaaagaaaaagtgggacaaaataatcagaattgctccctctttaataaaaaattggggtcctgataatatccacatggaagtagaagg

SEQ ID NO: 559499 - DNA, 605 bp, Homo sapiens
ggcttctaaattatagtcaaaagagttctggaaaagaactgtttacatgctggaggaggaagtcatcttttgaggcttctgttcctctctttatcctgtgtgtattgactagttttcgttcattacttgattaagatatctacaaaagcaggagcacttccaaaagttctctattttgtcctaagcaagaagatgaacagcagggaatggctatctaaatgatgagtattagtttccctgtctcttgtaaaaatgcccatttgcctttataaaaaaaagtgacgagacatactatatacatagtgtactataaagttgcattagaagctataagtactacagttcaataagacttaactttagctgacacatgtggccctgtagccagtgcctgtagagatgcacgagcacgctaccaggcgctctgtagaagcgcctccgttgtcagctttataactcgctcgatgaagcaacgaacgtagtccgtgagcttctatagtatcgagttcactatgctttgccgtggtgtggtcttatcaatgcaggactggatttcatatcagcaatgtagttgctattaagtgccttgggttcttctctggtca

SEQ ID NO: 559500 - DNA, 1015 bp, Homo sapiens
  misc_feature (180)..(180): n is a, c, g, or t
  misc_feature (182)..(182): n is a, c, g, or t
  misc_feature (310)..(310): n is a, c, g, or t
  misc_feature (369)..(369): n is a, c, g, or t
tctgatatcctgataataactctgttttctgctatgacagagggtggtgaaggcagatattgtaaactacaaccaggaacctatgtcaaggactgttaaccctcctagaagctctatgtgtgcagttcactgaactgcacacatagagcttcaaggactgttaaccctcctagaagctcnangtgtgcagttcagtgagcgcatttttcttttgtgttgatagttctggctgcccttcacctctgggtgggcccgaggacttctaggaacttgtttatcagtgaccatctctgtagttcagttaacactntactcccaacttgcttcatcattgctattgcctcacagtggcaggcagctccttggatntgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctgaagtcgaagaatgcttagaaataagcctgtaggagtatgaaatattatttgtgcatgtgtctggtaaataagagggcctaaattgttctatatatgtagtttgtaacatcacgaaagtgaatatttcgagtacttgtattcctttattactgtatcgtagtcgttatgtattgtgtaatactcaggttgtgcaggctttctgaattctgataaatgttcagctgatgctccacgtggaatttcatcttgcaaactgcataagagtactttcccgagaatgatacaccacagtgtggatcaggatcct

SEQ ID NO: 559501 - DNA, 1170 bp, Homo sapiens
  misc_feature (715)..(715): n is a, c, g, or t
  misc_feature (720)..(720): n is a, c, g, or t
agcgggcgagaactctgtctttgggccgtaggttagagtggggaccgatgtgtcagtccacccaagggtctccatcgcgatcgcctggagagtgcacttcgggatacttgtgtagctagttgacggagatatgaaatagccactgtaaccagagaccaagaaggtggcacgacgtccaggttaatataagaaaccactatttcgagggtgtagttgaatgcaccggatgggacttggagtctatgctattggatggaggtgctccgggtctgaagagaataagttagtaggagataatcgttagcagaagacgagtctaaaggcatcaagagttctccaatgttgcgatataggtgcaagatcatctctgaaaagtagtccttagaaaaagctcagttgacgggtaataggctagtattggaatcgatgagattggatcctctcattgtatctagctgctaagaaagaaggatgagcgactttgcagagccacgcatagtgcttcagacgagacgtcatgacatcggtgtgatatgggggcctaagttgcaaaatatcgtgcatgtaacatactatcctattctgggggtgttgtaagccacaagagaaacgaagaagaatcatagtctctacattcaactgctcatctgtagttgcgctgggggacgaataggactgtggggcggcccaagaattttgagacctccgtgtaaangctcntcgacaaagaagattccatccctttggtgtcccgctgcacatcggtctaaagagaccgctgggaactaaccaaaagatgatcctctctagacagcgccagtaacccaaattctaacttcattccaagatttttaagcgggggtcctcgaatcgatagacactcaatttctctagaaaacctcttcccctttgacagtccaaaccattttgtcattggggcacttcccatttggacgttaaagctctcaaatgtcaagaaacatatcttgtgcgagggcacctccattttccccatcggggataggaaaacgcgaaagaagtggcctagggtgaattcctatccgcaatttgtcacccaaggaagtgccaagaaaggaatgcgaagctatttaccgagataaattcggtttaaggacatggtttccccattttggagaaagccgaaacttg

SEQ ID NO: 559502 - DNA, 342 bp, Homo sapiens
tgacaaatggtgttctcactttcattcagcccaaaaggtttcttaatttcccgtgtgactttttcttgagcgggggttatatagaagtatgctgtttaatttctaaatatttgggaatttctcaaatatttttttgttactgatgtctacattaatttcattgtggtcagaggacatattctgtatgatttcagttatttgacatttattgagactggttttttgtcccatcatatagtgaatctgggtgtatgttccatgtacacttgaaaagaatgtatattctgctgtggttgtttggaatgtcctctaaatgcccccaatattttggatggcacttta

SEQ ID NO: 559503 - DNA, 1306 bp, Homo sapiens
  misc_feature (12)..(12): n is a, c, g, or t
  misc_feature (26)..(27): n is a, c, g, or t
  misc_feature (29)..(29): n is a, c, g, or t
  misc_feature (31)..(31): n is a, c, g, or t
  misc_feature (66)..(66): n is a, c, g, or t
  misc_feature (69)..(69): n is a, c, g, or t
aggaaactctangagccccccccaannantnactgtagtgtcccccctaaccggagctacttcaanggnaaactagctcatctgtagagactgatttgccaaccttccgggaagcccatagctctgcatggtccttagtggtgcaatggctagtataagcgtgcgttcgagtacccccaggctctccctacacatgtaagcagtggatcgaatgctagtcgaaggagaaatggactccatgatgtcgatttgaacactttcatatcagaagaaatggcactccacttggacaatggtggaactagaaagcgtacctcagcccagtgtggcgatgtcattacagactcaccaacccataaacgcaacagaatgatctaaactgcaaacattttcacacccaccatgctgcttgaaagccacttgatcctcaacatatactataattgcaaaggaaacatgaggccatcttcccttgttcactgtttaagacaagtgaattctatagtggttgccataaaaggaagttctaggtatttatagtagatgcctcttgtaattatggctttcttaaaactataatcctagcagaggacatcagatattgtgtagtcgttagcaagatcatcataggcaaacatatatccgttccaaggctaaaagtgaccttaactgtatttattctcaaagggaaaggaaatatcagatgtttatttggttatagaatgctttttttttttggggtccatttcctgctgtgttgagtattttgcttcaacagtattgccaggttcctaaaattgtctaaaaacatgatttggcttccatttttgcagctgcactgtaccatgcacctggtttctatatagtaacagtgtgcaattctaattattggactgtgccctgtttttagttttcaaatcaatttctaattctggtgattgtgtgatgtaaagaggtgctatgatggtcatgcaattaatactaaatattgaatcaatgcccagagctttattggattcactttgtgtgtgttagtgctctaaagtagcagtattattattaaactgtccccagagtaaccctgtaggcctaaagtactcagttttaagacaaacactacttcccatgcggggtactttccttatggtaaatgtaaccatgtagactgcattcgaggtgacctaaagtaaagaggtcctgaactttgagaatgggctcctttttggttcagtattagtgagagggagagggagatggatggtggggtaggttttctagtctatcattttacatttttcatggagtc

SEQ ID NO: 559504 - DNA, 390 bp, Homo sapiens
agttctgcctgtagacagggtgctactgtagattgtagcgtgaatgtttaccggtgctaatagattgaaaattctcagcctatgacatgacattcttagctgtaacttatctattaaggccttttccacatgcattacatagtcccaattttctcttgctatcagtagacttagcccatagtcttattggaacatgggtggacacggatctgctggctctgccttaacacacacatcgcagcttcaacttttctctttgatgtcctgtttgaaagtaatacttaccgagtcagactctgtgttcatttcatttcagggtcttggctgcctatgggcttaccccaggtggtcaagaccctcaaatgaaatgggttcggccctaagctgtgc

SEQ ID NO: 559505 - DNA, 1432 bp, Homo sapiens
caccggggttgacacgtagtaacttttagtaattggtagttaccaatattgtagatattggtagtattaccagtaaaatatatgtcaaggccagatgatatgtttttccagaataaaacttaattgcttactagtaatcccttataaaggaaataggcagacatgctttgacattgtgacaacatggaaagtaagtgggttgctttcaaaagggttacataattgagcaactctaaaaccttttttcttcttcctaggtcttagtggtgcaatggctagtataagcgtgcgttcgagtacccccaggctctccctacacatgtaagcagtggatcgaatgctagtcgaaggagaaatggactccatgatgtcgatttgaacactttcatatcagaagaaatggcactccacttggacaatggtggaactagaaagcgtacctcagcccagtgtggcgatgtcattacagactcaccaacccataaacgcaacagaatgatctaaactgcaaacattttcacacccaccatgctgcttgaaagccacttgatcctcaacatatactataattgcaaaggaaacatgaggccatcttcccttgttcactgtttaagacaagtgaattctatagtggttgccataaaaggaagttctaggtatttatagtagatgcctcttgtaattatggctttcttaaaactataatcctagcagaggacatcagatattgtgtagtcgttagcaagatcatcataggcaaacatatatccgttccaaggctaaaagtgaccttaactgtatttattctcaaagggaaaggaaatatcagatgtttatttggttatagaatgctttttttttttggggtccatttcctgctgtgttgagtattttgcttcaacagtattgccaggttcctaaaattgtctaaaaacatgatttggcttccatttttgcagctgcactgtaccatgcacctggtttctatatagtaacagtgtgcaattctaattattggactgtgccctgtttttagttttcaaatcaatttctaattctggtgattgtgtgatgtaaagaggtgctatgatggtcatgcaattaatactaaatattgaatcaatgcccagagctttattggattcactttgtgtgtgttagtgctctaaagtagcagtattattattaaactgtccccagagtaaccctgtaggcctaaagtactcagttttaagacaaacactacttcccatgcggggtactttccttatggtaaatgtaaccatgtagactgcattcgaggtgacctaaagtaaagaggtcctgaactttgagaatgggctcctttttggttcagtattagtgagagggagagggagatggatggtggggtaggttttctagtctatcattttacatttttcatggagtc

SEQ ID NO: 559506 - DNA, 370 bp, Homo sapiens
  misc_feature (12)..(12): n is a, c, g, or t
  misc_feature (26)..(27): n is a, c, g, or t
  misc_feature (29)..(29): n is a, c, g, or t
  misc_feature (31)..(31): n is a, c, g, or t
  misc_feature (66)..(66): n is a, c, g, or t
  misc_feature (69)..(69): n is a, c, g, or t
aggaaactctangagccccccccaannantnactgtagtgtcccccctaaccggagctacttcaanggnaaactagctcatctgtagagactgatttgccaaccttccgggaagcccatagctctgcatggtccttagtggtgcaatggctagtataagcgtgcgttcgagtacccccaggctctccctacacatgtaagcagtggatcgaatgctagtcgaaggagaaatggactccatgatgtcgatttgaacactttcatatcagaagaaatggcactccacttggacaatggtggccttccgggaagccatagctctgcatggtcttagtggtgcaatggctagtataagcgtgcgttcgagtacc

SEQ ID NO: 559507 - DNA, 289 bp, Homo sapiens
gcacgagcctggctgcagatgggggtcaccactggacatatgaaggcccacacggtcaggaccattggccaacctcttatcctgagtgtggagcgatgccagtcccccatcaatatccagacagacagtgtgatatttgaccccgatctgcctgctgtacagccccatggatatgaccagcttgggactgagcctttggatctacacaataatggccatacagtgcagctttccctgcccccaaccctgcacctgggtggactgccccgaaaatacacagcagcccaac

SEQ ID NO: 559508 - DNA, 286 bp, Homo sapiens
  misc_feature (20)..(20): n is a, c, g, or t
  misc_feature (127)..(127): n is a, c, g, or t
  misc_feature (151)..(151): n is a, c, g, or t
  misc_feature (179)..(179): n is a, c, g, or t
  misc_feature (190)..(190): n is a, c, g, or t
  misc_feature (196)..(196): n is a, c, g, or t
aactactgctcgtgcgggantggcaatactggcagccgtcgccgccatcgcagcgtgaggttccccccactcatccccgtgcttcacgctggggcagggcgtggacctgtactggaaccgccggggnttgcgccgcctgtcccggctattntggtagtgtgggcacgcatagcctggcngcacaggcgtngcggcntcgggcactgctccgtcttgtagctgcccagcacgaagttgcatcttgccaccgggggtcctcgctcaggatcttctcaattcatgcctg

SEQ ID NO: 559509 - DNA, 207 bp, Homo sapiens
  misc_feature (144)..(144): n is a, c, g, or t
cgccgttcagcgggtaacagagtaacctgtctctaagagagagagagagaaaaaaaggcttgtggtagatgatttgccaaactgcaggctaaagtgaggtcctcttagcacatttcaggtaggcaaggctaagctatgacgttnggtacattaggaatattaaatgcattttctttttttctttttttttttggagacagcatatca

SEQ ID NO: 559510 - DNA, 384 bp, Homo sapiens
acgagatccagaggacggagaacagcctggccaactgagaaccagcagcccatcaatgtcggagcctgagagcggatgggcgatggagcccaatgcggcccccgtggcatctgcgagctgtccccacctgcttcagcaaggtggctcaactgtgcacccccccggggatgcttgccggcaccaagcttggggtgcccagcactgcgcaggccctgccccgctgtcaatcatcgccgtgcggcgacatagagacgaacagataggtacacagaactacgaaacgtgaaataaccgcaagtgagaagacagacagactgagaggaacaagggagaaaggaagacaaaatagaatgagagaaaaagaaatagaacaaagaaaaccga

SEQ ID NO: 559511 - DNA, 300 bp, Homo sapiens
  misc_feature (2)..(2): n is a, c, g, or t
anctgggacggcagaggttgtagtgcgccgagattgaccactgcactccagcctgggcaccgaaagagattccatctcaaaacaaaacaaaacaaaacaaaaaaaaaaaaacaaaatcacataagtactaaaagaaaatatggatgaaattctccattaccttggagtggggcaaacacttttaacagtgcactcaaatctagcagtcagtaaggcagagcagagtgcatcacattgattacataggaaataaaaagaaaaacttgttaacaaaaaagcatcataaacaaagtcacaccg

SEQ ID NO: 559512 - DNA, 311 bp, Homo sapiens
tcacttgatgccgatagttcacaagtgaagagtccaaacatcgaggaaaacatgctgagccaaaacgccttggaaggcgtggctcgtaggggcgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcagcttggggtgtgagacgccgtcgactaccctgtcccccgtggtacgcacacgccccgtcctggacagtcccg

SEQ ID NO: 559513 - DNA, 276 bp, Homo sapiens
  misc_feature (1)..(1): n is a, c, g, or t
  misc_feature (113)..(113): n is a, c, g, or t
  misc_feature (276)..(276): n is a, c, g, or t
naatggacaaatgatggatggatggcttgctagctggatggataggtggatggatggacagatggcctaatgagtaggtggatggatagatgggtgggtgaatgtgtgtgtgnggtgagtgggtggagtggacagtatggagagaaagaagagaaagaaaagctgagagcaagtggtctacatgtggaacatgttagaactccacagaaagccaaatctagtgtgcacacgccagtgcattctagagccactggtcaaccctgtggttaccgagtn

SEQ ID NO: 559514 - DNA, 204 bp, Homo sapiens
ctcgtaactgtgttaaaagtgtgtggcacctcccttgctctcttgctccctgtctggccctgtgacctgcgctcctctcccttcaccttcaaccatgaataaaatgtttccgtgaggccaccccagacagccaaggcagatgtctggcatccgtgctgccttgtacatgcctacatgaacttgttgagccatgttaaacctatt

SEQ ID NO: 559515 - DNA, 420 bp, Homo sapiens
  misc_feature (72)..(72): n is a, c, g, or t
  misc_feature (80)..(80): n is a, c, g, or t
  misc_feature (127)..(127): n is a, c, g, or t
  misc_feature (150)..(150): n is a, c, g, or t
  misc_feature (185)..(185): n is a, c, g, or t
  misc_feature (249)..(249): n is a, c, g, or t
  misc_feature (262)..(262): n is a, c, g, or t
  misc_feature (271)..(271): n is a, c, g, or t
  misc_feature (282)..(282): n is a, c, g, or t
  misc_feature (371)..(371): n is a, c, g, or t
  misc_feature (417)..(417): n is a, c, g, or t
tggagctgagcggcagatacttgagctcagagtttgagactacctgggaacatggtgaacctcgtctctacnaaaaatanaaaaatatagcggcgtggtgatgcgctgtggtccagctcttcagagntgaggtgggaggatcacgtgagnagtagggagaggttgcagtgagccgagatcgcacnactgcactccgcctgagtgacaaagtagccctgtctcaaaaaaataaaataaaatagtaaatantgaggactttctncctcacctnaggactttctncctatctagtcaaactccctccaactttccttccctgaggcagtcctacagctgccagaagaggagagaagagcaaccaagtctgaganctctcctgacttgcttagccagcagcagaggcccagaaagtcccancgc

SEQ ID NO: 559516 - DNA, 4382 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
  misc_feature (1383)..(1383): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctggtaagagtgagtgtgagtgctgagcagccctgggctcatgccccatcctccaaagcaccactgctgttgctccatgtgagggcggcactggaagaggcagggtctctgagccaacagaacagctgtgctccaagtggtttcaagtgtcgtcagatgtatcacgcacccacagactgtgccacaatccggaaatggctcacgaagtgtgcagacgactctgaaacagccaactacattagtgctcacactaaagaccctcagcgaccngccacatttaaggaggtgctcctccccagaagtgctcacaccatgagcaactgggcacaggtgccaggagctttgtgtaatttgtcttaaaaccaacctggtggtgtgtgagcctaatggcacccttctgtctcctcatgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 559517 - DNA, 4217 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagattgagtctcgctctgttgcccaggctggagtgcagtggtgcaatctctgctcactgcaacctccgtctcccgagttcaagcagttctcctgcctcagcctcctgagtagctgggattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 559518 - DNA, 151 bp, Homo sapiens
tgtcctcgacggacagaacgacgcgaaggcgcagcccgatcccgaccgccgcgaggacctcgccatggcgtggcagatcggcggcctgttcgccggcgtcgtcagcggcgtcgtctcgtggctcatcgggcagatctacgacaacatctgc

SEQ ID NO: 559519 - DNA, 4144 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtggccgttgatgctcactgccatcagctgcatcctccctatggcactggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 559520 - DNA, 4158 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccttacagattgagtctcgctctgttgcccaggctggagtgcagtggtgcaatctctgctcactgcaacctccgtctcccgagttcaagcagttctcctgcctcagcctcctgagtagctgggattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 559521 - DNA, 467 bp, Homo sapiens
  misc_feature (43)..(43): n is a, c, g, or t
  misc_feature (58)..(58): n is a, c, g, or t
  misc_feature (139)..(139): n is a, c, g, or t
  misc_feature (276)..(276): n is a, c, g, or t
  misc_feature (301)..(301): n is a, c, g, or t
  misc_feature (449)..(449): n is a, c, g, or t
aggccgggacccattgacagcacgatggtgacggagcaactangtggatgccatcggnagacgctggtggaccccaagcagcccctgcaggcccgcttccgcgcatgttcacgctgcgtgggctcggcggcccaggcancacttgcatggatcagccaggccttcgatgacgattccgccctgctcaagcaccgagctcggcctactgcctgggccagatgcaggatgcccagcgccatccccatgctggtggacgtgctgcaagacacccgtcangacgcccatggtgcgccatgagganggggaggccctggggcaatccggggacccggaaagttctggagatccctgaagcagtattcctccggaccccgtcaatcgaaggtggccgagacctgccagctggccgtgcgcaggcttgggagtggcttgcaagcaagcaacggcgnggaaccggcggcggggaa

SEQ ID NO: 559522 - DNA, 4173 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtggccgttgatgctcactgccatcagctgcatcctccctatggcactggtataactaggagtgggattgctgggtcacaatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 559523 - DNA, 229 bp, Homo sapiens
ataaaacctgtgtcggatgctttactctttcactgaacagaaactaaaataacctgttatactattagtctctaatacagtcctcgaggtttttgctcatacacttgagtatttgtctaaaacgttgtcctctttgtagcagctaggccctgccaccactgtgcttggctgagttctctaatctgtggtaacctgtagcttctctgtctattctctggctctcttctct

SEQ ID NO: 559524 - DNA, 4124 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtataactaggagtgggattgctgggtcacaatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 559525 - DNA, 4179 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
  misc_feature (1246)..(1246): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagaccctcagcgaccngccacatttaaggaggtgctcctccccagaagtgctcacaccatgagcaactgggcacaggtgccaggagctttgtgtaatttgtcttaaaaccaacctggtggtgtgtgagcctaatggcacccttctgtctcctcatgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 559526 - DNA, 4314 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggtaagtgcctactgtcctcttggattctatattgcaggtagaggactggcatggtaataggtgacagcgttgttggcttgtgcactggtagctgctgctaagaatgggaagggcagtgtttttgactccttggaggtcctggagggtgtttgtggctttggctactccttgctcccaggcctgggccatgcaagcacacaccttgtttctctgatgcaggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 559527 - DNA, 3857 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagattgagtctcgctctgttgcccaggctggagtgcagtggtgcaatctctgctcactgcaacctccgtctcccgagttcaagcagttctcctgcctcagcctcctgagtagctgggaatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 559528 - DNA, 3978 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 559529 - DNA, 609 bp, Homo sapiens
gagcgccccggcccgcccggcgcccgccgccgtcgcgatgccctactccaaagccacaagcactgaagctgcgctatcccggccgaggacgagttgcccaacgactgagcgcccataaaaactccatggagcaaggtgctgagccccgaactgtacgcgtgagctgcgcgccgaagagcactcccgagcggcttcacgggtggacgacgttatccatacaggctgtggacaatccgggccacccatcaatcatgatcgattggctgcgtggcgggcgacgcaggcagtcctacagaagtgtcaaacatctcttcgacccatcattcgaggaccggaacggcgggctaaccagacgccaggcatgagcaccaagcaccgaagcgtcaagccccgacaaccatgagggcggagacacaccatgcgaacacaaacctaggatgactggagactcgcgggatggagcgcggggaccggacgcatccggagagaactgccgtacacccacgagacagcaggccgcggaagcgcccgacgccaacgacaagctacgcggagaaaacaccggaacgcaggacgcgaccgcgcggccgatacaagcgcaaaacatac

SEQ ID NO: 559530 - DNA, 306 bp, Homo sapiens
cccgggggggggggtttttttggggggaaaaaattttttttttagggggggggggggcccccctccccttggggggttttaaaaaaaagggaaaccaaatttttttcccccccggggggggtttttccggggttttttttttcccttggggccccccccggggggattttttaaaaaggggggtttgggcccccccccttcccccccccctttttttggggggttttttgttttttttttttcccccccccccccccccctcccccccctttttggggggggaggactttttttttggggggggga

SEQ ID NO: 559531 - DNA, 270 bp, Homo sapiens
ttccagagagcaccgatatcaccttccagtggcgagaaaactgtagtgagtcacgaccctcaacacccaaatcttacatctcaatgcccatcctaacgagagcactcatacttgatgcatccccgcagctacacacacgggacacacagcacacgcatgaacacagcacacacacgagcacagcacacacacgagcatacagcacacacacaaacgcacagcacacacagcacacagatgagcacacagcacacacacaagggcacagca

SEQ ID NO: 559532 - DNA, 465 bp, Homo sapiens
  misc_feature (349)..(349): n is a, c, g, or t
  misc_feature (351)..(351): n is a, c, g, or t
  misc_feature (359)..(360): n is a, c, g, or t
aacagggtggtgttgccgctgcttttgtgggcaagccagagcttggtggccctcatgtggccccccccatcaagggaaagaaggaggaattctggcttggaggcccctggagccaaatggcaaaaaggtgaagctctcctttcctgtgtgtactctgtccagttcctttagaaaaaatggatgcccagaggacttcccaccctgggttggggtcaaaaaacagccagcaaaagttaggggccttagggccctggggtgttgttccattgaaaccgactctggccctggcccttacttgcttttttagctctttaggcctctccagtttggacctgtcccccccctccantnaggtgttnntgcagcaaaccctccccccctcccccttccattttccccccctactgcagcccctccaggcctgttggtatagagcctacctgtatgtcaataaaccacagctga

SEQ ID NO: 559533 - DNA, 281 bp, Homo sapiens
aaaaaaaaacccccggttttaaggccaaaatccggtaatggttttttccggggccggcctcccggcttttaaaaaaaaaggaaaggtaatctttccccccttaaaataaaaaaatcttggccggtgccttttttttaccaaatttggtgggccaaaatggtttatatcctggggttccaaccaaccccggggggtggtcccaaggggctttttttccttttccattttgggtttatccaaaaaagaaaaatttcccataaataacggccttttttttttga

SEQ ID NO: 559534 - DNA, 546 bp, Homo sapiens
tgggatgagatagggtagaggtatataaggtatgagcatggcaatgacagtaggaggttaagtataagagtacaaaaaaaaggagctgcagaaaaggtcaaatcctcctaaatctagtttgtcttaacatcgggacttcttactttaggggaacaaggaaaacattgccatctcatagtttgctgcagggagtatacactaggagaataagggttgccatcttcatcacgtagcaggctgaaaactgtcgagatataaggtgctgagatgtgttagcagtagggtgaaggctttggtcattttctcttttttctttgagcaatttttctttttcatctttcaaatgatctaaatcttgctctagttctactatattttccagttttctttttctgcaattctgagcagccactttattcttacccctcctacgtatatcccgaattaatgcaagttgagcttcattgaactgctctttggacatcatttcgttgaagtcaacaacagggaggttaaccataggaagatatctgggggatcctctag

SEQ ID NO: 559535 - DNA, 109 bp, Homo sapiens
atacacacacaactcatgagacccacaaaaaatagcccttctaaacgctaatccaagcctcaacccactactaggccatccatcctagcacgcaagacaggcaaatcag

SEQ ID NO: 559536 - DNA, 101 bp, Homo sapiens
cacgggccgtcgttgaacacaaacagctataaccatgcatggccggtcgtttacacaaatcagcaataaccagtcatgggcggttcgtttacaccatcaaa

SEQ ID NO: 559537 - DNA, 886 bp, Homo sapiens
ttgttataaatatagccgtcgtgagatataggagtggtggaacggcttgtcggtgactttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatattgtcttttactcccctttgactattttttgagaatctctctgtggatatgtgataattcattcatgactcattttttgaatgacccatgaatcaaatataaataaccataagcgccctaataaaggaagtttacgtcaaaaaaaatatattataattattaaatagttgaacgttcaattttatacaatatatacacatcttgaccaatctgtaaaaaaaactaataacaaatataaaagacacatcagaattatcataggtatatagtcatcaacttactttccgctcatcacattctatttaaattatttgcccgccctattcctgacgacctctattgtcccagtgaagggcgatagtataataacgccatatagcaggtatgaccacaaccccaccacttcaacctctttaggattgggttaatagatatcactagagaaagctaatacttcgcgatactaatatgatgatat

SEQ ID NO: 559538 - DNA, 81 bp, Homo sapiens
  misc_feature (41)..(41): n is a, c, g, or t
  misc_feature (69)..(69): n is a, c, g, or t
gcaggataaggaagtttttatttgcttgtttgaagacaggntcttgctttattgcccaggttggagaanagtggcgagatc

SEQ ID NO: 559539 - DNA, 144 bp, Homo sapiens
ggatagggcattatccaagtactcatctgatttaagtttgattagattgataggccatgaattacttctccatctcactaagggttaaaggcgtgcaagcccccactggctgtgtcccctgccaccgaagtgagtgacctgccc

SEQ ID NO: 559540 - DNA, 847 bp, Homo sapiens
  misc_feature (600)..(600): n is a, c, g, or t
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaacttcacttcaaaaattttaacacagtaagcataagaaaaattttgccaatgtttccttaaaaaaaggcaactcagctaggtttatgtttaccccaaaattctccttgctattttgagttttgccacagttcaaaacgctcggaactataaggtgtagaccgagacgaatctcatcaattttttccgctcctctcgt

SEQ ID NO: 559541 - DNA, 366 bp, Homo sapiens
  misc_feature (9)..(9): n is a, c, g, or t
  misc_feature (313)..(313): n is a, c, g, or t
agttaaagntgatgagttaaatcacatagtttgggttttattcaagttcctaaaactcaagttaaagaaaatccttgaggccgggcacggtggctcatgccctgtaatccccgcactttgggaggccgaggcgggcggatcacaaggtcaggagatcgagactgtcctggctaacacggtgaaaccccgtctctactaaaaatacaaaaaattagccggatgtggtgacgggtgcctgtagtcccagctattcgggaggctgaggcaggagaatggcgtgaacccgggaggtggagcttgcagtgagccgagntcatgccactgcactctagtctgggtgacagagcgagattctgtctcaaaaaa

SEQ ID NO: 559542 - DNA, 170 bp, Homo sapiens
gcagcatcatttatttgggattcttttatctgatttcaacagtgaaaaacatccctatgataaagcctaatgacccatttcacaaaagatggaatttagccttctagaaatatgacgagaaagctgactcagagaagtgagtctgatttatagggtagtagatgacatct

SEQ ID NO: 559543 - DNA, 475 bp, Homo sapiens
ttggtttttcaagaaaagccacaaaacgtgtgcgtgtgtgtgtgtgtgtgtgtgaaatctttcaatttacaagtgttaggtttcttttttttcctttaaggaggtcaaataaaacctactgaaggtggcacggcgtggggcttaattcctgaaatcccacccccttgggaggccaaggaaggcggatcacctgaggtcataattttgagaccaccctgcccaaagtggttaaactttgcccttcctaaaatcccaaaatttacttgggcattttgttgggcgcctgtaatctcacttcctgggaaggcttaggatggaaaatgttttcacccggaaccttgagtttctatgaccttaaattggccccttgccttcacccttgggtgacaaataaaaaactccttttttttttatactttcccaaatttttttatttgcgccctttcgagctcccttgggcttccccttatggggg

SEQ ID NO: 559544 - DNA, 810 bp, Homo sapiens
  misc_feature (66)..(66): n is a, c, g, or t
aaatatgtattgtcgcatattttagatattgctgagttaattgaagatatagaagtacacaaaggnggttggcacgcgtacagtttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaatgagatctcgtactaggtattacatcagcacgggaacacgtccagttgggcaggatgatttccaagggcataacggatagggcaaaatatatctcaaagcattctaatacttacaaccgtatatgaagtttattccaactcttttcttggacgcgagaactaatgtagagtaaattttaatgccccaaagatcattattttttagtattgagagaagtcg

SEQ ID NO: 559545 - DNA, 108 bp, Homo sapiens
gtgatgttcaggaggccgctgtcgtgcatttgccattttcctgacaccgctcgcgcactcaggtggccgccgtgcacccctcgccatggccagcccgacagcggccgc

SEQ ID NO: 559546 - DNA, 924 bp, Homo sapiens
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaatttggaatagcccttggtaaaaggtttcaaggagatgggtgttggtgaatttaaatgttgaaaagagaaaaggggagagaagactctcatcagaagattttagcgcgggtgtgggagaggaagatgtacgcgcgtgggtcgaaaaaaaagaaaacacgaagaggggttggtacaccccaaagacgaggtcgtttgttgaggggtggagcggtcaggaagccccggatgtaagcgcgggaaagtccgagaagtgggggctggtgcgactcgagtctgtgaagggcgtgcgggggggaggggggaaggccgaggggtgtgtgagagaggggagaggggcgtgtagaggaagggcggggg

SEQ ID NO: 559547 - DNA, 925 bp, Homo sapiens
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatgtgaactatggactaaagctttgggcatgttgttacaaattctctttgagtgggcgagaaataagaggcaggacaccaattagtgaggtagcatggggaggatctgatcgtgtgggactttggaactcagggataaaccgtagttgaaattatagaaattataattcatatatagcagtgtgcgcaatggaaagttagtttcgttattggggatacaatcacgttataggattagatgtggtgcaagagcaaggcttcgaaaaatatggagaagtaagttagaaaatgactgtaagcgctcggctactaataaggatggagtaagggaaaggatataaagaataaggccacagaaatcgacagtagttaattgagtgtgtagctcgtagtcggtgagcgtaatcgttgatagttgtgttagtagcgtgttggtttaacagtgataatcgggaggactggataaggttagtggatggggaagcagattgtaagttgagtggtgttgacgaaggtgc

SEQ ID NO: 559548 - DNA, 203 bp, Homo sapiens
cactgagcccctggatgccattgagcccctggatgctacttacatgaaagaagactttaaacaatataatcagctgcacaaaattgtacagggtggggttatgctgtgaatattaagttttcctcatataatgtttttcttcgactgttcaagtaacataattatagatttccacggtcagaatttagtttgtcaacaatgcc

SEQ ID NO: 559549 - DNA, 158 bp, Homo sapiens
  misc_feature (138)..(138): n is a, c, g, or t
  misc_feature (144)..(144): n is a, c, g, or t
taggaccccatgctgtctcaggatgtgtcatatacaagcatagatggattcatgacatacgagtccgatctgcttcatcggccatgcgatatcaccaatggcgtggtgttatcctgatacagccaagaatctagaatngatggnagctctagctggtg

SEQ ID NO: 559550 - DNA, 893 bp, Homo sapiens
  misc_feature (859)..(859): n is a, c, g, or t
  misc_feature (861)..(861): n is a, c, g, or t
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaatcccacatcagcctatgtcaaccaatcccacgttaactgctctattggaaatgataatattacatcctatgcaacgcccttgaaatagatatactcatacatctttaacacccccaagtactttatatccgattatccctctaactaatctatatcaataggcatcgctatttctggtattccctccgtcttttatttgctctctaccatctcttttcgccagacctacttctcacaacttttgtatagaagtccatacagtctgctcattgcctccatactatgtaacatngntattttttatgattcttcaatcagtttctatt

SEQ ID NO: 559551 - DNA, 863 bp, Homo sapiens
  misc_feature (600)..(600): n is a, c, g, or t
  misc_feature (798)..(798): n is a, c, g, or t
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaacttcacttcaaaaattttaacacagtaagcataagaaaaattttgccaatgtttccttaaaaaaaggcaactcagctaggtttatgtttaccccaaaattctcctttctttagttaaacttatggcccgaatttaaataatgccatntatactataatctttgattattaaacatgaaaaattaagaaatcattttacattttcacacttag

SEQ ID NO: 559552 - DNA, 876 bp, Homo sapiens
  misc_feature (600)..(600): n is a, c, g, or t
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaacttcacttcaaaaattttaacacagtaagcataagaaaaattttgccaatgtttccttaaaaaaaggcaactcagctaggtttatgtttaccccaaaattctccttactttcttaactcatgcaatattcgaaaaccccgagaactaaaacttgccaaagaggcaaatttccaaacacctgccttaattaatccaaaatgcgtagtggtgaggaactccaaatgg

SEQ ID NO: 559553 - DNA, 239 bp, Homo sapiens
ttaaaactaagtgggtacagtgaacacagtaagaagatacaaatgataataaggaaatatacaactgtgaaaatgtatgtaaggtataatagagacaggcatagtagcttgcacctgtggtcccagctactccagaggctgaggtgggaggattgcttgagcccaggagtccgaggctacagtgagctatgtcgtgtcattgcactctagcctgggtgactgagcgagaccccatctct

SEQ ID NO: 559554 - DNA, 121 bp, Homo sapiens
tcgttaacgctcgattcgcgtacaatcaggcagctgctgacgggtcagtttcctttctgggggccccgggcaggcgattcccctctctgtagcgtccagtttttcatcatgtaccgtgggt

SEQ ID NO: 559555 - DNA, 485 bp, Homo sapiens
gttgaagcaagttttcagacaaaagggagataatgagtttattgatatgttgaacaatgtgcgtgttgggaacttgaattatgaaaccattgaagcgttccaaaaattggatcgacaaatcaactacactgacggaatagaaccaacacagttgtacccaactttaaaagaagttctgatggcgaatcaagcaaaattaaacagtttaccagggaaagtatacactttccaagccaaagatccagaaaacccttttctcgtcagtatgcttgataataatcttatggtggataaagttcttcatttaaaaacgggggcccaagtcatgtgtgtcaaaaatttcactgatgaattggtcaatggtaccttaggtaccgttttatttatggctacccgtaaactttatatgaagtttttggaacaatatgtgtatattgatgcggaagaccaggcggcgcttgctgaaatgaggttcgtatgtaata

SEQ ID NO: 559556 - DNA, 215 bp, Homo sapiens
cgatagagagaaaacagaagagttacaaaacactgagttataaagaccacgaccaactttacctacagtactaaataccctagtgtctagcactgtaactagacactcattctagccaccccattaaaaagtccatatttgatctttcttccaaatttccaagattctcttacacgtgtgctctctctcctattaggcacttactcgatttatct

SEQ ID NO: 559557 - DNA, 1098 bp, Homo sapiens
gtgagagtctctagaaaccagaaaggataagacaatggaaaagcattctccccagattgcctccagatgggaacatagccctgccaacatctttgtgttcatcatgtgtatgttggagaacggatatcttacgcgtgtgtgtatgccggaggtgtgcgttcgaagtggggtcgaccgcggatcaggtggtattcctcccggccccctcggttcggctggctctttgctcatcgtttgcttgtgactgtgctccacgggacgagcttgacttgtgtgaggtcttgtgaggaccggaaatgggggcttcactggggtttctccatgcggatactaccgagctcgagtggctttggtttcacccgggtttctgtcctgcccagaagtaggcgtggctcgtcaagcagggtgtatgaaggcacgcagagacccgcaggtcgttgcctgtgacggagaacaatggtagggattcgaatgaccatagtggtatggccatagtaagcggtctacggggggtgcccacagagacatcggttggagaaggcgtccatgttggccgcttgggttcgaccaggcgcatttgaattcttaagacgctgaaagcttgtttattgtggccacacgaatggattgttcctgaactgaacctcacaatatttggcggctgcgcagcaagattatcccagggtgcatataatattcctaagtatttacaacatttggcacgcgggcgtcggcaaaataaacctagataatggcgggcgtcccttgtgagagggtgaaaacggctactgcacactgcggaacgatcggcttgaggagcatccggacatattggcgcgtgggcattaccacattagaggtcgaggaaacgaggtccctgcgaatgacgaagtgtgcctggctatggatagctcctggcgaggtcatgagtggcgccaacattgtgttgtggcccccttgcccaagtgtttttcggcccacggtatgggaaccccaactgacttgtactctttgacccttaaaggataccacgcgcaggtgggaccgaactttgcccaagggttgttaacagaatggattactttacacaacacttta

SEQ ID NO: 559558 - DNA, 596 bp, Homo sapiens
gcgggcgccgccatattggctgttgtcctgtgaggggagcggtagcggcggcggcggcggcggcggcggcgcagtagccgccgaggccgcctgcgccatttaacaggcaagtattaagtgctatggtggtgcagctgcttcggacaatcttccagataaattcgagccgaaaatgacgaagacaaaggggaaagaggagaggatcgctgatatatgttcatctaggcccatgttaagaagaagatggagttgtgcctttggtcacatatatgcagaatctgatgagaaaggtgatatttgtagcacagtctaagggaacgttgggtacatgttcaagacagaggaagtgagccagcaaggtgttagccagtgggcaagaaagtggagagaagtcgtacaagtgttagcccgagtgattgttgtagggcgatagaataggttaaacgaagaggaggattaagggggccaggaatcattgattaatggagaatttaatgatgcgatattgaagaacaatgtaagcagactcgtaaaaacccgagaatagcttccttaaaccgatgtgaagggagaatgatcagaaaaacggaaagaag

SEQ ID NO: 559559 - DNA, 477 bp, Homo sapiens
ccctccccaattagaaactaccgcgccaagaacaacactatttgtgtatttttcttattaatataagaaggcaggaatgtcaggcctctgagcccaagccaagacatcgcatcccctgtgacttgcacgtatacatccacgtggcctgaagtaactgaagatccacaaaagaagtaaacatagccttaactgatgacattccaccattgtgatttgttcccgccccaccctaactaatcaatgtactttgtaatctcccccacccttaagaaggttctttgtaattctccccacccttgagaatgtacttcgtgagatccacccctgcccacaaaacattgctcttaacttcactgcctaacccaaaacctataagaactaataataatccaccactccttgctgactctctttttggactcagcccacctgcacccaggtgaaataaacagccatgttgctcactgtggagaaggg

SEQ ID NO: 559560 - DNA, 307 bp, Homo sapiens
  misc_feature (30)..(30): n is a, c, g, or t
  misc_feature (53)..(53): n is a, c, g, or t
  misc_feature (58)..(58): n is a, c, g, or t
  misc_feature (90)..(90): n is a, c, g, or t
  misc_feature (132)..(132): n is a, c, g, or t
  misc_feature (138)..(138): n is a, c, g, or t
  misc_feature (145)..(145): n is a, c, g, or t
  misc_feature (150)..(150): n is a, c, g, or t
  misc_feature (170)..(171): n is a, c, g, or t
  misc_feature (178)..(178): n is a, c, g, or t
  misc_feature (198)..(198): n is a, c, g, or t
  misc_feature (207)..(208): n is a, c, g, or t
  misc_feature (213)..(213): n is a, c, g, or t
  misc_feature (216)..(216): n is a, c, g, or t
  misc_feature (233)..(233): n is a, c, g, or t
  misc_feature (236)..(236): n is a, c, g, or t
  misc_feature (240)..(241): n is a, c, g, or t
gaattccccccccccccccccccccaaaanttatcaagactagggtgaattanttagncccagatctttcagtagaccagttatttttanagggattcaatatttttagtaactactccatcttcctttctngtttanggtcatntgggntcaaccatctaaacattttnntccaatnctgttttcctgaggtttctnccatctctnnaattnatntatgtatgtattaatcnatntatnnggggatggaatttcactcttgttgcccaggctggaatgaaatggtgcaatctcggctcactgcacc

SEQ ID NO: 559561 - DNA, 167 bp, Homo sapiens
aaccatggatgtggtgagcaccacctcgcgacactgcgtcagcctgcccgcctgtgtcctgcccacctgcagctgcggccaacgactgtcatggtgacagccacatgacctcgcaggtagcctgtctgtcatgcctgctgggtgctcaggcagtcgtggttgctccc

SEQ ID NO: 559562 - DNA, 3735 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaaatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 559563 - DNA, 2061 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtgagcagtgttgtaaactccagtgtaatcccccccagttaaatctaaggatgagctgttgttaattaatgtctcctccagactaattgaatggccttgtagcttgaaaccaaatttaagtgtatgtcaacatcatttggacattttgttacatttactttgttttctaatatatgcatgtctaaggtcctcagattcccaaattagtaagaattagaaagtaggggtgggacagattcaagaaagatgtaccataccagaaatgtgtagtagcagaattgcacaactttgcacgtttcaggaagtgagttttcagaattttatgaggttgatacaataagcatcagaatcaccatcttctgtacgactgtgagtgactgataaatgtcttgagagtatacagatccctctggtttgccctgaatagtcattgcctttgggctaatgagctcatttgtttcatgtactgattttaataataattctttcttatgcttgtatttcattgatttagggggtgttagtatggaaattgtaaagaatgaacaaagttgattaccccatcagcaagcattttatttaacacataagctaaaacatacctttggatgtcttgtaccttaggccagttattatcctatttacattttttatgatcattttgacagtttcccaacaagcatgtttccttctctaacactggccattatgggaaattggaaatatttctctttagtgttttcactaatcttttttcatgaattgttacttggattttgtttctgattaaattggaggtcaaaagggcaccttggcatgatgtcaaccaaataaattttattggaacttaaacagaaaaaaaaaaaaaaaaaaaaaaaaaaaaaaaaaaaaaacaaaaaaaaaaaaacaacaaaaaaaaaaaaaaaaaaaaaaaaaaacaaaaaaaacaaaaaacaaaaaaaacaaaaaaaaaaaaaagaaaaaaaaaacaaaacaaaaaaaaacaaataagaaaaagaaaaaaaaaagaccaaaggcagaaacaaaacaaagaaagaaggggaggaggaggacacagtacagacaatcacggaggacgaacaacccaccttacatagtaacctagacagagaaagacaacaagtgcgagacacgtatatacaacacagacctcagagtaacacaaccgtcgaggcgaagaacacgcggcacacagaacagtagacaaactcactacgagtggcgtactgaagaacacacagataaggatatcaccgaggcaggaaagcacagagcagagctcgcgtaacacaacaaaaagccgccgagacaaaggacccggagaaacacaaaccacaacagagacacgacggcgagcagacgcgagaaccgcaggccgccacggccgccacaacaccggcgaagacgaagacaccacggacacacaccacacggacact

SEQ ID NO: 559564 - DNA, 1137 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
  misc_feature (700)..(700): n is a, c, g, or t
  misc_feature (753)..(756): n is a, c, g, or t
  misc_feature (765)..(765): n is a, c, g, or t
  misc_feature (792)..(792): n is a, c, g, or t
  misc_feature (838)..(838): n is a, c, g, or t
  misc_feature (884)..(885): n is a, c, g, or t
  misc_feature (888)..(888): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggttgagacggactctcgctgtgtcacccaggctggagtgcagtggcacgatctcggttcactgcaagctccgcctaccgggttcataccattctcctgnctcagctcccaagtagctgggactacaggtgcccgcacacaccggctaaattnnnntgtatctcnacgtagagacgggctttcaccttgttngccaggatggtctcgatctcctgacctcatgatccacctgctcagnctcccaacgtgctgggattacaggtgtgagccaccgcgcctgtccnnatngtcactttttaaggctgtccccagataggatggagaatatgcaatttatacaaagtttaatacatttcttcttctttatggatggtgtttactggagtaaggttgaaatttcttgaaattattttggattcttggaatttttaaattgggttggttgcaagggtggatttttaatggggggtatccttggaaagaagaggggtggaagcggagtactggaaaagtgttagaaatgggtaaattgttaaa

SEQ ID NO: 559565 - DNA, 846 bp, Homo sapiens
ggtcagaggaggcgcggggagagtagggtgctgtggtctgagctagagggtgaagctggcggagcaggaggatgggcgtctgaatgccagaatggataaccggtttgtgctacagcatttgtgtaatggctgtgtgtgcttagcctcatttccacccatctacatggcagcctccatggcacagacttctggtatgaatatcgaagtccagttcaagaaaattccagtgattgtgaataaaagcatcctgggatgaattcatttaggtgatggaggcagcatgaaccagattataatgatgcactttttcgatacacgtggcacagtgggatgtgtggacgacggtgtatcaccatacccaaaaacatgcatggtatagcccaccagaaaggacagagtcattgatgtggtcacaaaatgtgtgagttccaccactaactgagcagttcatggagaaattgtgatccggaaaccacaatagcgggatgatctccttaggacctatcttgtggcgttgccatgtcccttttacctttggtgagtcaaggttgatgtgcttggggggcttggatcggacttggttgcttggattttgcgaaggttttatatccccaccatttggcaggggattctccatctcttgcaggtctggtgtacacgtgggctcagcaaagttggtatgtgctggaattgatatcaccagaaatagagtcctgaaggttcgggattgggttgcttctgctggtgggtttgccctaaagcaggtttggcctcatggtgggcacaacggagagcctagaaggttggggtgcaaaggcggtaagctttttacaaatgttccctcag

SEQ ID NO: 559566 - DNA, 767 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtgagacggactccagcctgggcaacacagcgagactccgtctcaaaaaaaaaaacttgaatgatttcacagtgatgaccatgttattgatcataaatagagaaaaatacggcaggatgagcaaggggttgtcggagattttaaaaggaaaacagagctgtcttat

SEQ ID NO: 559567 - DNA, 1259 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
  misc_feature (822)..(822): n is a, c, g, or t
  misc_feature (875)..(878): n is a, c, g, or t
  misc_feature (887)..(887): n is a, c, g, or t
  misc_feature (914)..(914): n is a, c, g, or t
  misc_feature (960)..(960): n is a, c, g, or t
  misc_feature (1006)..(1007): n is a, c, g, or t
  misc_feature (1010)..(1010): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagattgagtctcgctctgttgcccaggctggagtgcagtggtgcaatctctgctcactgcaacctccgtctcccgagttcaagcagttctcctgcctcagcctcctgagtagctgggattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggttgagacggactctcgctgtgtcacccaggctggagtgcagtggcacgatctcggttcactgcaagctccgcctaccgggttcataccattctcctgnctcagctcccaagtagctgggactacaggtgcccgcacacaccggctaaattnnnntgtatctcnacgtagagacgggctttcaccttgttngccaggatggtctcgatctcctgacctcatgatccacctgctcagnctcccaacgtgctgggattacaggtgtgagccaccgcgcctgtccnnatngtcactttttaaggctgtccccagataggatggagaatatgcaatttatacaaagtttaatacatttcttcttctttatggatggtgtttactggagtaaggttgaaatttcttgaaattattttggattcttggaatttttaaattgggttggttgcaagggtggatttttaatggggggtatccttggaaagaagaggggtggaagcggagtactggaaaagtgttagaaatgggtaaattgttaaa

SEQ ID NO: 559568 - DNA, 1806 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaaccaggacagagccacaatcttcctctattcattgtaatttatatttttcacctggtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 559569 - DNA, 839 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
  misc_feature (408)..(408): n is a, c, g, or t
  misc_feature (435)..(435): n is a, c, g, or t
  misc_feature (481)..(481): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagattgagtctcgctctgttgcccaggctggagtgcagtggtgcaatctctgctcactgcaacctccgtctcccgagttcaagcagttctcctgcctcagcctcctgagtagctgggattacaggtgcatgccatcatgcctagctaatttccgtatctcnacgtagagacgggctttcaccttgttngccaggatggtctcgatctcctgacctcatgatccacctgctcagnctcccaacgtgctgggattacaggtgtgagccaccgcgcccagcctaattcctgtatctccacgctacacgatggggatgtcgccatgttgcgctagggctggcctcaatctcctggcctcaggtgatctgcgccaccttgggtcttcccaaagttgcccgggacttctcttctattctttccttgttcttctttgtgcacccggagctctccctctgatctccccaccctggacgtgccgttgcgcgcgacctcgggctcccgtcgcacctccgcctcccggggttccacccctttctccggccctcagcctcccccgtactgtggcactgccggcccctggccctagtcccggcta

SEQ ID NO: 559570 - DNA, 1039 bp, Homo sapiens
  misc_feature (954)..(954): n is a, c, g, or t
  misc_feature (995)..(995): n is a, c, g, or t
  misc_feature (1017)..(1017): n is a, c, g, or t
  misc_feature (1037)..(1037): n is a, c, g, or t
  misc_feature (1039)..(1039): n is a, c, g, or t
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaaacaagcaantatgactggctaaaaaggaaccaaacccaagggacaggagnccacaaatccttccctcccaantttcaattggtaaattttanan

SEQ ID NO: 559571 - DNA, 1188 bp, Homo sapiens
tcgagatccattgtgctctaaaggctcgccctcctgtgcatcgcggctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccatggcacatatatacaatagtgattggctttagagcacaat

SEQ ID NO: 559572 - DNA, 353 bp, Homo sapiens
  misc_feature (23)..(23): n is a, c, g, or t
  misc_feature (26)..(26): n is a, c, g, or t
caatgagcagcattgtaagttgngangcattcatttggattggaacattctcaatcagtccttccactctaagtaaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 559573 - DNA, 1807 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 559574 - DNA, 323 bp, Homo sapiens
ttttttttttaaacagggtgtcagtctgttgcccaggctggattgcagtggtacgatcttgactcactgcagccttgccctcccagtctcaggcgatcctcccaccttagcctcccgagcagctgggactacatacaagcatgtgccaccacatctggctaattttgtatgttttgcatgttttgccatgttgcccaggctgttcttgaagtcctgagctcaatcaatcttactgcctcggcctcccaaagtgctgggatgataggcatgagcaccatgcctgacctctcagtcataaggcctctgttttaatgtggtcgacg

SEQ ID NO: 559575 - DNA, 1915 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 559576 - DNA, 174 bp, Homo sapiens
tatcagttcctacaagcacactacctccagtcttcgacgactttgctcactacgagaagcgccaggaggaggaggatgtggtgcgcaaggaacggcagagtcgaaacaaacaatgagggcgaaccagctttcttacatgttgctaacgatttgtactttgataaacaagtttat

SEQ ID NO: 559577 - DNA, 1914 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaaccaggacagagccacaatcttcctctattcattgtaatttatatttttcacctggtattcatttgtaaaactttgtattagtgtaacatactccccacagtctacttttacaaacgcctgtaaagactggcatcttcacaggatgtcagtgtttaaatttagtaaacttcttttttgtttgtttatttgtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 559578 - DNA, 1964 bp, Homo sapiens
  misc_feature (1817)..(1819): n is a, c, g, or t
  misc_feature (1821)..(1821): n is a, c, g, or t
  misc_feature (1825)..(1825): n is a, c, g, or t
  misc_feature (1829)..(1829): n is a, c, g, or t
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactaccaaaaaaaaagnnncncaanaccncaaaagacactgttgcggcgccctggcccgaaaaggtttaacacccttgttggggcccggccccgtgttttgacccgtggcaagcgttcccaggaaaccggcgcgacggggggtcccccaaaaacccgggaccgg

SEQ ID NO: 559579 - DNA, 645 bp, Homo sapiens
aatgggagatagggtcttaactctggtccaggcgggaggagtgcagtcgtacagtcagggctcactgaagtctgtgaccccgctgcctcagcctcccaaataactggggccacaggtgtgcaccacaactctcagtctaatttttaaaattttttatagagggtggggtttatactatgcgtggtccagaacgtggtcttaaacctccgtgggctcaaggtgatcccccgtgcctgggcctcccaaacgtggtgagattacgggcatgagccaccacaacgtggccgtgaaattcttaagggatgggagtgtcgatgacagcacctggcatcgtgggtgcctaaccgtgggagacggaaggaagcacgccaggggaagtgtttccctgtggggacaaggtgctaagtatgggggagcccatagcccctgtgagatagatgggctacttggcctttcttctggacctggtctggcagaaggtgggattgggggtaagtggtcttgagggatccatttagtcaccctcaaattaagattttaacttcatcatttctggggcctgcacctccaagataacaaagaagaagcatgggtcgtgccaaagaggtccacaaccaggtgtgcacggttcacttgcagcccatt

SEQ ID NO: 559580 - DNA, 189 bp, Homo sapiens
ctgaggatcacactacagcagctatccagagtacatcaaagctgtgagactatgaatgtatacagaccaccaagctcagtctatcccagtgagtcagcaagacttaaggcattgttcagtatttcatgacttgcggtgatttgacttgaaaagaaagatttcggtttggtccaagtaactgaacaactg

SEQ ID NO: 559581 - DNA, 312 bp, Homo sapiens
agatgcatgcccacagcccggtgatcatatgatcttctcagtggacacactcttgagtctcataatgcaaggaagatcccagcagtcatgcacgcagccccttgtaaccatataaaatgccaagccatgttttcatcttcctggagctgcaatgctcctgctggggcataatatagacgtcaatatcttccttaggttcctccttgtggcattgtctcaatggtccggtgcagagggtccacgatctgccagatggcgagagtgtggcccatccatgcccaccggcaggcccattgtggctgccatcccttt

SEQ ID NO: 559582 - DNA, 1791 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 559583 - DNA, 995 bp, Homo sapiens
cgttgcgtccgtcgtgcgacccgaggctccgctgcgcgtgtgccttcgtaccggggctccatccatgacttcccagtgctttgagcccaaccaggatgccgaggctctgtagactgccatgaggggcttcggctagtgacacaggaggccatactgtggacatacttcaccctacacggacacaacatggcatgagagcaggaggtctttcaccgatgcctacaaagtccctctacgcgcgaaggaccgtcaattgctgactttacaacgtactgacattgacgggccaagctatcgaacgcgtcctgattcgtagggcctgactgacggccacgcatgcctacttcgtgactgccaacacgaaacttacaatgactgccactctcgggccactttgggactgactgacgacacgatgcctcaattgcacgactcttgcgcttcccggacccaactgagcccagatgcaccacgctgcgttggccagcactacccaatgactgccctaccgagcgcggaccctggcaaggctgacatcatcgagggcaaaccctctggacaacttccatgaagcatgcttgctggtacctgctcccagaggaaccaaggcaccgacgactgaccgtacatgtacgccgaaggaaccctgagataccaaccacaggcactgtcccaggcacccgtactaccgcaagccaaggggcaacctcgcaacactcgcgcgaaacacgattgcacacccccagacacactagacacaactacgtctgcacccaaacatccgccagcgcaaacgccagagaattccttaacggcaattggaatggtacggacttgagcgtaattcacgacaacgaaccccaagcagcgagcaaccccctgacatggcaaagccccagtccataccgacgtgagcaacccatgacatacgacccaacaccctcgcccacaaccctacaggcctaggccccgaacctcgacatcgtgataatccc

SEQ ID NO: 559584 - DNA, 2030 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactaccatgttaaaaaaaaaaaaaaaaaaaaaaaaaaaaaaaaaaaaaaaaaaaaagaagagagagagaaaagaaaaaaaagaagaaaaaaagaagagagagaagaaaagaagagaaaagaaagaagaagaagaaggagagaggagaagaagaagggggagagacaaggcgacgagcgcaagagaagaggaggaggtgggggagaggagacggggcgagggggtggagga

SEQ ID NO: 559585 - DNA, 615 bp, Homo sapiens
gataaaggctggacatggagaagaggctgcgggatctggagaatcagtaccggaaagaagaggaagaagccgatcttctgctggtatcagcagacgtactgtctgcagtactcgagacagcggaggatgactctgacaagcgcatcttgtgaatgagagcttggaggctcattctcctccattgcaggagcagctggcgaccaccatggtccatgatcattgtcaaactgctgtggtctgcccagcagtgcgaagcgcagggcccctctcagggtttatcagatcccccagtcgaccgcgaggctgccagggctagagaccctccgtgtgtggccaccagtggtctgacctgaagatgcaggtcggtgaatgagatctgctacgaggtggtcctggctgacttccgccacgggcgggctgagattgaggccctggccgccctcaagatgcgggagctgtgtcgcacctatggcaagccagacggcccggagacgcctggagggctgtgtgccgggatgtctgggacactgtaggcgaggaggaatgaggtggagctggcaatggtggtggctgtgacgcaggagcccgaggagtgatgtgggactccgtgcccat

SEQ ID NO: 559586 - DNA, 587 bp, Homo sapiens
aattttctttatatcccttttaaaaaaaaaatacaataaattaaaaaaacccaaaaatattataaacaaaaaaaaaacccaccaatatcccccactacaccaacatcaactcattctcacaccaacaacaaaaaaatttaaccaatccaaaaaaaaacaactccacaccgcaatcctcgtcatagatttcacccatccaacatacccaactcctcaacaacctcataaaatttcttcttcctctcctcctcatccaccccaatacaccaccataatccaccccgacaaaccttaacacctcacatatgaaaaacattaaactaaactcacgaaactcaccccaccccacacccctgttacgacatccacaacatctaaaaaacccacaccataccccaatatatccccctacacatattcaaactcatcactcccataaacttaaaccctcaaaaataaaaaaccactttataaacaaacaattccctagaccttccgctcaatatccaacaaaataacttatattaacccccctattcccctctactaaaccccaccaccatccacactaaatcaaacaacacccc

SEQ ID NO: 559587 - DNA, 1143 bp, Homo sapiens
atctgtttgttttttgttttgcgtgtgagtgcgccgcgcagggtacgcgcaagcagacgggggacgatcgttgatgtacatgttgttgttttcgtttgctgatgcgggtgtgaagtgtccacatttggtgtgctgtgctcgtcctctactcgtccctggcctttcttctgcgagatgctctcggcccgcctcgtgtggcacccaggtttgtggaaaaacccccgggtgtaaagaccgtgttccgcctgtgggagtttgtcccacgcttttccttcccgggtccggttccctgtagttcctgccgtgtcccacgctggtgtagtctcccgccctcctatgtggatggtccaacaggtttgtctttaaaagtcctgtgacgcatgtgtgtcccatgtgggcagatcctggatatcctggtttcacggggcctgatagatgagggcccagacctttggtcatcttcaaggaggtcatacagctgccccctgacgccctgcgctcccaagcagggtttccacctgtctgagggccgaaccttatgcgtatcccgtatgcccagaccgactccagatatccagttgccccagatggaaaggccacccttcgtgggaacggggacccccagcgggagaagaaggaagccccaggatcccggaggaccctacgagctcaatgcttgttccccaagcgttgttccaatcccagttccccctggcgttctaagagagagtcccgtcttgggtacacccgggcggctcatgtaccatctgcccttctgtgggagatgttgcaccacatgaggtcacccagagccggagggccagcttctccgatgcccctgtccagggctttgtagatcaccgcacggacacacgccctgtgagattctcctttgcccagaagtagcaccctctttccccccactgcctgcccctttgcccctgttctggggccacccccttcttcccccttggctcagcccccctgaaggtaagtccccccttgggggcctttttggagaccctgtgtgagatgagtggtcgcccacccagccttgtaccccgagtctgtcccccagaccttgcacctggcgctgttaggcccggaattaaagtggctttttgaggtttggtttttccacca

SEQ ID NO: 559588 - DNA, 424 bp, Homo sapiens
  misc_feature (232)..(232): n is a, c, g, or t
tcaccatgtgtctctcgcagctgcgacccgaccatgaccatcctgcaggccccgaccccggctccctcttcaccatcccgggacaccggcggggctccggtcctgagatcttcagcttcgaccctctcccggagcccgaagcgtgccctgccgggcgcccccatcgccttctcggagtgggctacccggaaaatgcgcaaagcacaggactagaggttgcttctacacgctnccgaacgtttggtccccggtgtccggcacaagggcgttgccccaagtgtccaggaagggaaaaccctgaaaatccccaaaggaacccaagagatacggggccatatccttcgtttgtccgttggccttagtcgtacaacccaaatttcaggtccttttactttgcccccaagaaatttcccctagaaattgg

SEQ ID NO: 559589 - DNA, 260 bp, Homo sapiens
acaaacaacatgaagcacatggcttggagataacatggggcggctcccatagcaacaagaagcttttggcctccttgggaatagacacccgaaacattctcttcacgggcaataagaagcagcctgttatagtggccatgtatgcagcaggattgggtatgttagagcccaccaaggaatcactgaaaccactttctgctgcagaaaaaatagcttccatcggtcagacagccaccatgtgcttcatgttggttgggtac

SEQ ID NO: 559590 - DNA, 369 bp, Homo sapiens
  misc_feature (11)..(11): n is a, c, g, or t
  misc_feature (85)..(85): n is a, c, g, or t
  misc_feature (98)..(98): n is a, c, g, or t
  misc_feature (304)..(304): n is a, c, g, or t
aaaacggagancactgccactcaacatcaggttagcttcttaaaaacttagcttatatatgtgtagcttaaaagaattctgacanccggacgcggtgntcacgcctgtaatcccagccactatgggaggccgaggcgggcggattatgaggtcaggagatcgagaccatcctggctaacacagtgaaacctcgtctctactaaaaatacaaaaattagccaggcgtggtggcaggcgcttgtagtcccagctactcaggagactaaggcaggagaatagcatgaatccaggaggcagagcttgncagtgagccaagatcgtgccactgcactccagcctgggtgacagcagtgagactccgtctcaaac

SEQ ID NO: 559591 - DNA, 183 bp, Homo sapiens
ggtcgcagcacctgctcctttctatctttcgggagacagcaggccctctacagccacctggtctcttcttcaccttccccacccctgtccagcgctagtatctcagtctccttccatctatcttctccatcccactctgacctctgattgccctttactctgctagccctcagctctaagaag

SEQ ID NO: 559592 - DNA, 144 bp, Homo sapiens
tgcttgtaggtcgatctctagcacggatcccccaacttcgatcgcggagaaacttggtgtgcactccaagtacacgtgatggactatagtgtttacagttaatgtattcaattgcatttccttgtgtcttatgctctaaataac

SEQ ID NO: 559593 - DNA, 227 bp, Homo sapiens
attgcatggagctgcagcagtcatccgtcagcccagaagccaatacagaaaacaaaaacaatcacagtttctcatcagttacctagaataaaagagtagaccgtgaacaagattcccattttattaaaataattaatatatttccaaaagaatgactgtaatttatctctaaccattggacctaattgcccacagtttgatcccgctgcagagagtcatatccatcc

SEQ ID NO: 559594 - DNA, 878 bp, Homo sapiens
  misc_feature (747)..(747): n is a, c, g, or t
taatatcccctttcttaaaagacaagctagtatactggaaaaagaaaaaaataataataaaataaaaaccaagacaacttttagtaccctcatctttattggggaaggggagggggaactccgtgggtcgcccaccctcacccgtgctcttcccagctcagctaagctcgtccctcggtgccccccctttggggggcgatgggagaggaccagggtgggcgtgtggagggtttcgtggaactagcagagggtggtgagtggggcagggtggagggtgggagcataccgtgggaacccggggctcgggggaaacctcgggggtgcccaggacgggaaaggggcacgctagcattggcggtgcagtgccgtaccagggttgaaagggctgtggcccaggcagcacgtgtcggtatacaccattgtctcaaaacggggcgaagggccggggctgctgcgcttcgtagaggccttgctcccttgggacctgggtctcccatctggaccctccaaggccttagctggcctcacatgtcggggcaggtatccacctaaccagggctgcagggcaggatggatgggaagccggcgaatggggctaggaagaacgctacaggtggcttgcgaatgttgggctggggccccgaccggtgggcacctataaatactatggaagttatagccaattcacgagctccgactagtgtctgtgatggtaaacattcctatatactccggaccttggtatcnccctgtggtcccactaacaaacaacatgcaccggaacccagataaacagatatatccaatacaccacctggtggctgacaaataagcacaatactgattacctaaaaaatgacacgggacaacatacgaca

SEQ ID NO: 559595 - DNA, 679 bp, Homo sapiens
gtcaccctctcctgccctgacgtgtcagcctgttgcgaagtgcagtccgaggtcatagatgagtgactatgagagcgggcacgacgagtcacttcgaagaggtgatgatccgcctcctggattcccagcagcacacggaagtctgactctcgaactcccgccaaagtgcctgagctttagtgaatctagaggtcatatgagtaatccgcgctgttcttagcatcactgcattcactaaactttttatggtcagccgaatgaggcatagcatgtgctgagatccagcgaccactgagacggtgctagccatttccagtgtcccaactacgtgctcttcgtgatgctcttgatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttatgtacattttatgtacagatttgatttttcatagttttaactagatttccaagatattttgtgcatttgtttcaactgaatatgggtggtggtagtgccattatctagcaccctgatattatttcttactataaccagggttacatactgtctatttccactgaagtgtgacattttgttagtaca

SEQ ID NO: 559596 - DNA, 131 bp, Homo sapiens
aatcatctcgcacctgtatccggggaggctaattatgataagctccatctgcctacgacaaacagaccttatatcgctcattgcatatctctttcaatactgccaccattgccctgcgtattaagcagtcc

SEQ ID NO: 559597 - DNA, 82 bp, Homo sapiens
ggatttgctggtgcagtacaactaggcttaatctcgaattcaagttctaacgttagaagcttgaattcgagcagtagtagta

SEQ ID NO: 559598 - DNA, 617 bp, Homo sapiens
ggcatgtaccaccatgcccggctaatgttgtatttttagtagagatggggtttctccgtgttggtcaggctgatctcaacctcccaacctcaggtgatctgcccgcctcggcctcccaaagtgctggaattacaggcgtgagccaccgcgcccagcctacaggtgtctctttgaaaaaaaagtaggtttattttaaattctttaataaatcttcatattgctttcaataggggttgaactaatttacattcataccaacagttcccttttttctgcatcctcaccaacatgtccctttttttaattttttaatagtagacattctgactagtgtgagatgatatctcactgcggttttaattgtttatctgattagtgatcttgagcatctgctcatgtgtgttgccacttatatgtcctcttttgagacgtatctggctatgtcctttccccactttttaatgcggccttttttcttcttaataagttccttatcgattctgggcaattggccctttgtcacaagcttagttctgtatttcctccggtttggacgttgcctgtccctgggtagcttcttccctatgccaacgctcttcgcttaatttcccttctct

SEQ ID NO: 559599 - DNA, 330 bp, Homo sapiens
cattagctcttatactttgattaaaatatactttaaaaagatgctgttagtggccgggcatggtggctcaccctgtaatcccagcactttgggaggccaaggcgggcagttcgtgaggtcaagagattgagaccagcctggccaacatggtgaaaccccgtctctgctgggaatgcaaaagttggctgggcgtggtggcaggtgcctgtggtcccagccactcaggaggctgaggcaggagaatcggttgaaccggggaggcggaggttgcagtgagctgagatcgcgccattgcactccagcctggcaacagagcaagactccatctca

SEQ ID NO: 559600 - DNA, 184 bp, Homo sapiens
  misc_feature (9)..(9): n is a, c, g, or t
  misc_feature (12)..(12): n is a, c, g, or t
  misc_feature (18)..(18): n is a, c, g, or t
  misc_feature (29)..(29): n is a, c, g, or t
  misc_feature (31)..(31): n is a, c, g, or t
  misc_feature (41)..(41): n is a, c, g, or t
  misc_feature (53)..(54): n is a, c, g, or t
  misc_feature (74)..(75): n is a, c, g, or t
  misc_feature (78)..(79): n is a, c, g, or t
  misc_feature (95)..(96): n is a, c, g, or t
  misc_feature (114)..(114): n is a, c, g, or t
  misc_feature (127)..(127): n is a, c, g, or t
  misc_feature (139)..(139): n is a, c, g, or t
  misc_feature (149)..(149): n is a, c, g, or t
  misc_feature (157)..(157): n is a, c, g, or t
aggggtggntcncgcgcnactggctattncnataacttatnattagcaccacnntacctggcacactggccttnnctnnaccgagtgaacatttnnaaatagagcacacttcanatactgccgagtncacatgtaagtnagagtgttcnactctagnaaactgtgtagtgcaaagccaagatat

SEQ ID NO: 559601 - DNA, 150 bp, Homo sapiens
gccaatggcagcagttagctgggggcttctgaagggatgcacatctttagcagatctccctcatgtacttatactgttttacacagtggaaacaggtagagcccctcagaggatgaagggagtgggtattgcatcagctttattgtctgg

SEQ ID NO: 559602 - DNA, 532 bp, Homo sapiens
tcgtggttgtagtccggcgagaataccaaaaaagcaaaaaaaaaaaaaaaaaaaaaaaaaaaaaagtgtgtgtggggggccgggggccccgcgaaaaagctttctaagaacaatgcgggtggggggggggggcgccacaggtaggagataagggacgaacatggggcacaaagcgcgggtccccataaggagaagactccggggccaggagacaatagggggtgggagatttcttccccaatataaaaaagcgcgccggggggggaacacgggggcggtcctgggaaaacaacctccgagagagggggaacacgcgggagagggcccatagacggggggattcatatctacacgaggaggagtccacaagaggaggaagccggaaaaaatccaaaaatattaggccccgggaaaggggggagaacaacagaaagaaacaacaaacaacacaaacaaacacagaacagcaaaaaacagaaaaagcagaagacaacaaaaataaacaagctacaccgaacaatcaaacaagaaa

SEQ ID NO: 559603 - DNA, 294 bp, Homo sapiens
agacctagaggatccccgctacaacgccaaggcgattagcacatcgccgaggccacgctggacatttgtggtggtggcgccccgcgcgcccgaatcgaggaccgggacattgcggaagatgcgcgacaccagttcacggctttctgctcgttgccgcccggccgcttcagggcccaggcccaggcggccagatagttccagcgggcaccgcccgaggtcttgggatttggcgtgatcacgctgaccccgggccgggccagatcgtcccagtcccggatcgccttggcgttgtag

SEQ ID NO: 559604 - DNA, 198 bp, Homo sapiens
  misc_feature (7)..(7): n is a, c, g, or t
ggaactnttgtcgtggtagggacaggcgggtggctgggaactttgtcgtgggtagggacaggcgggtggtgggaactttgtcgtgggtaagggcaggcgggtggctgggaactttgtcgtgggtaagggcaggcgggtggctgggaactttgtcgtgagtaggggcaggcgggtggctgggaactttgtcgtgagtag

SEQ ID NO: 559605 - DNA, 166 bp, Homo sapiens
ataaagagccgatcatgccagtcttctcccatgagagcgatctaaagtagtctgacatgctagtagattatcctagatgtcgctgtaacagtggggaagacggacggatatcctaattgattagtgtctgtttcctacacatttgacattactgatgggacgaaga

SEQ ID NO: 559606 - DNA, 489 bp, Homo sapiens
  misc_feature (27)..(28): n is a, c, g, or t
  misc_feature (30)..(30): n is a, c, g, or t
ctaaggcacaagaggctaagaaggtcnntncagagagaaagtcactgtaggtcagtcacagcaggccaggcccaggacacagggttgagcattttacgggcaggtaagaggcttctgggaaacttggcctctgaggcaaccctggcccaggatggagaggttttcatgtgctgaagtcaaactggcccacattcctccatcctgaaaggctaaggaaagcaaccactctaacgtcagactcatagccgtgtcatccagccaagatgctacggccacttcctgacaagctccgaagtcctcagctgaagggggaactgagaccccttggctaatggctctgtggcctgaggtttggtccccagccctggcagggcagggccgccataggtcagtcctccccgacaccgtaccatgtctgccagcttcttgaagccggctggcccactcgtccagatactcgtaatcttggtctgggccggaggcagagga

SEQ ID NO: 559607 - DNA, 494 bp, Homo sapiens
atacataaacatgagcccagtggaatatggtgaggggtgatggggacacagattggagcactcaactcaggcacaggaccccagcagaacatgacccaggtcacatcctagagattggcccttgcagactttctgaagcctcgtgattctgtcatcttaccaaggtgtgaacccaaacatcatctcctgaacttctgggcacagagctctgagcaagcttcaatcatgaacccattatggagatggggagttaggtgcagacagactgctgctcagtggtagaaccagacatctgacccaggccacctgtaccagcgaccctgcttttagccagacagctcagtcgcacgcaagtcatgtggggccatcaatatatttatctaagatagagtctcacttagtaggccaggctggagtgcagtggtgcgatctcggattactgcaactaccagctcccgagtacaagcgacacttctgcctcagcctcgcaagta

SEQ ID NO: 559608 - DNA, 101 bp, Homo sapiens
catgagctcgacctcatgcatggcccttccccaataccagacactggcatagagccaactgagataaatgctatttaaataaagtgtatttaatgaatttc

SEQ ID NO: 559609 - DNA, 782 bp, Homo sapiens
  misc_feature (104)..(104): n is a, c, g, or t
ccctacgcgatccggctgagatggtgctgcgacgtgtgttgctccggcgtcgtcggaacacatcatttattaattaccatagaatccatggatcaaatcttagnataaattctttttagaataaatcgcccgagacataaagaatttacgataatcaaatcctgtctgatcatcccccagcctgtgtaggacttatgtctagtacttgtgttatatcgttccatcgtgtttcatcatcacatatacccggatagaatcaagctcgcatgaccggagtcctggaccagactcagtcgtgtccgcctgccagacgagctttccgacgacaggaatccgtagcatgatccgagtgtccttgtaccacggtgtagatccactggacaccttgagctactcagtcacgacaccatcagcttactcactcagggcccgcggacattgcaccgttgcctaggtcgcttatggctgggtccatgactggtgtggattccggcaactcgcttcggttttacttggtcctggtgacccccgctaaggtaggtccatgttttaccccaaatcatccctcggggtttggggctatatgtgtctttggttcgcgccctttacctttggtccttccctgtgtcgatttcatcctcaccgccgttaacttggaacccttcttctgctactatcatctctggcgagcaccaccactctgttaaagacacccacggggaacaaccccaacggcgtcgcaacttcctatcaaaacgcgaaacaaccccattttacaaggg

SEQ ID NO: 559610 - DNA, 80 bp, Homo sapiens
cccctcttccagagcttccacggtgctggcaaagtcctgcagcttcttcttcgagtcggagagctacaaggacagcgtca

SEQ ID NO: 559611 - DNA, 715 bp, Homo sapiens
  misc_feature (612)..(612): n is a, c, g, or t
  misc_feature (633)..(633): n is a, c, g, or t
ccgatgccgcaggcctggcttaggcaagattggagataatcagggaatcaccggcaccaagatggaccgcttggtcaaggacatgaagatcaagatactgttggagatctatatcttgtccctgcctattaaggaattagcgaccattgctagctttctagtagcctctataaaggttgagggactgaagattctgccagtgcagaatcagacacgtgccgttgagttgaataagatcatggcattacgttgatatcggcgtcaacattgttcacgtgctactggtagacaagggcatgtcggaggtgtacgtactcatctaggtagacatcatcctggccatgctctgtattgtcctggacgcatagactactgacgatacaagatcggccttcctcacactaggccattgagtggtgacaggccgttaccgtatattgcgtgccacgcatcagccatgtaatcatagcagtagcattcgttccgcaattgtgcctactatagctattatagatggctggtaacgaggatctgatcaaactaagcatttaagtgactgacatcgtggtaaattaggcaaggtcaccttgaagtcctgccattgactactgntaccacaccctaggctattgnaacagaccggatgcaccacatttactgataatagtcactgacgacttcttttaaaccgaacgtcctccgctagcgacacagc

SEQ ID NO: 559612 - DNA, 431 bp, Homo sapiens
  misc_feature (163)..(163): n is a, c, g, or t
  misc_feature (195)..(195): n is a, c, g, or t
  misc_feature (223)..(223): n is a, c, g, or t
gcggtcgtctgaggacccagtctttccctcaacacatgtgctaggagatactaccatagaaatcaatacagtacagactaccggataggattataacagaaaaagcagcattacatatgaataggaaatactcctggtgtatggcattcatttctcatatatntattgagcacctcccaatatagagcatacatntaagcatgttacatagtgggcacttaanatattgttgaatattatcagtggataagacagacacacaccgtctgtactcccaaagaactgatagttttattggggaataaagctgtagaacttaatcattacaactcagtggtgaaagtgctgatttgtagatgttagagtagtgtgcaggcttgatcgggacagaaagaatgaatagaattcaaatttgaggggaaaagaccctg

SEQ ID NO: 559613 - DNA, 117 bp, Homo sapiens
ggtttgggcaggtgctgggtttttcgctcggtcggacttcggctcttcctcgggcagcggaaacggccgcgacgtcgagaagtggcctaaaacttcgacgttggttgaaagaaatgg

SEQ ID NO: 559614 - DNA, 129 bp, Homo sapiens
caggcgcgtattgggtcatggagtgtcagcaaagaccaaagatggagtgagagaggttcagaaactggcgtacgtaaagagctgtgctgccaaggtatacgtgcgggagaatacaatctggtttccttg

SEQ ID NO: 559615 - DNA, 161 bp, Homo sapiens
agttgctaccccacaaacagtgtatagccagtgcaatgtgtcttgtatatgtaggatctgggtggaatgtgtcttgtagaggaggaactggatgtaatgtgtctgcagaggaggagctggattgatattgttgtctgtatgtagaggaactggatggaatg

SEQ ID NO: 559616 - DNA, 372 bp, Homo sapiens
gcaggatcccccgtagacagagttgtgcaggtagaggagatgggagattgtgactgacttaatacgtggtgtgtgaggctgatgaagggggcccagctgtcagtgattgggggtggggactcagaatatcccataagcagagaaggcaaaaggagaaaaaggagatttgtgtaggtgtgaaatcctggaaggtgccttgcagccatagctcctcaattagcatgaggaattgagatggattatctaagggcgtggggaaggggtaccaggagagatctgagacaaggtatgaagtaaaagatttaagattggaagtggagagtgtcatgggccagtgcctttcggatgggtgacttctggaattcttgttag

SEQ ID NO: 559617 - DNA, 221 bp, Homo sapiens
cgagcgagctattacattataactggacatgctatacattcttgaagttagttgcaatacagaatctgacctataataaactttcctgttacattaaaatccactgctttattttacattatgaatcttttacctatgcacaacttttttttttttttgggtttttttcccttttttgggccggcccccggggttttgggagttccccgggctaaaaaagc

SEQ ID NO: 559618 - DNA, 411 bp, Homo sapiens
gtagcttgaaggacctggctgcgcaggcacatatgtgtgccaaaactgatagaacagtacatgcggagagggaacatgtattaaatagacatcatatatcactagaattgagtgaaaaagaccaaaccctcagggcatgcgagctgcgatgaatgaggcgcgctaaaggagaaggtgaccggatgaccctacaagacagcctgaacacatatcagagcccggatcgaaggcactgcctgtccctgaagacctggggctctaagtcattcacgtgcggggccggcgctccgcattcaatcttccggcataccactcccctcggatgtcttctgagacaaggacagcccacgtccaccaaccccactgcaggcaaaccggcgcctgcctgatggaggacagtaaaggaaggaa

SEQ ID NO: 559619 - DNA, 235 bp, Homo sapiens
gagaaaagtgtggacagtaagaagggggcaaagcaataggatggagctgccaaggaacttttaagggtaagtgttcagcctctattcttaatttacaacagagatggggaaggaccagggagcaactccgcacatggtggtttcattcattttcacagtgttacacagtacacatcgcgcttattcaaccctggtaaaattgggtccagagacgcagttgtcactctcctaaatc

SEQ ID NO: 559620 - DNA, 483 bp, Homo sapiens
ggttgtcgttaactgcgggctgcgttgactgaggttgcgaggtgaaaaccatcataggctcgtaatacaatcagcctgaagacagacaggtggtcacctccaggcaacatggtgagactcggcccctccagcagctactgcactccgtcacgggtggggtccgctgggtgccacggctgaactgtgtcccctcccaagatgcacgtgtggaagttctaagccccggcatcgcgcagtgcaaccgtgtttggaaacagggtctttaggaaggcgataaaagtaactggggtcactagggcgggccctaatcccataggaccagcgccttacaagaaagagggcacagataacatagggacgagccaggtgccacggccgtcctgtgggcacaccagtctgtggcgccgtgttggtccccctccaacgtggaaaggcccggtcactaggtcactcattaccgccaatcgcagacccaagtctggt

SEQ ID NO: 559621 - DNA, 110 bp, Homo sapiens
cacgagggggcacgctacgagagtacaatgtattgggtcgctgcctggccacccccaagtgacacaggccgcgcctctatcgcatgggaatctttgcgcctaatcatgtc

SEQ ID NO: 559622 - DNA, 202 bp, Homo sapiens
  misc_feature (61)..(61): n is a, c, g, or t
tagaggatcctggtgaacaagagatctgtgagtgccaggggctgcatcatcggggcctccntcgaaaggtcccaagctgggcatggacataacgtgctcatgtcgcccagttgctgatggagcaggtggcagctgagggcagcgggcccttcctgtacctactctaccagcatttgttcttcaactttcacctccgtactgg

SEQ ID NO: 559623 - DNA, 323 bp, Homo sapiens
gagatggtcccaggagacccggtgggggaaacagacatgaaaacagttactctcaatatagggttgtcgtgggcccgtaatcaaggtgaataaggaggctggggcgcgatggctcacgcctgtaatctcagcattttaggaggctgagttgggtggatccctttgagcccagaagttcaagacaagcattagcaacatggcaaaaccccggtctctacaaaaacaaaacagaacacatcaaatacacacacacaccaaaatttagctgggtgaggtggtgcatgcctcttgtctcagctactcgggaggctgaagtgggagga

SEQ ID NO: 559624 - DNA, 927 bp, Homo sapiens
agaaaattagctgggtctggtggtggatgcctgtaatcccagctactcgggaggctgaggcaggagaattgcttgaacccaggaggtggacggtgcagtgagctattactccagcctgggcaacaagagcgaaactctgtctcaaaaaaaaaaaacaggggggggggactttaagagagtggtgatgacccaaactgttgaaccaattatgtttcggcgtggggggtgtcctaaagctggttgaatcctgaatgggttccatacacgtggaactacgctgggcttaatggcagccagcgtcctgggggcaggcagaaccttatctcattctcaactcgtaactcctattggcgtgacttccaacgcggtgcaggatttctcagagcagaacctgtgctcctatacgggcccgggcgctttcaaggaatcggggtgccccagtcctctatcgaggagcctggcccatacctgtgggcaaagccgtgccatacccttctccagagcgtgcggacacatctattagattccccagcgtggttgtacacagacgagctttcaaccccctcttccaccctgtggtccttacacgaaccctataggggtgacagtgttgcgagctgaactattgctcagtggccctcaaaatagaccaagggggggctaacgctccgctagcgcttctcaacattctccacgagaaaacaagtctgagacactgccctggaagggggccagttgtgggctacttccaatttacctgtggctgggacgaatcttccccgacaccaagagcctcttcagcacgtgggctcacacacagcctgtacacaggcgaagaagaaactctgtgggcataatgcggagtacaaaacccccgatctttcccctatattgccccctgcggcatctatggaccgtgttactcgc

SEQ ID NO: 559625 - DNA, 280 bp, Homo sapiens
cgtaccgtcagaagcatctgagttcaggagatcgagaccattcctgataacacggtgaaactccgtctctactaaaaataaaaaattagctgggtgtggtggcgagcacctgtagtcccagctactcaggaggctgaggcaggagaatggcgtgaacctgggaggcagagcttgcagtgggccgagattgtgccactgcactccagtcttggcaacagagggagactctgtctcaaaaaaaaaagaatttgtaagatttcaaactcaggatgcttcttga

SEQ ID NO: 559626 - DNA, 442 bp, Homo sapiens
tcccccactcatgccgcgttcctggagaaccaggcatgacagatggcttatgttgcttagaacgccactgcaggtagaacgtgcagcatattcaagcgcacttatgagaattacagcctactgatcgatccttcagggcttccctgcttactgtgtttcgcaatttctgcttggagatatgcgtcttgatgattgcttggctatgcatatagcagggacagtgcgatccctgaaccgtatctgcggcagcactgtcgaagttgaggcaagattctctttcttattttgcccccctttggcgaggctatcatacatttatattttcaggaggagaagtcaagtccttacccccagccattccctgtggcaaaagggatgtaggtccattgcttcctttttcttggttgattcactatagtttgcttgctttaaacgtgtggga

SEQ ID NO: 559627 - DNA, 901 bp, Homo sapiens
gccttgggttctgtgtgtgctggctgcccggtggctctggccccgtcgggccgttggcccacgccgtcggcccctgagctccggtaggccgccgctggaggagctgttcgtccggggtgggctcgttggggatcttccttgatcgccacgcggagtttgaagccctattttaatcgtcagtgcagcgctccgatcttgcgtgggcgcgcagatagagaagctaggtgcaccatggagaatcgagcatcgtagtctgcggggcagcactgaggcatcgttggctggcgagcggatggagaagtgaaggatttacaggacaatgttgcagagaatgaaatcactttgtgtcaaccacagcaaaaataactcagctgaagcatcagattatcttactttttggttccctcaggaagaaacacgatgacaacatgatttgatcctggaagtaacttgcaggagttggaggtcaggaaggcaatcgttgtttacactcacgagatatcttgatatagtatcatctaaatatgctggatataaggacgatggccatatttgaaaaccctgcgaatatgttccagggtgacaatagggtcggcctctaaggacaatgcctatcttggccaagcacttggggaggttccaggacagaccgtattagcgacacctggacaaattgtgagaagcgacggtgttcgacaagaaagataactaaatggacgtgcctcaaagaacagaaaaagcggaaagggccgcgattccaatagctatgcaacccagtgacctgttatctagtataaaccccgaatcaaatgacgaataattctctgggaataacatccgaaaaattggagaattggaccgtaagcgaggcattggagttgtgggcgaacaagtaattcag

SEQ ID NO: 559628 - DNA, 338 bp, Homo sapiens
  misc_feature (19)..(19): n is a, c, g, or t
  misc_feature (53)..(53): n is a, c, g, or t
  misc_feature (136)..(136): n is a, c, g, or t
ccacgcccagctaattttngtattttttagtagagacagggtttcaccatgtnggccaggctggtctcaaactcccaacctcaaatgatccggccaccttggcctcccaaaatgctggcattacaggcgtgagcanccacacccggcttacatgcattttttatcaccacaaactgaaactctgtacccactgaaaaagagctccaaattccaccctcaccccagaccctggtaaccactatttcactttctttctgaatttcccttcatatgagtgggatcaaacaagagttgtccttttgtgtttagcattcttacttagcaagccatcaactgct

SEQ ID NO: 559629 - DNA, 111 bp, Homo sapiens
ggtcaagggtatacgagtagctgcgctcccctgatagaacctccaaacaagctctcaaggtccattgtaggagaacgtagggtagtcaagcttccaagaactccagaccac

SEQ ID NO: 559630 - DNA, 127 bp, Homo sapiens
ggatctagaggatcccatatgctgcactttacaacactgcactacatgactcaggaatcggctctacgaatgtgaagcgagaggaaactagacctcatcagcccaacatcaaagatcaccatcggaa

SEQ ID NO: 559631 - DNA, 371 bp, Homo sapiens
ggctaatgaagacatttaccatgtttatacaaaggaggcaatcactaagggctgatgtaaggataaagtaaacgcagcctgggagagaaaggaggagggatccagtgcacgaggagagttcagaaaaagtgcctcagatagtaaaggcgggtgttaaaagggcaggtgagagcatgaatatatgtagagacagaggagaaacgttaccaaattcggtttaaattaaagtggatacagggtcaaaaaatagcacgtgaaaaatgaaaaatccattgggaatattctaaagacagaggtagcagaaccttaattctggttacaccgcaaaactagccaacacttatttagtttgaaaaaaatggtctaaacac

SEQ ID NO: 559632 - DNA, 961 bp, Homo sapiens
cgtccgggtggcgcatgcctgtaatcccaacactttgggagaaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttctcattttttcatgtaatcttatccaagcaactgtcccattggtcagcaagtcaattttccataatggggattttcccaaaatatttttggaactacggctatcaatggctacttaagggtacgggggacatgtggtgcggggagtgtaacgggaattcaccagctatcttaaatttcccagggaaccttggaagtctatcactctaatgaacggtctgtcctctacatgacctttgtgcctcaccttggccccaagtcagtttaggacacacaacagtcattggacgcaaggacactgcagagagttcctacgtcacggggtactttccgcggtgacataggtcagctgtaaggcctgcttataaaatttgctcactgaagcagtctggcttttggtacccctgtgtccaccttcttgttcaaaagcaaacgtggcgtggatagccaacggtactccggatcggtggtgaatcagcccaccatttggtgggccaccgggctgtgaaactacggatacggtggaaaaggcagacgctacaacgggaagcaggtacacaaaaaacagggggcatccgagcactcgtgctgcagcgctgtaggcgccagcagactgttgcctctggtcacgaactttgtgtatatacacggagaaagaaa

SEQ ID NO: 559633 - DNA, 230 bp, Homo sapiens
gccggacccgcggttatgtcttacggaataggtgttggtattgtgtaatcatactaaataagtaagtattcacggttacatacctcttcttgggtgctgtggacttagccattctcccaaatcatttgtatggcatttattaatcacaggtctatgacccccattaaaacagacactctattgtcaactcgttctatcctgtcttacatgagcgtaagacataaccgcgg

SEQ ID NO: 559634 - DNA, 842 bp, Homo sapiens
tctaaaatgagaactatcgtctgagcagagcttgctgtctctccatatgcattgaggccagcactgaatacctgacatggctacatttgtcaacatcatgttgttggacttggttgtagccgcgagtttgtgacacataacgtggtccctcagtccgtaaagcatcatcccctggaatgtggattgataatcgatattcgggaagaaatatagagtatcatcacataggtgtagagtgagagatgtagagcaattaaatgtggttctaaagactctatgtatggcttcagtgttttgaaaaatacatcgttgtacccagagctaattttgaagtgccctcactattgatgcatttttaatacagcaatcaccggagacttggtaccatgggacattgtctgatgatcattgctggcatgaagcgtgttgcggagatcattctgcaacccggtttaccaggtttattaacttgagcttcagtgtcatcttttatccagtttgactacaaagatatttcagagagcttcatgagtggatttcttcatggtgtccatttatttagcaagctcggggactgttcacaagttacagttcgtcctgacatatgtggtccttggcagatggcttggggttcttccggtatacacgtgtttgctcagattcttttgcattcctcattctgcatgcttttctttcagacgatttggcacatcaatcttttctaaccccattgagccatttcttgggaagtgtcattttcatcacgtcataatgtcaggccagtgaaattctgcgagaaaaataaaagtgtctgggtagtgaggaaaaataaaaaagaaaat

SEQ ID NO: 559635 - DNA, 667 bp, Homo sapiens
ccctcagccaccaaattctagacagggcttcctctgacagaggtgcaggctatgactacatggctccagggcatgccactcaccctgcagtccccatggccttgggtggtggttatcacgcttctccatcagggggcggtaaagctctttccgaaagtgctgtgattccagtcatgagctatggtgaagctcttaaagaaggggtggcttgaccgctcgtgctgactcatgcctgtactccgagcactttgagagtctgagtggggctgaatcacgatgtcaggagctcgggaccatcctggatagcacggcgaaaccctatctctcctagaatcactgtcgcttagtgtgccgtggtgatgagcgcctgcagtgccagacacgcgctagcagagagcctcggaatcgtttcaatctgtgcggcgaagctagctgagtgcgaagctagcgccacttgactccagcctgtttgccagacagaggctctggcagattacgtggacgacttccttcacggtcacatgccttacgtagcgtgccaactctctcttcgactcggcacaaacttcatccattccatccggcctagggcgtcacttggccttctccctcctctggtcagtcatataccactttctgccccgcctttttacaccctattcctggc

SEQ ID NO: 559636 - DNA, 859 bp, Homo sapiens
agcggagcctgtttgcgcgagagatcgcgagcgtgtggcgatcgcttctgtctgtctacttcagatatggaagctgaggggatgcacgagaggcagccagaacctaccgtcagggtctcgactcgggtgtcatgaccgccccgcggaggatcgagtaagcgatgggggagcccggcttcttcgctcacaggagaccgcagccggtggccggagctggtgacctgacggcgggtgagggatgagcgccgggtggctgctgcatggagatgatgggtgcgacggtgactgtggggacggaaggacttgggtgtcgcgattaccaatggggtatcagaaagatcttgcgcccctgactgatatcgtcgaaacacactgatgtttccgactgcagaatcctgagggaccatgtggactagattgatggacttgactggagggtctgaaatggtgtcagagctgagagcagagcggcgtctgggaatcctttgaagggctctattgccgatgcgatcgaggggagacgtacatgccaagcgttgggagtgtgcgtctggagatagatacagtgagaatgcggacgtagtgcaatatgaagttgacgtgagagaaggactggggagatgaagtagtatcgcttgtctttcctccaaagaatgtagcaaagtgatagaaataaactaaggagatggatgaagcttagaagggaaattcgaggttctgggactgcagtgagcgcagggtccctggcacgcttgacgggtcgcctcagaaagtgtcgaggatgccacacctttactactaaaagtgtgctttgtgatgtcctggtccagaccaggggaaggtccccgagggggaacag

SEQ ID NO: 559637 - DNA, 751 bp, Homo sapiens
gttggcgcgcaacgggttctaggctgcaggctgctcgatggaccctgcggccccggccccggtctcggcctggcatgatatgcagaggcagcaggccgtgccggggtgtggcatgttgctgtaaccagtgtgcccagtgggatgttactggtggacagtgccacctggacggtgcgtggcccccgcagggctgacacccatgctttgctagctggcttgtcggtgcactcctggggtatacctccgttcgcgcgggttgacctgctcttgtgttcaaggagctatggacgacgacgtgctggtcacgagtacgcagttgtgtcaccgagtctctctcagagttgccaggctcgtctctctggcggtttggaccaaaatgcttgcctccccgtgtgacagtctgctcattccctgtggtggcaagggcgtcctgttggtgtacccctaacacttgcggctagatggacacctcagaggcctgtcgctctatctgtaccgaacacaagttcctaccttttggcgcgccgagggccggatattgaccacctcgaaaggggggccctgccaaactggtagctccctattgcactttcttgatctgtacaagtacggcgagcaagtcggtttcgacgagcccctggatgtagttcgagtggcacagggttccgtgggcggcccggggcattggcatcatttcaggccttgtgctcctaagcgcaacgattcattggtacattgtctttggggggcg

SEQ ID NO: 559638 - DNA, 430 bp, Homo sapiens
caccacagcccccaagtagtggaccacaggtatatgccaccatgccagctaatttttttgtatttttggtagagatggggtatcaccatgttgcccaggctggtctcgatctcctgacctcaagtgatccgccgccttgactcccaaagagctgggattacaggcatgagccaccatgcccggccaggtatttttttatagcaatgcaagaatggactactactgtaatttatacaagaaaagaggtttatttggttcatggttctgcaggctctacaagcatggtgccaacatccacttggcttctggtgaagcttcaggaagcttccacccatggaggaataggtaccacatggtgagagagggagcaaagcagtagggagagatgtgaggcttttttttattatatttttatattttttacaccacc

SEQ ID NO: 559639 - DNA, 312 bp, Homo sapiens
tgtacacccagcccccagcacagggcctgtccaggacaagtgcccagtaaacacttgggaagcaatgcaagggtccttccagcagttcctgcaaacagacccccgacccaagcccttccttttgcctcccctgcccccactgctggtcatttttgctggcacagaagttttttccctggttttccagaaatcccctttccccactcagccagagggaggtattaaaaatgcgggccagcccacatcagtccccagcaaagtcctctttaagggatttttgttgcttggagaataaaccctcggattccttca

SEQ ID NO: 559640 - DNA, 483 bp, Homo sapiens
ccatgtcatggcaggcattgttggcgatagggagctccccaatccccaaaagattccgttggagtgcggggggttttttcaaattcaggataattaccttcctctttttgggggccccagggtggccggcaaaattggcccttcaatccaggccaacaaattaagttgggtggtggtttagtgtttgcaaggggcccctccaaaccagtccccgttctttaaggaaaatttcgggcaaaagggggtttaaaaagtggcccgggtgaaggggctttataaggaggtggttttccccccagtgttttttcaatatgaggaagccagttcccgcccccttttgggtttcttttaaaaggaggggggcccccctccccccccccttttttttgggggttgggggcaaattttccaagggggaaaagttccctaaaaatttcaaggggggggggggggggttttcaataaaaatttgggtccccttta

SEQ ID NO: 559641 - DNA, 892 bp, Homo sapiens
  misc_feature (75)..(75): n is a, c, g, or t
  misc_feature (229)..(229): n is a, c, g, or t
  misc_feature (425)..(425): n is a, c, g, or t
  misc_feature (512)..(512): n is a, c, g, or t
  misc_feature (525)..(525): n is a, c, g, or t
  misc_feature (527)..(527): n is a, c, g, or t
  misc_feature (545)..(545): n is a, c, g, or t
  misc_feature (554)..(554): n is a, c, g, or t
  misc_feature (561)..(561): n is a, c, g, or t
  misc_feature (566)..(567): n is a, c, g, or t
  misc_feature (571)..(571): n is a, c, g, or t
  misc_feature (591)..(591): n is a, c, g, or t
  misc_feature (594)..(594): n is a, c, g, or t
  misc_feature (601)..(601): n is a, c, g, or t
  misc_feature (613)..(613): n is a, c, g, or t
  misc_feature (621)..(621): n is a, c, g, or t
  misc_feature (669)..(669): n is a, c, g, or t
tagaaattggaatcctctagcttctatttttagaatttttaaaaatgaaacttgttagatcacttgttgtctttnctttatgtgtttttactacaataaaaagagcaaggaaaactttgaggatattgattccagcctctctgttactttatttataatatggatatatatgtgctgtatgcaggttattagattattaaatggaaaatgtacctagcctaggatctanacatatggcagaaattcagaaagtatgattaataaaaaagaaacatgaggaaagcctagcggtttctgtgtagtcatgatctcaaatatcactggtcatcctaatgtcacctaagtagaatgcttagaacaaaataattagcctatatcatactggtttgcaaactcaaattttaaactaactgaaagtagtttanaaataggtatatattttacgtagctagttttatatacttgtgatgccattgacaaatcgatgtaactttctttgctctggtattgtnctagatacctccnantgtccgtaagtataccantggcccccntgtattntgtcnnaaanttaattcagaattctgagtnatnggaatgnttacctctgaanttatgtgngttcagttggctcttttcttccttgctctttgttcaaattagcatgcnagtatttttacaatgggctaagtatttatcaggaattaactttgctctatatatggacaacttaatttgtcgacgatgccttctgccgggttccgaatcattcgcgccaaaatctcgcggctgcccctacaccccgtcagcccggtaacaacttcactcccaccacccccatgcatcccccacaccttgcccgacccgccccacagcgggcaaccgcgccccc

SEQ ID NO: 559642 - DNA, 836 bp, Homo sapiens
  misc_feature (75)..(75): n is a, c, g, or t
  misc_feature (229)..(229): n is a, c, g, or t
  misc_feature (425)..(425): n is a, c, g, or t
  misc_feature (456)..(456): n is a, c, g, or t
  misc_feature (469)..(469): n is a, c, g, or t
  misc_feature (471)..(471): n is a, c, g, or t
  misc_feature (489)..(489): n is a, c, g, or t
  misc_feature (498)..(498): n is a, c, g, or t
  misc_feature (505)..(505): n is a, c, g, or t
  misc_feature (510)..(511): n is a, c, g, or t
  misc_feature (515)..(515): n is a, c, g, or t
  misc_feature (535)..(535): n is a, c, g, or t
  misc_feature (538)..(538): n is a, c, g, or t
  misc_feature (545)..(545): n is a, c, g, or t
  misc_feature (557)..(557): n is a, c, g, or t
  misc_feature (565)..(565): n is a, c, g, or t
  misc_feature (613)..(613): n is a, c, g, or t
tagaaattggaatcctctagcttctatttttagaatttttaaaaatgaaacttgttagatcacttgttgtctttnctttatgtgtttttactacaataaaaagagcaaggaaaactttgaggatattgattccagcctctctgttactttatttataatatggatatatatgtgctgtatgcaggttattagattattaaatggaaaatgtacctagcctaggatctanacatatggcagaaattcagaaagtatgattaataaaaaagaaacatgaggaaagcctagcggtttctgtgtagtcatgatctcaaatatcactggtcatcctaatgtcacctaagtagaatgcttagaacaaaataattagcctatatcatactggtttgcaaactcaaattttaaactaactgaaagtagtttanaaattgtaactttctttgctctggtattgtnctagatacctccnantgtccgtaagtataccantggcccccntgtattntgtcnnaaanttaattcagaattctgagtnatnggaatgnttacctctgaanttatgtgngttcagttggctcttttcttccttgctctttgttcaaattagcatgcnagtatttttacaatgggctaagtatttatcaggaattaactttgctctatatatggacaacttaatttgtcgacgatgccttctgccgggttccgaatcattcgcgccaaaatctcgcggctgcccctacaccccgtcagcccggtaacaacttcactcccaccacccccatgcatcccccacaccttgcccgacccgccccacagcgggcaaccgcgccccc

SEQ ID NO: 559643 - DNA, 825 bp, Homo sapiens
  misc_feature (316)..(316): n is a, c, g, or t
  misc_feature (337)..(338): n is a, c, g, or t
  misc_feature (342)..(342): n is a, c, g, or t
gaccgaccttcctaaatggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggccctgaagacaagaagaaacacctccttattggngtgtcctcagatcgaggactnngtgntgctattcagtatcctccagtgtgctagacacagatgactagcgcgaggtctgcttacaactgaacaggcaattggctggtgaaagaagtataatcgcgtttgcttggagattgcttgacaaaatcagagcgcgatacttttataggactcattctgaccaggtttctggtggcctccaaagaagtggggaggaaaagacccgccactattatggagatgcggtcggctcatgcccttgaaagtgactaacgttcctggactattgaaattttgatgaagggctccagtcatccttcaatacatgcaggttctgcatctccctataacaaccgaaacaaccagccccatctttctcccttaactacacggtggccacgtgctgaccgcgctgagttctgttgaacgaatcgcatgctggcgagactgcagcattaaccagaactacaatctggcaaaaataactacaaccctgaagggatcac

SEQ ID NO: 559644 - DNA, 217 bp, Homo sapiens
ccagttaatttcttccccggtgctttcagacacgatagtacactatagtaactgcacacagaaggggctagagtaaatgacagctagtcaaagatgaccgaagtctcctgaaaatcaggacacaggcagagaaatcaagaatgcaccaagcagattctcaaccgtcccacgtaacaccctcatgctatcatatttccagtggatgctacctagtgag

SEQ ID NO: 559645 - DNA, 274 bp, Homo sapiens
aacgatggacagtgcagttatccgctggactctataattcctaatacagagcccaaaaaatgtaagacaaacccaaaaaatttagcagaagcatatccgaacaatggtgtccagaatctcgtttgtgcagaaatgtttccactagacttatagagtactctaccgaagaaagaggcgagggctcgtaataaaggtcaccctttggacatatttgcaactcttcaatggataaccatagatggtagattgtcataagcttaagaggtacagaagg

SEQ ID NO: 559646 - DNA, 632 bp, Homo sapiens
  misc_feature (316)..(316): n is a, c, g, or t
  misc_feature (337)..(338): n is a, c, g, or t
  misc_feature (342)..(342): n is a, c, g, or t
gaccgaccttcctaaatggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggccctgaagacaagaagaaacacctccttattggngtgtcctcagatcgaggactnngtgntgctattcattccctcatgggtaagcagatgaatagaggggggcgcccaataacaggaactcggaaaggagttattctttttaagaagaggtgacaacaacagacccaatccctcaagggaccaattctggccagattaatgtaagaatttaaagaagagaggacgcaagccccccacctagtaagatacatgaatcattcatctataaaaagctgggactcacaaaactctccgtcacatatatcaacttttagaataataaatgtccccacaccaccataaatataac

SEQ ID NO: 559647 - DNA, 178 bp, Homo sapiens
gaccgaccttcctaaatggctgtggctaccatgttctctcgcgcgggtgtcgctgggctgtcggcctggaccttgcagccgcaatggattcaagtaataggaaacaggaaaggtccaaggacccgaaactgcaggaaagggaaagaccagattctagaacattgttgggacctacagc

SEQ ID NO: 559648 - DNA, 478 bp, Homo sapiens
  misc_feature (392)..(392): n is a, c, g, or t
  misc_feature (394)..(396): n is a, c, g, or t
aaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatccgtagactgttttccctttccccttttctcccccctccccaactccccccctctttttttctccccccccgcncnnncccctttccaagttaaatgtcttaaatgtatacattagatgtgtgttttaaaatgcataaaacacgttgaaatacattaatg

SEQ ID NO: 559649 - DNA, 984 bp, Homo sapiens
gcagcgagcctgggtccatctcatctgccgcttggagggtgtgcgtgtgcgtgcatgtgcgtgtgcttgtgtgcatggttgagaatctggcacatggtgcctctggtcgtgctcttgcttcgcgctcctttatgttagttcatgtatgaatacgcgcgacgctcacgccacgtgttcggggagatgccctcgactgagccgtgaggggctaccgtgtgtccgactgcgtagtccttcgtttgtcttgctgatcttgagtagctccctccacgttcaatatctcaggctatgttgacctgtacatctgccctcctagaagggataggtagtgcagaggctgatgaagacagtcccttgactagacaccgaaatccataaacaccatcttctcgcaccactgtatggacgagcagcccctgaagacacgtttgctgggactgggagactgcttggtgttccctgaggacaagagacactcctgacagtgttgggcatctgctccccgtggacacagccccactctccactttctgagcctcagacaacctcattcagcctcttgggctccttttcaaggacattaagtaactcaccaaaatagctcatgcccttcagctttgacaagaactcacggttcccaaactctgctttctggccacttggatggaaaacgtgtggaccaagcaattaccatcgccttggaatctgcggaatggagcagcatgggaaaacttgaacagtcatcaacgagcctcccagtggattccttggttctggcctcgaaggatcatttggtcgaaggtctcagcatcccattcaaaggtgtcctgcgtcgacattttccgaggctaaccgtcaagggggagaaagcaacccggaaagaattaattttgttctattgaggaaaaccgattcatcgggccgctagtcaggatggaaaataaagagaggaaccagaatagatcaaaatggttgacaatataa

SEQ ID NO: 559650 - DNA, 482 bp, Homo sapiens
tttgaacacccaaatcaccaataatgctttattttccacatcaagattaatttatatgtaggttgagtacaagtactaaaatgtatacttcttgcctaatagctaaggtatacataagcttcaccatacatcttgcagccacctgtctgtcctatgtcattgttataaatgtagagattttaggaaactattttattcaacctgggacatctatactgtgggagttagcactgacctgatgtcttatttaaaagtaatgtatattacctttacatatattccttatatatttaaacgtatttccatgtcatccagcctcaaaatcacatggtggcttaagagcatgagttctgcagctcagatctggactgaaatcctgatgctaccacatgcgctcaggttgtgattgtggtcaagtcacttaacttcttcatggcccaggtgcctcattctcaacagagaaaaccttcatacatgccagg

SEQ ID NO: 559651 - DNA, 217 bp, Homo sapiens
gggggaggggggtgggtgcgaacgcgggtgggggtgggggggagtatgcggcgcgcatccgggtgtattttcagtttatttgctctctgttttatggatttcagactcttcaaaatactcttcagggggcgggggggccaaatgaaaaccagaaaaatgatgcgtggaatttcataggaggcagcgggcggatgagaaaggcgctcctcctggtcta

SEQ ID NO: 559652 - DNA, 228 bp, Homo sapiens
ccagtggtgtcatcgcttaaagtaaaccacataaattttagtggtattaagtgtgtgtgtgtggtgtctgtgtatgtgagtgtgtatggtgtctgtgtgtctgtgtgtgtctgtatgtgtggcatctatgtgtgtgtgtgtgttgcctgagtgtgtgtgagtgtgtgtggagtctgagtgagtgtgtggtctctgtgtgtgtgtgagtctgtgtgtgtatgacccact

SEQ ID NO: 559653 - DNA, 352 bp, Homo sapiens
cccggtattcccaccccatagcaggaactggtactacaacaccactagtgcttgatgtccagacctaagaccagtttctagcccaactctcagaaacatcttggtgtgctcaaaggatactcctatcctctggtccaagcttccacccagttgtagattgtctgcaagcaccttgagtcatccatatctactttctacttgtatgcctccagtgacagggagctcactacctaacagagcaagttatttcaacaccactcggctatactcctttcaggagacaatccttcacctggctgactgcagttaccatatgccgtcgggcggggataccagggggggtaccgagctc

SEQ ID NO: 559654 - DNA, 109 bp, Homo sapiens
gtctgattcctagaggtatcccgcgatggaacactacgatcatcaggcattagattcttataagaagtgtgctggctgggcttggtggctcacacctgtaatcccagca

SEQ ID NO: 559655 - DNA, 191 bp, Homo sapiens
ccttccaagcgtaatatccaacagtttaaggtactataccacatggtaacctactgtttgccagcctgtaaaacacacacacacacacacacacacacacaatatatagacaatagatgacaaatcatagagtcaaacttttttttatactagctcagcagacaaaaacttctctgtcaaggtgttataac

SEQ ID NO: 559656 - DNA, 918 bp, Homo sapiens
  misc_feature (427)..(427): n is a, c, g, or t
tccgtggaaacacaccttgggcgttaatggtccgcacgccatggtgcccgcgacactagtaggcaacaagctggcccgtccgagacaatgctagcacaaagagcgtcctgttgggaagaccgttgtctgataacagacgaagccgcccgccccttcctcaaaagagggcttgtgcgcccaagaagatcctgggccgaccaccctgctgttgatgagatgaaccctctcgttggggagcacgctgtagctacaaatcacacaggaacgatgtgaactagaggagtattctccagtgcgttcacccaggagtggtataaaaacacgccggggagtaccaccccagcgttccactgcacaaacacaacaggttcttcccgcagaggcgtgtagaagaatacccgggcgagttacaaaaaaacattctttnggtgaagacagggagatacatccacctcaaaagtagcataccacacgacggtggcggcaacaagatactcacacaacggctccctacactgccgcacgacgacgctgggatgacagacggccgttatagaccaccacccacactcttggtgagaggcgccgcgcgcgccacaggcgtgggagtaacgcctcgtgcggccccacgggtgttcaacagactccccgccgggcacaagtgcgacgacaaacgccactcccccttcgtcaataaatcaggatgatatacggcacccagcatactggctgcgccccgtccacgcgtggcgctctgacagcatctgtcggcggcgatacaatacagcaggcggcggagatggtgttgtcggcgcacgcaagagcacgaggcctgtcacgctagccaccagagctgtgggacgcacacgacttgacacccggggctggccaacccaaaatcccttcgcccaaataaca

SEQ ID NO: 559657 - DNA, 315 bp, Homo sapiens
ttctggtgtcgattctatgatgtatctcggagtataccgaacaggaccaaaattggttcggtgttgtcttatgtactagtatatcaccatagaagttcttagaatacaagtcaatacagtaacagtcttttgcaccgttgggaaaggttgtgcattagaaatgccctacggatagttgttgggattttattatgctgttgacggtttggtttgtgtggttttgtttgctgttgattttttctctcttgctaccagcatggctatgccagacaaaccccccagtcccgggagctaggaagtgtctaggacgggtct

SEQ ID NO: 559658 - DNA, 256 bp, Homo sapiens
  misc_feature (15)..(15): n is a, c, g, or t
tcttagcacgaatgntccaggccaatgaacgcgtagcggctggagcacgaactgtgccgcgccatcgaacgtgaagaattgagcctgtattaccaacccaaacgcagactggtcacccaacgactgatacggggccgaagccttgatcccgttggcaccacccgaccttgggcgaggtcccgcccgagcacttttatttgccctgggcgaagagaacgggatgatccttgcaaatcggcggactgggtactggaac

SEQ ID NO: 559659 - DNA, 305 bp, Homo sapiens
  misc_feature (305)..(305): n is a, c, g, or t
ggcggctgcccctgctcctgaggaggagatggatgaatgtgagcaggcgcttgctgctgagcccaaggccaagggacccctttcggctcacctgcccccaagagttaccctttgtgtttggatgaattttaagcgccaaagtactcccttaagggacaccacctctcttgtgggcacttccatattttcttggggggcacttttataaaggacggcttggtcccccttggtactcagagtatctcctttccctcaaggaacctcactcagaaccctccatgaggctgccaacatcatcactaggn

SEQ ID NO: 559660 - DNA, 2482 bp, Homo sapiens
aaaacatgctgctcaatgggcttcagttccttcaaatcttttcttaaatgtttcaaaaatcttatatatatatgtatttttttcatgctttatattgaaagttttaagctttgattattgccatattcagctagccaaaaacaactacatagaaccttcaaagcgtattaattctggctaggttagcctaggttgagtaggaggttgaatagatgacttctgaagttccttcaactctaaattttatgattctgggaatttataacatccaagaatcacagaatgttagaatgggaaggaactttaagatcatctagtctaagccactcattttacagatgagaaaggctacccagagtgtagagacagaagcagagctctagggaggcagagagaggggaagtggcagaagggccagagctggggagggtctgggcataacctcacaggactggtcaatccatggcctgcagaggaaaaagggagaagagagaccacacaggagcttcagcatcactccaggaaactgatcacaggttggatgggatgcgaatggggccagtggcaccagctggtgtctgaacaggaatcagtaatggtcactctgtctgaggtcacctggcagtcagggccggccagacttttgtgctttctacagctagcatagctgcttctcatggtttggcagaacagcagcatccagagctgattctgccttgctctcatgtgtctaacctgttgtagatgagctgggtagcccagagctgcgccctgctcaccctccatggcccctggcctattcatggccttgttgtgtttctgaagtctttctttgccacattcctaaagatttttgttgttatggctgtggggccaaaaccctcttcactttttcagcatgcctggaattttcccagatcggctggatggactctacttcattcttggtaaagtttctctatcctgccatcactacctgttgtaattagtttggtcaacaacaacaacaacccagtgaggctctgattaaacaccacctctctctgttgaagccaaccctttcgttcaccacgctgatgggaaccaccttcctaatgccaagcactccacaccggtctctgtttttttccctgcgctatctgaatacacttggcaggtgggcagccttcaggaatcatcatacaattaggcttcaggagctctgttttagtcaattatgtggataaccttggaaaaacaaaatgcacagtaggtggcatcaacaagcccgttgtgcctttgggcacagcttttccctcgtgctgtttggatcatatactcattaagtccaccagctgaaaatgtcacaactggctgtgtgccatgcattaggaaaatcaaatacaggagaaattgggatatattgagcaaataagagagaatgatttttccacaatttacaaaagatttaccagtaaaaatgccaccttagttcatttacatatttcaaagatgattacaggtcactaactctttgatagaaagtataatttaaactaaagctatcaggaaccatggcatactaaagattaattagatattaggagaaatggtttgtgcaatttcctaagtcttttgaaaaggatgagtttgttttattacatttgattttcacccaacttcttaggattgtatgattgagtaaaagcaaggtacaattgtagctagctttgtttgtttgtttttgtttatttctcactgttttaagcgtccttcaccgtggttggttcaaaacttttcttcccataagtgtgtgtgaccataactggtgaattctcgaagtgttgggatacacagaaggaaaggaccgtggacaatttaaaatcgtgctatctgtaaggaaacctaagttgtatgtgtaccattattatttgacaagtgtcatagtcaaggaggtctccagtgaggaagtgtgttttaagaatggggagagacatgcctttgtagacagcatgcagtgcctttttggtagagcaattggcccgctaggactagaagattggttggaactgagagaatcatcttaaacaacatgctgagccaaaacattttttgatgttaataatattcatgtgtaaatagattgtttcaaatctctccgaaaacatagcggtagctttgtacttggacttcctttacttgtttaattttcaatggtgaaagatgggcatgatgaacaccttaaaagtcatgtggattatttttctgagttaaaaatgtatacattcaatcggaaagatataaagtctaaaaggaaagtgagggtcaaataagcagatgaggaattattatccctggaaatacagggaattttcttgttgatacaagtttacttcctaaaataaaagtttctggttttagtacctttcatcaaactttcttaatgtattaggaagcttttagcacagtttacccacgttctctaagaatctgcaggcaaatt

SEQ ID NO: 559661 - DNA, 301 bp, Homo sapiens
agcgatgaatgtgaggatatgcaggagtgtgtgttggtatccacatgacaagacagtccattttatatgttagtgacgtctgcttcaattgatgttcatttctcacttcaggcactcataatctcatctcattttacaacagacgagcagcacactgaaccaccaaaacaaagcaaattcaaacccaagcaatctgatccaaccgggattactttgatttcacagatgtttcttccatggtgaacgaaacaggaagttgcgtcgattctgatgtgtttgcttcggggctctgtgtatcgta

SEQ ID NO: 559662 - DNA, 795 bp, Homo sapiens
ggagataggctgaaaatagagatggctacaccattctatgtgtgttcatgcctgtttcttctccaatcctatgtggacattagagtaaatggatcacaaatctgatgagggatagagttaaaagaggcgattaagtgtcatgtactcattacatgttatgacctatttgcatgttaatataggtctgtgatctctgtcgataggtcataggaatgttgtgattggagttgctgcagagaaacagagtcaggaactggagacttgagatgggaaggccgattggtgagggaagtggggtattattctactcgtaatgttctgagggtaatacaaaacaatttactgtgtgctggctgtacccgctctgtccattgcattgcagtattctgatagtagtaatcttagcaatcatgatgcaatggtgaagaggccaggtttatgtaaatgtggcgttgtgaaggttctgaaaggagtaattgtacaacatataagtagttgatgtgcatgtttgaacagtaaggagtgacattagaacttgtgaatataactagtgatgttgcaatctagtgttataatagagctatagtatgtaatagagaagtaagtaaaatgctagtgaaaagtgtcacgtagaggcacttgaagcgaccaatatgaaaactcgtttcgggctttcaccattattgcatactaggcttgtaggatgtcttagaatcatgtttaacaagaagttaagatatttgcatttctgacatctttatgcagttgggtaagggaggaacttggaaaataaca

SEQ ID NO: 559663 - DNA, 282 bp, Homo sapiens
catgtgaatggacggatacagtatttgtccttgtgtgactggcttatttcactcagtgtgacgtcctcgaggttcagccatgttgtagcatgtgaaagaatcttcttttaaaaaggctgcataatattcctttgtatgtttataccacatcttcatgtactcacctttagatggacgtttttgtggttttcacctcttggatattttgaataatgctgtaatgaacatggatgtgtaaataactttttgaattcttgccccaaaatggaattgctggatcat

SEQ ID NO: 559664 - DNA, 188 bp, Homo sapiens
cgacagttgaaatatagacgctagaccatggtatctagtgtcacgctcatggcatggctatgttatacaagccagtgagagatgctaagaactcactccttgtactagctagtacaaaacctaccacaggccttggaaaagagtaagtgatagggccaggcacagtgactcacgcctgtagtcccagc

SEQ ID NO: 559665 - DNA, 218 bp, Homo sapiens
aaattaaaaaaaaaaaaggggaggaatttcagttgggggggaaattctaaaacaaaagggaaaacagcccttttccttaagagctaaggcccagtctgccttaacaggactcacaaattagctacaaaattagaaattacagtttagggctcctgcaggagtatgtcactgtggaaaaactaaaatcgatgctggaaatgttttgcagagcctgcata

SEQ ID NO: 559666 - DNA, 108 bp, Homo sapiens
aggatcccaagagtagtagctgatcagtggttgttagtggggaaagatggtggttgtagtatctttttctccctcatgtccatgtgaagggagttgtgctaacaacgc

SEQ ID NO: 559667 - DNA, 286 bp, Homo sapiens
gggacagtatctctcacccagtctggagtgcaacagcgtggtctccgctcactgcaacctccacctcccagattcaaatgattcttgtgcctcggcctcctgagtagctgggactacaggcatgtgacactatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgtcgtcttctc

SEQ ID NO: 559668 - DNA, 288 bp, Homo sapiens
  misc_feature (41)..(41): n is a, c, g, or t
tagcacataaggacctggtccaaatattcgtacagcgtagnaaatgatggtcggcctgagagtcagggttttaagaacttctccagtcatgagctatgtctgtgtgatgacatgcttcaatgcactttcctccgtaccaggctgcttcctcctaactccctttgcctactttgtaaataaattatattggcccccactgcctcttcactctgatgataagcatttgcttaacttactttcattcgtttaacacatttatttttcttcaactgatatttttgagccctg

SEQ ID NO: 559669 - DNA, 1177 bp, Homo sapiens
gtctccggtccgtgcctccaatgatgacaaagaaaagaaggaacaatggtcgtgccaaaaatgggccgcggccaacgtgcagcctattcgcatgcactaactggtgcccgatgcgtgcccataggacacaggcctattacagaaattcgctcattcgaaacatagttggcaggccgcagacagctcaggggccactattctgaagccgagcgtcttcgactgccttatgtgctttccccaagcgtgtactgtgaagctacacttactgttgctgaggctgtgcaaaattcaacagcaaaacgtacgctccgagacatacgaatctcgatgaaagccccggcaagggacccggacaaaaccaccgcaagccacgactatccgcacgacgtccttcacaccactggaaacacaaacggtagggccgacgtacacccgaccataacgtcccctacccccacagcccgcaacgcgaagcaaacaccgcacaacacaccgcacacagccaccacgctaacttccctgggggacactcctgaggtcacattgccgccggcgcccgcacccaccccggcgcacataccggaacaacaacacacaaacgaacaggacacacgcgtgacacttgcctgaacgtcacccccccacattggcccgatggcggcacacggcatcaacaccgggattcccggctccaaggaacaagttttaccagcccgttttgcctactcacatctgctgacacataacatatacacactagtgaacgcccacaaatattcacacatttccccagttatcccacccgccgtatgtcgaacattactccggacatatactggggcaatacataacaaaggctcaacagttgggcgttaacgcacacagctggacgaccaacgcacttcaatcttgggataccaataatttacaataacatctagcccacctattacacagcttgtctgagcccacccaccgctactgcgcagaaaccacaacctcatggtcagtttcaccatggtattcagcttgacacgatttataggtaagcagcccaaacaccaccttgtggctttactgggcactgtgacgtaacacacactttcttgcgtcgggagctttctgtagaaacacacaacccagaatcgactcattgtcaactcccatagttttcaca

SEQ ID NO: 559670 - DNA, 707 bp, Homo sapiens
aaataaattatacaatctcctccccttcccttcctgaaaatacatggtatggtggtacatggctactatcctagtaatactgtagcatgcggcacaagctaaggagaagaatgaccgagtgagtcccacgcgtccgacagtatggcagaggaaggaaccagtgatagtaacacatggctcggagagcaacagtgcaacagtggaggagccacaacagatcccatagccagaagatgagaaaaaagaataagtgttgccttgtatgtgtgtgctaaatacttttttgaagtgaaaaaatgttttttggttttaatggtgttacgtggttgtgtattaattattttctttgtccatatcacacaccaaaggctttggaccatttagcatcatgagcctaatggtcagtcagtcacctttcttaagtgtggtgaagatggctcttttctttggcatctgtttctagccctcaactgctgaaagcctcagaatgagattaatgtgagaaaacacccacctcttttagagaattatccttgtgatgctgcagacatctactcttacaatgccttcctacagctcacgtggggtgcttaccaaagccatagctttaaaccttaccagtacccccaacagtagtatcctgaaagtctcctctcttgtttacttctgcaaagggtcagtttcttaaaagtgatcctgtatgagta

SEQ ID NO: 559671 - DNA, 258 bp, Homo sapiens
caccgccaaccttggctgcgtgaccactcacttcctgctaccatctgtgcctcaggtatatcccataacttctctgttgaactccagtgtactctcctcgatgtcctatgggaggtatgataatctatacacaattatggattccttctttaaagcgtgagtgtctcatgtctctagtcagccatttgtgaccccctatctcagttttaggcgcgacttctgtggttggccgtcaattccagtgcgtttatgctagcc

SEQ ID NO: 559672 - DNA, 137 bp, Homo sapiens
ggttaaactatcaagcaatgattatgaattgctgcttgaagaaaaacagttcaaaacagagaaaatggcatttgaaaatcacgatatctgttcttagatctgttcttaggacttgctcatcgttgttcgtagacctc

SEQ ID NO: 559673 - DNA, 761 bp, Homo sapiens
gagttgagctagctgctctccagcaactcaatagtgcatccgcccaggcgcatggctatgcacatatcggccactagcagatcaacacacaatatcagactcgacgcaactccctgcacattaccatgccacccatcagtaagagcacctctccattggtagcaggcacctgcacagtgctgtgctctctgcacagcatatccactagcgtatgcgctcatcacataccattactggtcggtgctcttatccagtaaccagactgacgtgatagtcagcagttatacacttcatactgcgcacgtgtcccagtcacattgcagagactatcacttgtgcagaccatacccaccatcaaaccatcatcatcacataatcctcaatggcaacatacatcattctcccacacagagatgtacttagcacgcacgtcttggccatcatatcacgattaggccgcacagcatcagacacagtcacacttcacacacccaagatccgaagcacacgcactagcgcacacacgaatcgcactatagcacatgcacacatatcacataccgcacactcacatgatctcgtctctataccagttgctcactcgcacacagtccattggccgaaggatctacgagcacaacccatagccaggtgcataatccagcaccttcaagccacatatacctcttccaatcatactccaccctcacaatccagtagcacacacccatatcacatgccgatcacgctcattacaggcc

SEQ ID NO: 559674 - DNA, 360 bp, Homo sapiens
atatacatctaattttttaatactcaatgcacaatcaacatttttgatcaacagtataaaccattttaaagagaattctggttttcatttgtacaaatactgctttcatcattgtaaaatttttaaggttaaaacctcccatatgttgaagctataaacctcttgtttgaaggttcctaaaacgaagttaatgctgtctgttgttaatgggctacattgtgacctctaataccagtcattaaatccataggatcttttaatttccaaaagattgttttgtacactaagattatttttttggccaaaccaggtcataggattcctttttttttaaaaatatgtaaatgcatccagaaatgt

SEQ ID NO: 559675 - DNA, 1686 bp, Homo sapiens
  misc_feature (68)..(68): n is a, c, g, or t
  misc_feature (218)..(218): n is a, c, g, or t
tcttcggtcgacgacagctaccgtagacttagttgcttacatgtgctgtaggtcgtcattgtacatantgtggtacgcccgctcacttcgttcggttattgagcgcttcgctgtggtagttatccctccgggtcgttgttttagtggtctcgtctccttatttatggcagagttgtatctctcttcctgtcggcgcgtcgtgtgggtcctctctcttnaatgggaggggaggcgttcctcttatcttgttctttactgcgtacgagtcaccacttattggggggcgcacaacctctcgtgtttgttttcctctgctggtggccccgctcactcttctctatattaagacggagagatctgtgtggctacgcatcatcttcttatagctactatatttttctcttgacggcacgctcgcagctgggagaatatctcttttttcttgtgtggacgccagttgggtgctccgacattgttggggtgctcatactctgttggtaaaacgcttctggcttggttgtggtgtcccgcaggttgttgtgtttttgtcttcctccgtcctggtgtttgttgtgtcccaaagcgggggggtgtgtgttttgttagtgttgttgctgttgttctcacctactcgttggggtgggctctacttctcctcctctttttttggggtgtgcgtcgtattgtatactccttctcgtgaggactacttcgtttttcttttttcacgcagtgtgttctcgtctgcgacgtctatttttttgcggggggcaccccccgcccgtttttttttgtgtgtgttttgggtgtcgcccccaccccgaggagttgtttccccaccacccacatgtctcttcgcaccgacgggaggagtcttctctctttttgggtgtggctacactcgcactctcctactcacccgttgcttcgctctgctgtggtggtgaccacacacagcagtattttgttttctctctttgctgctcgctttttgtgggcgcgcgcattctctctctctctctctcctactgcctccctccacacacacagagtgggtctctctcctctcctgcgcgggtgttgttagtgtatgtgtggggtagatattgtgtggcgcgcgtggagatatatgtgtgtccgcgacgactgcgtggcgcgcacaccctctctctctcctgtggcacacacaccccgcgcgggaggtatattcacttccttgtgtcttgtagtgttctctcccacagagatatctctctcaagagagagaagatttaataataagaagacaccgcgcacctgtcgctctccgagagaagaacaaccagcctccccccgaaggagttttctcgcgggggaaagaggagctctctctcccccctcgcgcgggttctctctctccttttctctcccccgcgcggggtcctccccgcgggtgtgctgagagagagaggaccccagcgcgccccctctctgccctctttttcccccttccctcttttataaggggggccccccccgcccccccgccataattgttgttttgcgcccccccccccctgccgcgccccccgcgcgaggggggggggacccccccccgcgcggggtttttaagtggttttttcaagagagggttttacccccccgggaaaagagagggggggggaaaaaacacacccccctttttta

SEQ ID NO: 559676 - DNA, 801 bp, Homo sapiens
ggcgtgcgttagtatggccgcgtacccgaatcacctgacttgactgggctggcgttaactgtgcggaggcaggatttccctggggacagtctacactcagagcttcgctgacagccaaggatggcaagcaaggggccctcggcctctgcatctcctgagaactccagtgcaggggggcccagtgtgtgtagcagcactggcgctggcgcagagcggagggcaggacaggacttatcgagtgcaacatctgcttggacacagcacaaggatgccgatcatcagcctgtgtggccacctcttctgttggccgatgtatacatcagtggttggagaccagacctaacagacaggtgtgtcctgttggccaaagctggccatcagccgagacaaggtcatcaccaccatctatggaaggggcagcactggggcaacaggaccccagagagaacgaacccatccatcgatactcaaggacagaggccagagacaggagaatagagggggatctccaacggcattggaacttcggagaagggatgccaaaaccacgaaggacgacgtcggagcaacagagaggcaacttatcccacttcaggggaacaactaacgagccaaaacatagcaaaataaacacatgaatagaaacaggacactcacaaccagaatgaacccacgcagacaaccccagacatcgagagaacgaaggacacaaccaatccacgacgcaaccgagacagcggcgccccgcactggcccacgaacccgacacctcgaagaccaacagacgggaacaaggcaaaa

SEQ ID NO: 559677 - DNA, 874 bp, Homo sapiens
gatgccgccggagcggaggagacgaatgaaactggaccggagaaccggagcgaagccgaagcggaagcccggaatgaggccggactggatagccggatgcggggccaggcgggcctcccctaaaagcctgcccctttcatcccagcggtaaaccgccggcccaggccgagcgcgtgcgtgcgctgcgtattgcagtacgcggcaggtggagtgaagagagactggctccggcagcggtgataccgtctgaggcctggaggatggacaaatcgggccgtggagtcggtgcttggatgggagctggtcttctggcgactgtcgacgaacctgacgatggaccgcgttgactgcggggcgttctgcgatggcccggaagggttcagagcaacgatgaaagactcgggtgacttcagaacgtggagcaatgaaggcaagagggtaatttgcgcatgctcgaaaagaagccagtttgggctggagtgaaggaagatgaagcatgaggaaatggttgacatgatgagcaatcggttgcggacggatatgatgacacaagtgctagtgacagtaaactttcgaagagacaaccttaaaacgagacttacggacgaattccaacatgccatgggaggagtacctgcctgggcagagacttacttaagcggaaaacatcttccgatgatgaacgtgaagaggatgacgatgacttgtgcaaagggactgggaattttccattattccacattcaacttctttccacgggggcctcttgcaccattacgaactggcagcatgcaatgtgaacggtcctactggtggctcggggattttcctctggggccgttcatcccggtgcccgattgctgatggttgctgc

SEQ ID NO: 559678 - DNA, 168 bp, Homo sapiens
tagtgtgtgccgagcttgactttgtgatgttggcaggagaggggagacctgggtggtgactgagattccctttatcaaacccttcaatgggcacaaaattgagtgcttgattttaggttttattttattatgaatgtccaaatctgtgttacccccacagagagacgt

SEQ ID NO: 559679 - DNA, 1143 bp, Homo sapiens
gatgcaatgtccatagtcagtcattcatggcaacaaagatgctaaacgatcaaggtggagaggcctgaggctgggtacctcttcagcgcgcagtacaccatgatgattcaaaatcggacccactgtaatggctgctgcagtaaggacagctcgtccacagattctgctaactataacaccagcccttatccctcgtgagaaaaagatctcgtatacttgaggaaccttcaaaggcgtttcgtggggtctcaggcccgagaattattgcactaatatcagtgcacaggcattatagctaacgctgtcaccggttgctcttaactgagaatcatcgcgtcatgcattgaaggagagacagtggcatcagttccgtggaaggaagatcgaagctgccttgtgctgaattacagcaactgtcatcatttgaacataagaagtttcattaactggcgagaatatggctcaatgttagaaggaatgaagccactggaagactcctgacttgctcgtcagaagaaagcccgaagaactaatagagactcactgtaccttgtccacgtcagatggcgagagcatgcatgctggccgtaactcaagggccatgcaaatttaagcacttgtgtcagcgagcgtaaaatatgacgaggagctcgggaaagctgcccgggtttcctgtgacatcgaagcagctgaaggtccaaatcagtgctctgcggaccaacattaccagtccaagaagcactattctcaagaactccctgcggtccctggtgcctctggtgaaatggcacgcggaaactgcgggaacacaagtaacttttgcccgaaaatttccattcccaaaaagcgcctgaagggacaaggggaaccccaaggtggggcgggtcccaaaaagagaacctttacaaaaacgggggcacaagaacaggggctctcaaacaaagggagaatgacccgagtaaaaacaggggaaaggggggcagaagacagcgaggagaacatcactgtagagaaaggatcaaaaaagcaaaagacgcccaaaagggggaaaacaatagcgaaaacagacgcgcaacaacagacgaggcaaagacacgaagatgaggaacaaaaaacaacagcggagaaaaagcgaaggtacgt

SEQ ID NO: 559680 - DNA, 143 bp, Homo sapiens
gtcccatgctctgccgggcaaagtagccacctaggcaccatcacctccctccaccccccatgaggtcatctgcctgcagacagttctcgtgttccccatgcaacagccaattaagagattaatataccgtgagagtagaggaa

SEQ ID NO: 559681 - DNA, 289 bp, Homo sapiens
tcttgtacccacctcggacacatcctgatccatcatcgacgtcgattacaccctattgctacgatatcggactctaacaataatattgcgctgttctcccttacggtaacttgttccgttgttcccgttattgtatcaactcattctattcttatcagctctagactggtgatatctttccatatcccgctctgaggttgggttctgcctccgatgtcgtcccgaccgcaatttcttatgcatgttcgttactttagcacctgtgtgattgttatctcctatatgcatt

SEQ ID NO: 559682 - DNA, 247 bp, Homo sapiens
  misc_feature (232)..(232): n is a, c, g, or t
aatcccttggaaaaattggcaggggttgaaggggtttccttttctccccttgaaggggctttgttgggtttttggggttttgggtgggactcccaaagcagggggggggagcccccccagcaaaaactcgggggctgggatgaggggggcgggcccgttttatgatttgggttttatggggcccttgaaaacaggggctttccaaaaaacctctcctcttaaataaaaaaanaacccaggttttgga

SEQ ID NO: 559683 - DNA, 401 bp, Homo sapiens
  misc_feature (338)..(338): n is a, c, g, or t
tcggcaaagccgagcttagcaaacgcacccacctccttgggacgttatattctattagattcattcctgtgtagacactgtcaagtgtctgtatgtattgaaagtgtactacatggccaagcatggtggctcacgcgtaatcccagcactttgggaggccgaggcaggcaaatcatgaggtcaggagttcgagaccagcttggccaacatggtaaaaccccatctctactaaaaatacaaaaaattagctgggcatagtggcaggtgcttgtaatcccagctacctaggaggctgaggcaggagaatcgcttgaaccggggaggcggaggttgcagtnagccaagatgcgccactgcactccagcttgggcgacagagtgagactccatctcaaaaaaaaa

SEQ ID NO: 559684 - DNA, 986 bp, Homo sapiens
gggagggtccgcgccgcggttttcaagtgggaacttctgaaatggatcgtgatcgttgcgtcaaatcctgccgctaaggggtgcctcaagtggtcaaggccccgattgggttactgggccgtttctatgtgtcctcaattacaccaaacgtgtcaaatgtacctggggcaaattcctcgactacccaagttttcttctggtgcgagggctcgttttggcgtctttcctgttcgtggctccatgtggacctgtggctgacacacccggggtcaaggttcccattgggattcataggccttgggatctcaccaacgtagttgggacagatactcacgccttgccaaggtcatggggccggttcggtccctggctcggagctctcttcgtcctcgtttggtgtgcaccatacagtcttggccgtcaacgtcccagcttaacctcgagggggcccgtttcacggttgagatggaattgtataacttgtctgacgtctctggcggacgggccttgacattcaccttactcatggatggctctccagggcgaagcccatgccaggcagcagtcaggcatgcagtccgttgcacttctattgaagagtcatatatcaggtttgctggagctgtgtcccagtaatctcagaggctgatcatccacagcctctgctgagtggttgtcaatgcacggttgcttgaagacagctcgcctgatctatgcacaacggtgattgggcctaactgaagatagttgcaactctggagaggactggtaaaatcaggcttcgtcagtaactaagttgaaatttaggtataacaagataagaattgattagtgagggtataaagtgtaaccatcagttaaacctctccgtgtcattcctagcttgccttgcttcagaatgtgaaatggaagtgggggtgtccctagctctgtagaatctgggactgggcaaatgtttgtgtggcattccttcaatctagctgttg

SEQ ID NO: 559685 - DNA, 884 bp, Homo sapiens
cctcaacagggccactcttagggggatctctgtgcttgtcgagctcacctctctgcggaagagactttgctcagtttttcccacgcccggggttttttctgaggacttcagtgccccctgttttctgaggctttgctctcccaccacgtgtgccataatgggactcccgcgctttcctctttctgaacaacggcgtgtatctcggggttcacccccgctagcccccgccttgtgtgacgccactctcgggcggtcctttggtgcttacggtcaattcaactcccccccgtggtggccattcacgacgcgccttgtgtttgccgcggaaatatgcctctggcatctaccgtggggttggtcccccccccggtggactggcgccgttgtcacgcccacctccttcttggacgtctctcgtggcaggggtctactctccgtttccaaggtactcttagccccccttgccggtcaacacccgggtcatccccgcttttgttttgcgcatccaccccccgcaatttgcgggcgcacttttgggcggcccaccccggcttgtccctccctttctccccagggcttgagcagcgagtgatctcattctcaccacagcaggaagcggaggggcacctcgcagcctcagacgcgattcccctgcctcacccctcggtgataacctgagaatcacttgtcaataacaaaccaaacaacaacaacatatattagtggggttaatttggcgacaagacgtcctgaagtcgcacaccactgggggccacccataggtgtgggagagctcatcatacggggcacgcccatgtgcagggccgcggaacatcccaaacccctgtgtcacgcgccaaacccctttttcttaaaacaagaca

SEQ ID NO: 559686 - DNA, 660 bp, Homo sapiens
caaaaaacaaacaaaacaaaaaaaaaaaacaacaataaacaagaaaaaccgaagttaatcgaacgagggtagacaaggcgtgacaagcgaagagagaagagactatcaagatctccactaagggaaatgagaatcatatatagcggaacatagggcagaagcttgccataggctggatggagaaggaggaggcagaatgtctgcatagtaacaccatacagctcaaacttcagaagatttagggttaagcagttatcattagtctgcaaatgatcgtgtatacacctagatcattagaaactaatgaaacacctatttaagtctatatgaattcaaggttacactgtaattccagatgcctatggcagctggtacagggcctctgaaaaatggaaccaaatactctgaggactaaagtcccagctttcttatctagattaggggaaggccacatagaggggaatcagaaagtgtccccgatgtggcacatacaatggaacccggggactgagctgtaagaacaagacatgtggaaccatattccgctacggtgcacgcacgcagcctagtgtagacagctgtcaccatcattacaggctctgatcttcaggtctactcagtgcggcaagagcacggggccctgattaccgatgcttagaa

SEQ ID NO: 559687 - DNA, 700 bp, Homo sapiens
  misc_feature (6)..(6): n is a, c, g, or t
  misc_feature (19)..(19): n is a, c, g, or t
  misc_feature (60)..(60): n is a, c, g, or t
  misc_feature (67)..(67): n is a, c, g, or t
  misc_feature (113)..(113): n is a, c, g, or t
  misc_feature (289)..(289): n is a, c, g, or t
  misc_feature (538)..(538): n is a, c, g, or t
  misc_feature (587)..(587): n is a, c, g, or t
  misc_feature (599)..(599): n is a, c, g, or t
  misc_feature (614)..(614): n is a, c, g, or t
  misc_feature (626)..(626): n is a, c, g, or t
  misc_feature (662)..(662): n is a, c, g, or t
  misc_feature (688)..(688): n is a, c, g, or t
  misc_feature (697)..(697): n is a, c, g, or t
gccccnagttccctcccgnttaaatgaaaccagaaaactttaaaacagccaaaatcagtnaccaggnccagttataaccagagcttttctagttcagccctcaccaagttagnaacaaacagagcttcagcaaggaacagcttcaaacagtggttgggcacttaccatggttccccaggaccagtcccatcaagtgactggtaaccaccagcaggcctcctcaggcagaacactgggatttccacgtaggcaatcaggccctattacaatagtcgtggtgtgtctcgtngagggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctcttggcagagttgaccacggggagccccacgaggtcgtggagggcccccaagnccccacagagggattccgaaattacccttagcaagttatttatttgttncaggttttgttnattgccaaaacaaantgccagtttccntatttttccagagggtttttctttgtttccttaggnacttttttaaggggctttttaccctnagcagggtnaat

SEQ ID NO: 559688 - DNA, 965 bp, Homo sapiens
gatgggaggatgcttgagcccgtgagttgagaccagcgtgggtgacgtggcgagaccctgtctctacgaaaaattaaaaaaaaaaaaaaaacccgggggttgggggctggcagtggagctatgaatggagccactgggactccagcctggggcaacgagggcaagaccctggtctcaaaaaaaaaaaaattttatttggaacccttctggttgggggcagttcctccggtaaatatttacctttctcaaaagggaaaaacgcgttggggcgcggggggtcccacgcttggtgggccccaagccacttgtgggggaggccggaggtgggggtgagacaccccctggattgtccgggatgttagaggggggcagggcttggacccaattttgggaggaacatctggttttttattaaaaacccaaaaaattaagcgcggggggtggggggcgatggcttgttagttcccaagttaattgggagagggttggaggcagaaagatttcggttttgaaccttgggagaggggggagggttgcatgtgatgctggggttttcggacccattgggaccccaagggttgggaaattaaggatggaactttcctttttcaaaaaaaaaaaaaggggggctcttcgacacttttttcggacggaacagtgtgaagtgccaccaatttttttccttttccacaggcgtgattgtggggccagcgggttcattccctcaccagaatgttctagggagttaagggcgcttttcctttaacaaataggggttctggtccctaagggtatggtcttccctttctcaccgagggttaatacttaaagcacgcgcgggggggcaccagtaccaaggtgaagcggggagagctaccggtgccacacgacaaaaaaaaaaatgcgggcaagaatcgggcggaaaagcttaccttgctcagcgctgtgtctgtctcgtctcctgc

SEQ ID NO: 559689 - DNA, 432 bp, Homo sapiens
aggaaggcgacgtccggagttgtaccttctgatgtacagatgtgttgggagtttcttccttctggtgggtcgtgctctcgctggctcaggagtgaagctgcagaccttcgcagtgagtgttacagctcttaaggcagagcgtctggggttgttccttcctctcggtgggctcgtggtctccactcaggaaagaagctgctgatcttcatgtgagtctcacagctcataaaaacagcgtggacccaaagagtgagcagtagcaagattattgcaaacagctaaagaacaaagcacagtgtggaaggggacccgagcgggttgccagtgctgactcaggcagcccgcttttattctcttatctggccccacccacatcctgctgattggtagagccgagtggcctgttttgacaggacgcgccatcgtgcgctt

SEQ ID NO: 559690 - DNA, 287 bp, Homo sapiens
tgagggctttaatcctttaaaacttggagaagctggctgggcgcggtcgcacgcctgtaatcccagcactttgagagaccgaggcgggcggatcacgaggtcaggagatcgagaccatcctggctaacacggtgaaaccccatctctactaaaaatacaaaaaattagctgggcgtgagtgcaggcgcctatggtcccagctactcgggaggctgaggcaggagaatagtgtgaacccaggaggcggagcttgcagtgagccaagaaaagaccactgcacttcagac

SEQ ID NO: 559691 - DNA, 472 bp, Homo sapiens
ataccatggcactccaagggagaatgtgttgaactgactgctaattgacccagtccactagtcttaccggttatcttagttattgggtataaatctacttctcctggtatatgataagtcaatgcaaaacaatcaatgatgatcagcgctacctctcttgaatcgtccacaatgtcattatgtacgtgactaccaataacactctatcgtagtagcctgatacattctggttattcactcacatgtggtgtattctccaacttttatttatagatctgaaccttgcctgagttaaagactctagattctacgaaaagggtgaactccagagatttccctttaatgactcattcctcatatcaacattgggaagttacctggagacttcctgcttcatccagttggcccatgagagaggaccgtttaacactgatattgcttggattggttataagtttaactccaacaataa

SEQ ID NO: 559692 - DNA, 1110 bp, Homo sapiens
cggacgcgtgggcaagatcgcaccattgcactccagcctgggcgacaagagcaaaactccgtctcaaaaaaaaagaacaaagaaacaaaacaaaaaacttcccaaggacccaaggacccattttcctctctatctgcctaaaataatttcttaataactcctacaacattcccccctgtggagatgccacactaactgctgttagggagtttgggcgacagactccttctggctacttctttgttgcaaaagggcgtcgaatggggaagagcagtagggctcctcctggggtcacatctaagggtcctcagaagaatgatgtgtctcatgtgtggttctgtttacagccaccattttggcagtttgattgcgttctagatgagaagaaacccatttgagttaatagtattgcggtactaccagggtcccaatattctactacacagaccaccataaaggcacgagaaggggcttcaactcaacagggggttaacccaattccactaaaagaagaccggaacttttatctacaagaggccatctgtatgccactcgggggatcacactcacatgtctgaactcgagactttacagaaccctgtctcgatattctcctttttcaacctagaagggcattaatcccgaaaagcacgcattgtgttcccatctggaaaacttgcggtcacctaaaaccgcaattacaagagtgcctaagccagattccagtggctaggttacaaccttttatgcttccccttttcacataagtagccctatttaattcctcctgggctattaacagggactacaactgcacgttaaaggccgccaataattgagcaaggcatgtgggaggcactcccccttgtttacaactaatgtccacagcgtatgacaaggggggcgtcaccccccggggtcatatatccctacttgtgccacacatacactaaaagttgaggttatacgccccgtaatcccaccaactaggtggcatggttgggtagcacataattctccactccaaacactcaaccgccggccgcaagtttgaaaagccccctgggggggaccacagcagagcagtgggtgcaaatcctaacgaagaac

SEQ ID NO: 559693 - DNA, 266 bp, Homo sapiens
agcgggaggtcgggcgctggcgggcgaggagcggcggcggtggcggcagtggacatgggaaagcggaaccaccaaaaggagtggtgatcaacgatctcatgataaatctggatgctagttctcatgcctcagcacatccccctgtcgaaacacagctctgggatcagacttcatctataggaccgctgccagaatactaaagccagctctagccacgaatggtacaaaggaaacatgatgaaagattaatccttacataccgaata

SEQ ID NO: 559694 - DNA, 382 bp, Homo sapiens
cttgggtacagaattcagcacaagaatctaccctgcgtcaaagcagtgatctttctgacagaagagggggagaaatgcagccactggagggagaactgggtgttccagaaggttcatgaacttgagaaagcccgaaagagacagctgaagatctcttcacgataagagtggcacaggctgctggcatagcagagcttgtccgatgacttccatatttatgcatctttgaatgatttgtagttttttatttgtaatctaatttactttaaattattgaaatattgtacacaataggtataactggagttatttatttctataaattattattaccgataggtattctgagtaaaatattaataaaaatgactttcactttgga

SEQ ID NO: 559695 - DNA, 105 bp, Homo sapiens
  misc_feature (49)..(49): n is a, c, g, or t
gatcagccggccccgccttaccaactgacatacataggctcatcacagnttggatgcaagcacacaaagatgggcttggcgcttgtctaagaattttggcatggg

SEQ ID NO: 559696 - DNA, 106 bp, Homo sapiens
tcgtattatttggccctatgttcgtaatagaagtcccccacgcccagcatctcagaccaaaatcctttcccagaggccagcggatccacgccaatggttgcacaca

SEQ ID NO: 559697 - DNA, 936 bp, Homo sapiens
cccacgcgtcgggctgggaggctgccccagcgctgctacccacgcagagccagggctggcttcgctgggggctggtgtggctgtgccgagccccgtggctgcagctcgtaaggggagccctgtggctgctgggagctgctgggctgcgtgtgccctgtgtgtgtggtgatgcccatgtggggcttgtaccacaactggactgctggtggcaaccgttgctggcgcccagtgacctcccacgcatgagctgctcagcctgatccaagagtctcccatgatccatgacctggcctgcagctgaccccctgttacccacgtaaacaatgacggttgtcccctatccttgcacgcaaggggtcctgacggcgcgtttcccttcggacggttcaccacattggccaccgttggccccccatcacgcagggtggtgggattgggaggtgttgaaagccccttgttagtcagggccatgcggggacttggaggaattccacacgattatccttaccccttcacgttaccgcatcgaacgacagtggggttggccccccattcccattgggcttgggagcccccacagggacgactggtgaccgcacacgccggcgtccggagcgagaagaaagagcgataaacagagttgacgcgtccccttccttcgttcgtattacaacattccgacgagccgacacgccattcacgagggaagggccgtgaacacaatgtggcttgttaccggagagggaccaagagcgacccccatggtgccacacggccaggtactcccgatacacggcacgttaacgttacacaccccgagccccaattgtgacaggtggctggtgcaaaccggcaagaccagtgtgggccaaccgcgcagcggctgaccccgcgcgagtatcacgcgccaccatacagcttcctgtggcatcaacg

SEQ ID NO: 559698 - DNA, 916 bp, Homo sapiens
gcaggtcggctaggccggcagctcccccttgcccgtcagccagttggacgaaccccccactccctgccaccgtcacacgacgtatttattgttcccacacactggctgagagtggggcccttccagattgggggccctggggttccccagctccctgtccatccccagtcttggggctgcgtaccgccagatttctcccttacggaagttgacttcagtcaggggtgtgacggctcccagtacccaggggcacgtgtgtgtggagacgggcgtgttccaatcagagaacggacctggtctgcatgagccgtccctggtgtcccctccaggttgctggtaggcagactctaagggccgaattgttcctatgttaggccacgcttcctctgttcatgtcgcatgaggtgaaccactcatgtcggcccatgtcaatgggcctcctctgaagctaacctgtgcacgtcacccttgtcagccccaaattagaagcccagaaggcagctgtaaaaaatacaagatcctagatacatccaagacaagccagtgaacaattggaccccaaagtcatgtcaagtgttggccccatgataaccttcaccatctttgcaaccagcgagaccagaggcagtgcatgggacgcagtgtcagggtcgccgtatccatctccattcctaggcccgttggcgcagagcatggtccaacaacgttcggcattcatccatgggcctgccgggcccatgtcctcctatctgctgccacattgtatctgtgttgcgcatgcccaaatgcttgcctagccctcttcagaaggctgtgccaaggctcgcgtggcattgctatcgctaaccacgaagagtgtcctggaatgcccggttccccagggccatccagcctccttgccttcccagatatccca

SEQ ID NO: 559699 - DNA, 583 bp, Homo sapiens
agcaggctattccacgtctgtggactatatattccctatagatttcctaccaaggtgcgctattgttagcagcaacacattgggcttgggtatttagtcctggaatctgccctctgtatcagaaaagctgctgatttttctatccagttccatgctactagtactactgtcccagaccaagtcagtagtggggatggacgtgtgtggtatatgcgactttaaactaaagttaagcagtttttcacaaataaatgcttctcaatttatttctcttcaattgttgtatcaggccctgacatggttgattttgataattttgtccagttttatggttttagggagaaatttgccaacctctgcactttacaatcataaaatctgcttttttaaatatctaatttgttctcttacgaagcttaatggcataacttttctaagaggtaaaactttgaattttaattttgttcttagtcacaaataactatgttcacctcagttaactttcttcttaatttgattcgtgacagaataagcaccggaagccatgatcactgactaataactgatcattgtacaatcatcc

SEQ ID NO: 559700 - DNA, 725 bp, Homo sapiens
gggcgcagtggatcacgcctgtaatcccagcactttggagggccgaggtgggcagatcacttgaggtcgggagttcgagaccagcctggccaacatagtgaaaccccgtctctactgaaaatacaaaaattagctgggcgtggtggtgggcgcctgtagtcccagctacttgggaggctgaggcgggagaatcgcttgaattcaggaggtagaggttgcagtgagccaagatggcgccactacactccagcccaggcaacagagtgagaactccgtctgaaaaaaaaaaaaaattttgcacacacacacacacaggagatatttatgggaaaaagataattggcaaataggcaagttaccagggcagagaaaagtgcttcaaaaaaagggagaggctggggcaggggctcaagggctgttggtcccagacacttggggaggccaaggttggggagaagaggatggctgtgaactcgggagttggagactagctggggcaacttgggttgcaattcccaatctctaagagacgaaagcaaaagaaaaacataaaacccacttgggcgggcaggacagagccccgcaaagaagacggcgcccaacaccacaccgcggtgggccacgaggtgccacaaagagagacagcggacactggcgacacagcggggtcccagaggggaatcggggcaagacacgaagtgagggagacgccaccacaagaaacg

SEQ ID NO: 559701 - DNA, 1060 bp, Homo sapiens
ccaggcgctacgggatttaaacatctccgtactgagatagtactactatatcgatcacgctgcttgatcgttctgaataggcttctaacagacatactcgtatcagctgaccattatttgctacttcgtcatcctaccacgtgcatgtactcacacatacctctgcttgagtcactaaggatatcgtgtctctcatgtgggatcagtatgccttagggggctgctcaagacaccgggtgtggtctgatcacctattgacttcctcgatctacatccgtaaacacatgagtagggtcataaaatctaagttaaaatagacactcaatgtacatgacttcgagtggctagacatacttacctggtggacaactgtgtaggattcccattagtcaaacatgaaatgttgatcttgtccaaggaatggtcgtacgttggcaatcgattgactggtgaccgcagaacttgacctaacaatggtcccactaggattcacttgctcaggtgattatcctgcataatatcccatgtcacgcataagcgcctggcctcatgcaccctgtattggatcgcctcatggttctacattgccatgcaagttaagctgacctgatcggtggggcagattgatcgccgatctggtaatgaagctggaaatcaaggccctaaattcttgcaacgtctggtgatgctgcccatagttgatattgtttctggcaatcccatgtgtgtggagagttctcatgactattcaccttgggtccgttgatgtccgcatagtgtaaacaagacccgttgtggggggtgcatcaaaacggcgtgacacaagggttgtggactatggaaggccccaagtttgcctaaccgtctagaggaaggaatttttccaaactggcccaactatacgggggcaacgcaaattgtggctcggggcctaatggagcacacacgggtgtgtgaacagcgctccgccgaaggacagagggcgtgccctgccggggagaactaaaacgttgacaccacatcaggccccctttgagacaaacaccaaaaaaggcgtcgc

SEQ ID NO: 559702 - DNA, 305 bp, Homo sapiens
tgccgcggccgcgcgcccgtggcttcttgcctttgttcttggtggcaacgactggcgctgcatgcccctgacacggacccggcggggtgacaacgctttaccggtgacaacagacaaccggctaaacgcttcgtttcctgtcatcctggccctgtttgggaggtagggggctttaccccttctgtttcatgaagttgctgcggaacggaacgattgtaatctcacctccagatccataggcttctgctaggagcatgttgctgacaaggaatgcttgtacccaggccaacagcatccttgcctcc

SEQ ID NO: 559703 - DNA, 105 bp, Homo sapiens
tctagaatcctgtgggtgcttctcatagaacaacagagacagttgattcattttgttgagttatcgcgtcagaattccagtttacgtcgaagcacatgaggatga

SEQ ID NO: 559704 - DNA, 234 bp, Homo sapiens
agtcttgatcaggtacatgcattagtaagtactattctcccatgccagtgggcttgtcttctacttttcttaatgaggccgggcgcgtgtggctcacagactgtaatcccagcactattgggaggccaaggcaggtggatcacctgaggtcaggcgttccggaccagcctggccaccctggggacaaccctgtctctactaaaaatacagaacattagctggtgtgtggtggcg

SEQ ID NO: 559705 - DNA, 109 bp, Homo sapiens
tgatccccctcgagttctagcattgtcagctgtcctcccatctcagacctcatgagtagctgggaccagcagacatgtacaagcacagcttgctaattatttaattttt

SEQ ID NO: 559706 - DNA, 137 bp, Homo sapiens
aagacgcagactcgaattcactctggagagaagccctacaaatgcgaaacctgcggagccagatttgtacatgtgtggccacctccgatgcccagtgtgctctatccaccacttggtagagacagccgctatcccct

SEQ ID NO: 559707 - DNA, 356 bp, Homo sapiens
cctatgaggccgatacagtttggatgttgtcccctccaaatcccatgtggaattgtaatccccagttttggaggcagggcctggtgggaggtgattggatcttaggggtagattcctcatggcttggtgctgtcctcacaatagtaagttctcacgagatctggttgtttaaaagtgggtgtcatctcctccccttgctcccactcctgctgtgcgagacgccagttcctgctttgccttttggcatgattgtaagctcctaagtcctcatcagaagccgagcacatgcccgcaccatgatttttgtacaggctgcagaaccatgaaccaattaaacctcttttcattattgatca

SEQ ID NO: 559708 - DNA, 292 bp, Homo sapiens
tcgcggccgcgtcgaccctacgcccagtaccgcaagacccgcaagcctggctggcgacccagggcaatgtcgacaagctggtgaagctctctggcgccaaggcgtctgatattcccctgctgctgcaaggcaacgtctacccgttggcggctgaccaggtcaccgttctcggcaagccgaccgcccaggccatcaccgacaccgccgcgttcctgaaagagcagggcaaggtcgatgccgtgctgccggactacgtcgacgcggccgcgaatttaggagtagtagtagagta

SEQ ID NO: 559709 - DNA, 871 bp, Homo sapiens
  misc_feature (3)..(3): n is a, c, g, or t
  misc_feature (102)..(102): n is a, c, g, or t
  misc_feature (112)..(112): n is a, c, g, or t
  misc_feature (136)..(136): n is a, c, g, or t
  misc_feature (140)..(140): n is a, c, g, or t
  misc_feature (146)..(146): n is a, c, g, or t
  misc_feature (178)..(178): n is a, c, g, or t
  misc_feature (253)..(253): n is a, c, g, or t
  misc_feature (293)..(293): n is a, c, g, or t
  misc_feature (309)..(309): n is a, c, g, or t
  misc_feature (404)..(404): n is a, c, g, or t
  misc_feature (435)..(435): n is a, c, g, or t
  misc_feature (437)..(437): n is a, c, g, or t
  misc_feature (441)..(441): n is a, c, g, or t
  misc_feature (506)..(506): n is a, c, g, or t
  misc_feature (529)..(529): n is a, c, g, or t
  misc_feature (732)..(732): n is a, c, g, or t
  misc_feature (738)..(739): n is a, c, g, or t
  misc_feature (749)..(749): n is a, c, g, or t
  misc_feature (766)..(766): n is a, c, g, or t
  misc_feature (865)..(865): n is a, c, g, or t
gcncaatccattggtgacgttcatctttttccagaggaatataccattctgttaggacttctggtcaaacgttggtcgtcactgcgcctttgcgcgccgggngactttaganctttttccttccaggacaaaaggnatgntgttcngcttgttgtgatgagcgatatagaggggagcnacaagagtgggtgcggtgacaagatatggaaaggggtgggtggtctggggggtgggatttttagaattgttcggntaaaggttatcttttttgctacccgtggaatcggaaagtnttccttcagggttctnactggagggagaaccggacatcttttgtttgtgttctttggggggtgagggtcgtggggtggtgtatcatcatcttcagggtctttgggctccanatcctcagtagggtctgaagagttaacttcntnttgngggggagaaatgaggttagtttcctccccagattcggttttgaaagcatgaggggaaagcttccntttgtgagggaggtggtttgtgncagccttggggagctccttgttatcagaagggttggagatgggcttggaatggtctttccaggaaggctgctctggaaccaccttgttagggctgtcttttgaggtctgctcctccgcacccgacttgctgggcccgtctattgggccctgctcctctgcaccggacttgttagagccgtcttttggagtctgcttctccgcncccganntgatagggangtcttttggggtctgancctccgcacccgacttgctggagccgtcttttggggtctggccgtccgcacccgacttattagggaaatctttttgtggtctgcgcctccgaacctganttgcta

SEQ ID NO: 559710 - DNA, 321 bp, Homo sapiens
gatcgacgaaaatgttggtgaaaagtgagtctcgaagtggtagctcacacttgtaataccagcactttcggaggctgagacggggatcgctcgaggccaggagttcaagaccagcctgggcaacataacgagacccccatctctaccaaaaatttaaaaattagccgggcatggtggcgcaacgtgttgtcccagttactcctgagactaaggcaagaggatcccttgagttcaggagttcaaggctgcagtgagctatgattgagccactgcactccagcctgggtgacagagcaagactcttatctacctgtgggaaaa

SEQ ID NO: 559711 - DNA, 801 bp, Homo sapiens
  misc_feature (333)..(333): n is a, c, g, or t
atagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaatttggtggctaggataaagggttatcctaattggcttaactctcaggaaagtgttaattaacgcattgggaattcctgtacgtatatcactgtcaatggaattatccaattttacagattagtatgatatactttccatcatttaacgtaagggatcgaaaacttttcaaattggctctatctgggctgatagacatttncgtcattaaagtaaggggatcgaagactttccaatatggctatctccatctggggctgatccaaaatcctgagatggtgggctacctatatttggtggcagcttttcaattgtcctctggaacttccaaaccactttcattccagcctgtagaacaaattattctggatcttttgatcaaagcctgtaatgatagctttaacaaaaaaaaaaaaacaatcaaaaacaaaaaaaaaattgttgtggggccggtcttcggcccctagaaaaagttctttaaacacctcttcgttgggggccggcggccccaagtgtgtttatcaaacctttggcaaaccttggcccccagagaaactctgggctacaaacggcgtggttttccccccaattaaaaaaccccgggggaaccagtcgtttggacaatccagatggggtccgggcgatcggggtttacacgggtcccgagttc

SEQ ID NO: 559712 - DNA, 402 bp, Homo sapiens
tactattataggttttcagaatcgtaagccaggctattgtatcgcaattcggcatttatcgaaaacaaatttgccgtggacactttgttttgtgcttgatcatgtctataatatcattattgaggaatattattatcacagcatgatccccaccctttatcattttgtgcagtgattattttttaaacgtcttctttcatgtaaatagcatacagggctttactatcttttcatctcattaattcaattaaaaccattaccttataatttttttctttcgaagtgtggtgtcttttatatttcaattagtcactgtcttaattcatagattttactttttttcaccttaggtagtaggaagaattacaatttctttaaatcatttatctggatttttatgtt

SEQ ID NO: 559713 - DNA, 253 bp, Homo sapiens
agtacctcatcccctcagtgactaagaatcgcagtatttaagaggtagcaggaatgggctgagagtggtgttagcttatctccaaccccagaagtggccaccacgtattccatcgtcaagtttagtgggctatcgacgtagcagcctgacagcaccacaaggagcaagggggcgcagcacacacaaccttaggcgagaaacccaacccattgcttgcatattagtgcgcacaagcttgtggccaacggaattg

SEQ ID NO: 559714 - DNA, 394 bp, Homo sapiens
acttccacaaggactggcagcgggcgtggccacgtggttcaaccagccggcccgtaagatccgcagatcgtaaggccgcggcagagcctaaggcgcagccgcattcagcctcacgcgccaccgcgtcgcgatcccatccggcccatcgtgcgctgccccacggttcggtaccacacgaaggtgcgcgccggccgggcttcagctggaggagctcagggtggccggcattcacaagaaggtggcccggaccatcggcatttctgttgatccgaggaggcggaacaagtccacggaatccctgcaggccaacgtgcagcggctgaaggagtaccgctccaaactcatcctcttccccaggaagccctcggcccccaagaagggagacagttctgct

SEQ ID NO: 559715 - DNA, 324 bp, Homo sapiens
cttccggcctgcaggatccagtcctgccctgctcacccagcttccaggcccttccctgtgtgcagcctcagtttgcctgctgcagaataagcaccacgctccctcgtgggcagaggcaccggcagactcaccacgcgccctgcaggcatgtcctgtgctgtgccaggcaggccccggccacgtccctgcccccggagctggccttcagcggggacagtggtcagcactgaagacagtcatacctgcccggccggcactgccctgctcagcacggggacaatttgaacttaagctttaacttaattaaaatgaactaaaattaca

SEQ ID NO: 559716 - DNA, 506 bp, Homo sapiens
ttttttttttacagagtctggatctaattaattgggtaactcaaaaaaatcttattccggacgggatccagaactaaaaagtaaaagctcgcagagaggaaagtcggcgtctctccgaaatgggtcccgggggcttctccttagcctccttcatcctcgtgggccaaaagttaagcatatccggcagcctctccttaattttccgtgggaacgcggcttctccagagcaatacgccgccgtgggggcggcaggacacggtggagtaacaagacgctaaactcgtggggtgctggggccctgaggtcctaaccttcttaattaaggggcttcctacacaacatacggggggacatcaatctccttaagaagagatggaaaagttgggggatccggctaacttttggggggcccgagggggcgaggcacggtagtatcagccagcccgggattatccttctctccttttttcacaataacccaagttgaaaagctcggattggcttca

SEQ ID NO: 559717 - DNA, 354 bp, Homo sapiens
  misc_feature (58)..(58): n is a, c, g, or t
  misc_feature (166)..(166): n is a, c, g, or t
  misc_feature (187)..(187): n is a, c, g, or t
  misc_feature (239)..(239): n is a, c, g, or t
  misc_feature (243)..(243): n is a, c, g, or t
  misc_feature (319)..(319): n is a, c, g, or t
atggaatgatctcggttcactgcagcctctgcctcctgggttcaagcaattctcatgnctcagcctccagagtagctgggattacaggcatgcgccaccatgcccagctaatttttttatttttagcagagatggggttttaccatgctgcccaggctggtcttgnaactcttgacctcaggtgagncacccatctctgtctccccaaggttagggttacaggagtgagccaccatgcncggncaaccctttcttaaagtaacaggaatttaacaggcattaacctaaacacgagaatgatgtacatttaatggatttncagaacatgatgaattccactgacccccattaaca

SEQ ID NO: 559718 - DNA, 413 bp, Homo sapiens
cgtcgaccggccgcgggacagtgaaaacaagaagacaagagcaagagagagagtaaggaggggcgagcagcctcttttatagtgagtcaggcaaacctgaccattgccaggtaactgtggggcagagcttagacaaaatgttaacaccatctgtgacttcagcaagcctttattatcatggtttatatttttgctatgagttttttaaatacatttttttaggagaggaagtgttttacctcaagatttgaggtccaacaaaagttctagtctcagaatatgagctcttcatcataatgtatcaccacaaatattttttaaacttttccataaaatagaaaagggaagccataccccccactttctgtgacaccgtcgacgcggccgcgaatttagtagtagtagacggccgc

SEQ ID NO: 559719 - DNA, 379 bp, Homo sapiens
tttcctcccccccaacttttttaaacaaaaaacaaggccttttttttttagagtggggccccctttgccccccccaacagagattttacatggaaaccgggctcagttaaaactgatttcctgcccaatatttgtttttgggctgtttttagtgactaattattaaggaatctagctggttatccagttcaaggctttttttgttgttaatgaccccccaaaatagccgtttagacatgaaatacagcagcgggtttccaatgcgaacaggtagtttgcctttttgttaaacattcaaaaaatgaagttttgaatttgttggaacattcaaagggctttagagcctttttttgtaacttaaaaaaataaatacccctgt

SEQ ID NO: 559720 - DNA, 853 bp, Homo sapiens
ggtcgtggtgcttgggtggtcgccagcaagaagactttggtggggtagtctcggggcagctcagcgtgcccgctgtgcccgttactggcctcgttcgcagtcttgcacgtcgagactcgtaggccgtaccgtagggcgagcgtgcgggtcgccgtcgcggccgcctcgtgggtctgggcccatgccgcatgcctcttctaccgcgtgctggttgggagtcgccgcgagatgcggcctccgggcccgcccccgtgctatgcccccagtaacggggacttcatccttatgtctcctcagcagacgcggaagatctcagtggttcagtagcatccccgagatgtcaaattaaactcttggtggagattttatcaaagaatctacaggctactacatttctgagtacaaagaggttatggctggcttctggaacgtcgagagatgatgcatcctgaagataacaagccactcttggaagacattggacattgatctaagggatatttattacgaaatccgatgtgtgtgatgccaatgccatcacttggttaaaatagacaagtggtgagagacaatcctgactttaggggtcctctggcgtgtagatctttccttttccatgatatcattcatatggacagattagggtggtctcatggattataaccatttgtattatcgggttcagtaacaagatatctgactgtgccagacgtacttggtggacgaaagttgcatatggacaagtcccttcgagttcttgggacaatcctaagttcctctcattgttcatagcccctgagcttttggagggaaggatcattgaagtggggtcaaataataaatgctggggaga

SEQ ID NO: 559721 - DNA, 186 bp, Homo sapiens
tactttccacagggtacagaagacataggatgaagtctttggcatgacaacattcaagatggtgtagtgcaccatgcagagcttagaaaagctggacaaagaaaacaaggaagtattcaaagattagtaaagttatgctaaaagcagataggaactggcttgaaatagctcccccctgtggaaaag

SEQ ID NO: 559722 - DNA, 194 bp, Homo sapiens
gttttttttttttaaaaaattttttaaaaaataggccttgggggttttttttttttccgggggccacctgtttggtttttaaaaaataacccctttagtaaaagggggggggggccttttttttttttccaaaccgggaaaaaagacctgggttttgaaaaatgggcccccaaattaaaactttgggacgggta

SEQ ID NO: 559723 - DNA, 461 bp, Homo sapiens
aagcagtggtatcaacgcagagggcccattacggccggggggaaacactgtgcggctgtggtttggttcagcgcgtcgcggctcatggctctcgttacaggcctccacggtgttccaccttggagtcaggacgcgcgcttgtgccttacagttcggttcacgcaatggtggaaccacctgggcatttacagtcgacgcctgtgtacactcggcttcagagaattcaccgaaacactgtgtcacccggtgggcatgccaggcgcattctccctgggagattcacttcctgcacgagacgttacttaacacgcatgtgtaccctggaacgtggcaggacatccctggggtcggacaattatctttcacacccaactttctctacttatcgacgggcactgacattgccagaaaacacccactagaacttcagcaatcaacggcccgtcttccctgcacccgac

SEQ ID NO: 559724 - DNA, 105 bp, Homo sapiens
atggtcggtgaagagaccccattctataccaacacctattctgatttttctggtcaccctgaagtttatattcttatcctacctggccatgggtacctgagctcg

SEQ ID NO: 559725 - DNA, 1209 bp, Homo sapiens
gtacgcctcgcgtttaggcagggcaccacgaaaatttgtgtgccccacagaaactcgttctggtgccctgtctgtttcgtcgtagaggaccaggaaacattctgcgagagattactcttatagggggttcctcatataatctcttcaataagagagatattgtgttccaacacacattgtgtttgggaataatgaataaattggttcataccgctaaataattggggggaacttttcgccccgtgtgtgtgtttagaaatgaagactttctttgttaaaacgggaaatttccttgtggcttccttttcataaaggggggtgtcgcccttggggcagccacaacaccgagtgggcggcccaagatgttgacgttgccgctccccgctcgtgtttgtaaaaccccctcctttgggtggggtgttattttgtaacacacaaggatttttaatttgagtacatggaagaagcgtgtttatgagtgctcaccaggaagcttggggaggacccccactgtgcgttgagtgcccacgctctttggtgaacccccttggcgcttagtgcacacgcctcgctcttgtaaccaacccctgcttcccgtcacgcacgagtagccctctatgatctcgcctcgtttctcacggatctcacggacaccctgggtccacctggcgcacaagttgccacgcgcccccttgtggccacagggggctccccacattcgcacgccccctgtgtgcctgcacacagggagaggggggtcccccatggagagttcttcgcgtttttggctgtcacatacacacaggagagacagagtgtggaatatggcttgtccacaggcactctgcgttgatatataccctcgctgataaagagggaggggagagttcacctcccacggaaatatagaccacaaacggaagaaggaggagggccactacacaccttctggccttcttccacttcgatacaacacttcctcgtgtcttctggtgttaaaccactagatgcactggaggctaccacacacgccacttcttaggtccccgcagggtgcccacgcactcaccgtaaaaccactcgaataatgctaaagaacgaacccaaaagagcgccccattctctgattgttattgaggctcctgcactgaaactctggacctgcctgcctcagacttctgtgaaagaataaaatttctttttgcccta

SEQ ID NO: 559726 - DNA, 116 bp, Homo sapiens
ctgtgaaactgtgtcggttatctctgtctttgaggatggctgtcctgttgctggttaacattcaccttcctctttgaggagtatttttccattatgtattcataataatgttaatt

SEQ ID NO: 559727 - DNA, 308 bp, Homo sapiens
  misc_feature (33)..(33): n is a, c, g, or t
gccaatgtgtgctatgaccccttctgaacctcncaagatcacagtctttgaagtaagactaaggactggtccttttctaggtgacacaagtaaagtaatagctagaacagaagaaaaaggggtccccaaaaatgtaatcttaaaatttgatgcctgtgctgctattaatagtaaacagcatgggataagatgcagttctctagattggaaaaaaagttacacagcagaaaataagtacatctgtcaaaaatcatatttatgcgaagatgtgtcaagtactggtacttgtgtcattagaagctacttaa

SEQ ID NO: 559728 - DNA, 165 bp, Homo sapiens
agcagcaacctggtataccagcgaaactccttggtgcctgcgctgtgtgtgtagtatgtgcgcggtgtgatcagtgcgctgtgtgtgtgtgaggtgcacgctgcgctgatcatatgctgtgtgagttaggtgcgcgccgcttgatcggccgcattctgttaaggt

SEQ ID NO: 559729 - DNA, 440 bp, Homo sapiens
cccagggactccatgaaggttcaaggccccaggacctctgctccctaatctgccctgagaagctcagagtctgggggcagaacacatgaactgaaggaaggagggcagaggcagtgactgtccacttggtgagcttgtacaagtccacccacctgttctaactcaagaagggaccactggttcgagagagtattgagccaggcctgggagctcagtgcctgctttctgcctagaagccctcctcctgtcccttccagcattcatgctatgtgtctggccagagggccccagcccagcttctgccctctctctgaatgaagatctaccaaaacagtataactgaccaaggtttctttccaaagggtcagtgttaaggcaaagctcttagaacagcccctcacacacagtaaatgctcaataaatgttggccttttaaaaaa

SEQ ID NO: 559730 - DNA, 159 bp, Homo sapiens
atactgggccaacttaaagctgtggttcaagcagaagatcagcaaggaagagttcgaccttgaagcccacaggctcctcactcaggacaatgtccattctcacaatgatttcctgctggccatcctcacacgttgtcagattttcggtttctacaccag

SEQ ID NO: 559731 - DNA, 149 bp, Homo sapiens
tccacgagaagatcgagcagacctccaccaatgtactctggtacggctccgtggacgagtaggaagctgcgcgagctgacgcagcgctacctggaccctgagcgcgcgcctgagagaagctgggctacagccgctgtagtcacgatcgg

SEQ ID NO: 559732 - DNA, 1079 bp, Homo sapiens
taatcgcaatggcattcctaatgcttaccgaacgaagaattctaggctatatacagcttacgctaaggccccaacgttgtaagcccctacgggctactacaactccttcgctgacgccataaaactcttcaccagaagagcccctaaaaaccgccacatctaccatcaccctctacatccaccgccgcgacctttagctctctaccaatcgctcttctgacatatggaacccctccctccaccagatatcctaaccctccctggatcaaccatcaacataaagtccctccttattattttcgtgagccgaacttcttaaccgttggccgaaatgtggtcaaaggcttctgaattcgagaggatgcaccgatcacagaggttggtaaatgacgacactgtatcggaggtgaaagaggcatgtggagatgctacaataagatctcaatatgaatgatgactcatcagggcactattagtaacttactgaataccacaagatgaacttatctaaagatgagaataccctcttaatcctactcgcgtacgcggtatgaacaaaacttcacgtaataaactcctgaataagtgcctgccagtgcatgaccattcctccaattgtatgattttaactccgaagactagcagaggagcattggaaatcgccctttcgaactagggagaatggggagttccgaaatgtatcttgcgaagcttcggacaatgggttccgccggaggtcccctttgctacaatttttcatggccgaatagggaacattctttaatgtcctgctcactctacatcttcgtaagaccaaggattttgggcattttcccgtaatcggcgaaattttagtggcagactactgttagctccggttattaatcgaagagaaaccgaaatccaaacaagtctacccccattgaagaattctacccccgcaggcatatgtatgtatacaaccaaatgacaagacccacgacggaagtacagacgacacaaccataagacacctaaaaaaacaagggcacaccggcacagacaacagaaaaggagacagacgtaccaatatcatcact

SEQ ID NO: 559733 - DNA, 763 bp, Homo sapiens
tgatgtatctggacaaaggttagtgaagctcatcacagcgaaccaggtctctcaaaagaaaggacagatagaccaccctcatcaatgaaaggaagttctcaaacacatccttggaacttactatgtttcccagttttagttttgtgtttcgttatcagttttcggtcattttctgtcacaccagcaggcactcatccctcagtctgccatgtcaacttttcatgcatcagttcattcccaacattccaagcaagcaagcagtaattaacatccaattgcatcggacacaaagttacatcttatataaatattaaattcgatctatttccacaatgctagatcgtactatcaggtcatatccgcactataaacgcatgttgcacaaggtgatataactgcatatgcatactaacaggtgaatgtagttgagacaaacgtggcatgggctttacacagcaagggaaaagtgcctctaaacacgacgtatgtaaaaaaagcatttaaaaaccaagagttcattaacaaacaaccagctatcgcgcctgccatttatctactaaactcatcaacacacatgcccacgccaccattcaacctaattctctacaaacactcgcggcgcgaaccctatccgacagcttatccagagggtccctccggatactccaactggttcgccataagtgccacttagggacaaacttacgtttttcgacacgctgggacctggtcgcacaccacccccaaagtccacggccacgta

SEQ ID NO: 559734 - DNA, 147 bp, Homo sapiens
tgaaggtccactcaggagccatggacggcaggccggaaggggtctggatggaggccagggctgctgctcaaaatggccaggacagaagcgaggagtcctgaactggagatgaacagcgttagagctaccttctagagcctcattgac

SEQ ID NO: 559735 - DNA, 1598 bp, Homo sapiens
  misc_feature (248)..(248): n is a, c, g, or t
  misc_feature (351)..(351): n is a, c, g, or t
  misc_feature (698)..(698): n is a, c, g, or t
cttgatctgtaatagctagaatgagaccttatctgcaagggcatttgaggcgcaaactacaagtaatacgagcagtagttatcagaattgggatgatccatgagcagctaaggtcaatactagttagatcacctcgtacacggtgcatgacgagtggagcccatccatatcctccataggactgtatattctagtgccaaagtgatgtcatagctctcaatacgcgtatcactcgccagtgacagttnatgattcacacaatcatcataacttcaccttctgggaataggcaagacgaccgaagccgcgtataggaaacctcacccgagagagcacagaagcgcgatgcantagctcgtataggacacgatgcgtaatcaaagggaggctactagacctgattctaactgatcacgctgccacttagtggaagtggatccagactttgagtcataggatacagattggacagacacatagcctcgaatcgcggaagcgctggggttttatttacagctctggtgtgagtcacacaagaattaggatattcctcttacgatgtccaccccgttatcccaacttgtctttgctgccacgaccggacgttatggcgccctttccttaaaaagtaagcgcgcgtgtgaatagacatagtgttgagacctgggttctgaagtatcccaaacacaggcagaggnataccaaagggtcgtgtcaggtccaccgaagctatagagcagaaaggattataccattgtgagttgagaagaggatggaagggttaaaaacccatgggctgtggtacatcggatcactccgaattagacttaagggccccccgttacaaattggggccagtgcgtgaaacccctaaattgttaagagagaacacatgggcgtggtctctgaagaggcccatgccgaaactacacagccccaatgcggtaatcccattacccgatgaaaaactttttccccaacaatttaacaaattatcacacaaaaagcaggacaaagttgcacacgaggagggccgccactgggagtattggcggaggaccattttaaaaccaaaagtggggttggtgccgaggagcccgtgtcatcttggcacaccccacgaaagttgtaacatcttggcaccgcgggtgaggagccgttcgcgaaggaggcggttacacgacagaaaagagccctatacattgttggtgtgggtcaccatggggccaacaattggtaccccagtgtgggagaacccacgaaaagacgcccatttcctccggcttggtttaccaaaagcgtcgggggatcccgcctttaggtacatgtgggtttccaagacgcagaagttacggtcccaacagggggggaattttggcccccgaaatgagaaactttacaattggaggggggagcgattgtgggcggagaaggcaacaccacagggggggactattggtttgcgcgttgtaacgagacattccttatattgaggacgcagttgtaacattggggttggacacacacatgggggagggaacagtgtgaggcaggaatttgtggggcgtggaaaaaacacaggcagctcatcatagggg

SEQ ID NO: 559736 - DNA, 373 bp, Homo sapiens
atttagtttttttttttaaaaaataatgccccccgaaaggggtcctttatgaaaacccatctgaagtcttttcataaaaaaaattaataaactttagttggccctttagcccgggttttttgaaggatggaccttttaaaaaattaagggtcttggatgattaaaaaatgggaaagaggaaccttttttgtatcaggaaagttttggggctgggttttccccccaacccctggcttaacaaaaactgctgggtaaaacatggactaaaaattcccggtattgggcaaaacaaattgttccttttatatttggggggaaaccggccattcatgttttaatgtaaaaaaaaacccttttcccgtttgttttttta

SEQ ID NO: 559737 - DNA, 410 bp, Homo sapiens
ctcgtacccctttaccctataatggctatgcttagagatttcacatacactcggagggaactgctggtagaccaacttatttagagcgaattggacatggatcagaaccccagtgggagaaagttcataggcgattagattaataatttaatagaggatgagtgacctctgatttactgctagaatgaacttgtcaatgatggatgggcaatcttcatggaagttatacaagtgatgactgaagaccctagcttttacacctgtcagtagacctgctactaccactgaacctcattgtccctacccctgcttgtaactctattgctggattctgttcactgtatataagtgtgtatgtgctaagattgcatcgctgtgacaattggtcccctagagatttagtggttggc

SEQ ID NO: 559738 - DNA, 219 bp, Homo sapiens
gccaaccttctatcagagttaaacttttgacaagggggccaatctccaactgatccatcagtcatgtaagctagctgtagagctttcaacttaatagcagcaactgcccaatgccatgtgaagtaaccaactggtttttggtttttttttccccctcagtgggtaatgttatgtgtaatgtaattaaacccttatttaaatgaaacttgttttcagaaa

SEQ ID NO: 559739 - DNA, 779 bp, Homo sapiens
gaacaggaagtcacttgggctgtgcagataggggccaaggtgaacgaacacgtgtagaggaggaagagttcaacctcaagttaaactggtaatgagcttgatcttcgtatcattagaagaaccccagagatagcatgcctctattggattttactttcttgggatgcactgatgtgtcgtgggaagtgacactttatctggcaaagtaactgagagttgggtaaaggaatattttcttctctgaataataattattttcacaggtgaaaatttcgagtagtttatatcactaatgtatgagcaagatctatatcgaatttcaaggcgacgtgaaaaaaattgtgagtatgtgcaatttaatatagaaagatttctgcctgttgggacaagaggtttggggtagtacagattaggataagtaagcttatatatgcacagagattattgtattagctgtaaattgatttacaagtacttaaaagcgtggtccccagtgaggcaagaaagtttccggttaagttctttaataataatcctacagttgatcttaagacagaagagaaaaaggttggggataaaacactttaagtgaaggggtccgaggtcgagggtggaaaaaggatgtcaggcaaatatttcagatatttgcaaaaacgcaggtaataggttacttattaaatagtgatatgggttactattaagggtccgataattagttgacctggggtaaaataaagtgttcgctagtaaatttagcatatttgcatttggttatcggc

SEQ ID NO: 559740 - DNA, 398 bp, Homo sapiens
aacaggagtccgcgccggcaaagtcccacgctgaggcatcacatccgtggaccatgccaccggaggacaaagagccctctgacggggagggcatgggctgccgcatggcactgtagctacctccagagaataccctctataatgcgctagccattctgtgcggataacctatgcagacaagccaatgttagcactcatggagcggcctggctcagtgcgggactttggtgatagatggaatactgactgagccactgaatacttgtccgattattcctgaggcccgaggtttcagtggacagagcgcagagacggtgaatattcagggtttatggcatccggagagggacatttttcagcagaattaaacagtcatgtgatagatgtgttcaaagttg

SEQ ID NO: 559741 - DNA, 408 bp, Homo sapiens
taaaaccaagtctttgcaacatattgaaaaatttaatattccacagtagaatatgtaagaaaaaaacccctctatttgtaattaatgacacataaatttaagaacataattaaaattacactaaatatctttctatccacatagacatagataaatatctatccggtataacagatctatataatatatatcacataatagacctatatatctagatagatagatttatatcacaaattcaccgttgatgacctggaatacctgagcttttagttgttggttttccagacagtgcaaaaatcatttgtcatcctctttgtaaagggcacagccaaatcccagaaaaaaaaaataactttgggttgatggatgctgtctctcaaagatcaaacaggagtcttcccacgg

SEQ ID NO: 559742 - DNA, 118 bp, Homo sapiens
cagaagtgaatgcagctttcttcttcatgcacactcattgtcactctggatacttcatccttattagataagagtgctgcagagctcgaaggcagagattcgcttgtgtgggttaaaa

SEQ ID NO: 559743 - DNA, 365 bp, Homo sapiens
  misc_feature (201)..(201): n is a, c, g, or t
tttgtttccttttgggtttttttttttgtttaaagggtttttttttgcagggttttgtaaccggaaaatttccgttccgctcccaaggggtccagggtaaattccccttccccctggggaaaagcacaacctttttttggggggtttaagggggtttttttttttcaagtgttttggttttttggttttttttttttcccnggccctttttcccctttatttggaggggaaggggagaaagtgggaacagggaggggggagggggattttttttttttttttagttcttttccaggggggggaattttttttaaaatgggttataaaaaaagttgttttttaaaaaaaaaattttttggccttta

SEQ ID NO: 559744 - DNA, 953 bp, Homo sapiens
tgcgtacccgcgtgtgtgcgcctaatctcaggtggtccacccgatgatcccgttgagcaccaaccgctatgtcgccctcgcgcggcccttattcgctcgcgacaagatgatagaaagaatcatgaaccaggaaaaactcgccaaactgcaggcacaaggtgcgcattggtgggaaagggaactgcttgcgcaagaacgtaagaaaggtggtgtcataggaacacgccacagcagatgacagaaaagcttcatggtctccttatcagaaggtaaggggtaacacgaatatctgctggtagttgaacgatggtgaactctgtttacaagaccaaaggaacggggatccactattctcaaccctaaggtacaggcatgctctgtgggagcgaaacgactttcaccattacaggccatgctgagacaaagcagctgacagaaatgctacccagcatgttaaaccagctgggatgcggagtagtcatgacgtacgtgttcccggagactggtcgagagctctgaccatacaatctgtggtggaaaaagacactagctacgtggagaggatgatggtgatgaaattgccagatctgtgaggaattgggggagggtccaggaatgagggcactggattggtcagtctcgaagataaactgaagacgtggggagcggatcttttatgacggcttgagaacattgtgtggttcgaagcacgattggtatttaagccagacatgaacgaacattcggtaggtacacacactgcgatacgcgaccggaacgcgacagaaccttcgtccaaaagcacagcgcgtcaatcgccgttcgcctccctcgccctccccctcccttctcccgcctccctcctcctcacacgcaagaaaacacagaaagagacaacaaccgagacgacaacagcaaaacagaagacacacggcagaaaacagaagacatac

SEQ ID NO: 559745 - DNA, 356 bp, Homo sapiens
aacatgctacttctctccatttatttaggggttctttaaccctttttcccatttgtcctgagaatactcaccggcagtgcttacagctgcagcgtttaccccgagataactttgccacgaaatatctcgcttttatgattattttcacatcgctctagtatatcgactttagaaacaaaagacatcattctatttatagcattctgtctttagtagtggtatttccatttacaaaacatagtaattctcgatcgctgaaaatgtcaaatcctggaaaatgtagtattcctacacgtgatgttaacatcgttctcaacagttagccgaagattcattcgatgagtccgatttttctg

SEQ ID NO: 559746 - DNA, 425 bp, Homo sapiens
atatcacctcgcattgccgaggagatctgctgaccgacgtacgccttcgtggcgtcggtataggccataggctcaccgatcttggcggacttcatctcgccggcaagggcctcggcggccttcttcatctgcggatcggagatgacggaggtaaaggagtctgtgttctcgttggcttccttagttcccggcaggaagccctgggcaagcttgacgaagtcaacctggttggcgttattggtgacatattgggcgaatgctagggccagattagggttcttcgagtctgcggagacgcagatgccctgcacaaacaggggaggaacgccgatgcgtgtggtcatggcgacgtgggggaggagcttcggtgcgctcttcttgaggtcgacgcggccgcgaatttagtagtagtagtaggcggccgc

SEQ ID NO: 559747 - DNA, 786 bp, Homo sapiens
ggaaacatcagtgttttgaagctttggccccaaaaccaggagcagagaaaaaaacagatgtttcttattacgtcccagccatgaataccaagagagaggaacactggggccatttcagaaactgcttaccacaggccccatgtgggctcaggggagagaggccctggcctggaggaggaagagtgaacggggagtgtgagtgacattaagtgtttgctaacgtgagactagctggaccctctctcttctagtggtccctgaatcagagccttagcactacatattggagtctggattgcctgtttcaggaatctggtctctcaacaatcattagatttctgaatgaagatttagcataaacaccctgtatatgataaaacaaaattttaaagattatatttaatttgtttcgaggccttcacgaaaaatttaaagaaattataccaccacaacccatattgacatctactgacccctggaaaccagtagaggaatatgttaggaacaaaatattctgccaggggacccatctgatgttggcctgaccacctgagcgcaggcactggtcccactcattaacagatctaagaaacatgaggtaccagccctactacccaaagacctgagtgctataggctcagacaaaaaggcaaagttctagctaagaaaatattaagaacattgcctggcgcggtggctcaggcctgtaatcccagcacttagggaggccgaggtgggcggatcacgaggtcaggaaatcgagaccaactaacacggtgaaacctg

SEQ ID NO: 559748 - DNA, 169 bp, Homo sapiens
tcacaagcctacctaaacaagccttgaacagccagcacgaggactgaagcagcttaagtcactatcatctgggatctcctgtttcagcagtcttagtctgtatcctcttcaatacagtgtatctaagaaagttaaaaacctgtgctttactctccataggctatgaatc

SEQ ID NO: 559749 - DNA, 562 bp, Homo sapiens
attctaggggcgttgggtattggagttatggagaggaggtttatatagataattgtggtgatgaaattgatggccctaagatagaggagacaccgtgcatagggtgtaaggagaagatggttaggatctacggaggagtgggggaagtgactagattccccataataagtcggtgaccacgggtatggcgctaacaccacgacaatacaaacgaaacagtaaagacatacacatgaacactcacgtaaccataccacagcatccccactaactccaggccctcgaaaataggggaacactcaaagaaacgagaacgagacagcgaaagaaaaccaaaggcgcaaggacaacgcgactcccacccccggggcccgaacaccacgcacgcggcacgcgagcacatccccacgcccccgacaaagccgacggccgcctccccgacgccaacccacccacaaccgggcaccagaacacaccacatcaacacgcgggtgacccgcaccgcagagccgcaacataccccgcgcacaaagcacccccacacgccgcgcacgcccaaaca

SEQ ID NO: 559750 - DNA, 256 bp, Homo sapiens
cgcagttagcttcattctcttgtcccttcgtcacaggtagcaatttgcagcagatagaaagcgagctggattactccggtctgaactcagatcacgtaggactttaatcgttgaacaaacgaacctttcatagcggctgcaccatcgggatgtcctgatccaccatcgagatcgtcaaaccctaattgttgcatatggactctagcaataggcattgcgctgttctccctagggtaacttgttcaacgattaaagt

SEQ ID NO: 559751 - DNA, 220 bp, Homo sapiens
ccgcgattgactgagcccaggaaatcagctgcagtgggccgagattgagccactgcacttcagcgtgggcacaacagaagtgagaacttgtctcaagaaaaaaaaaaaaaaaaaattggaaaaaacacgggaaattctaattcctctattttccggcgggggcgggttaaaaaaccgggttttgcaccaattttttataggcaattttgggaggtatact

SEQ ID NO: 559752 - DNA, 285 bp, Homo sapiens
cccgttatttacctttccagggggcaaaacgacagaggtgtggacccatccgatatatagttagttttaacaactcttgcaaaactgtgtcatcagctgttatagatatctctccctttgccctgtattgttgaacactttatttttcttgggaacggaatcttgctctgtcgcccaagcatggagtgcggtggcttaatctaagctcagtgcaaactctgcctcccgggttcaatcaattctcctgcctacagactccatgagcagctgggacctacaggcgca

SEQ ID NO: 559753 - DNA, 185 bp, Homo sapiens
ctttaatcaaaacactcaatattaaaatgttaattctcagtcaggcgcgggggctcacacccgtaatctcagcactttgggaggctgaggtaggaagatcacgagcccgggaggttgatgctacagtgaaccatgattgtaccactgcactcaggctgggtgacagagcaaggctttatcttaaa

SEQ ID NO: 559754 - DNA, 157 bp, Homo sapiens
acctctaaactgacgcgatacaaatgatagccatacacaacactttttgacgaacctgatctctcatactcagatcgggaattatttttattgccacaactcccctgctgggactcctgcctcactcatttacaccaaccacccaactatctataaa

SEQ ID NO: 559755 - DNA, 227 bp, Homo sapiens
ctcatgagtacagttggactttggggtgccagagatggaaacgcagagcctgcaggtggcacatccctctgccttctgggtcttggcacctcatcctcgtggatggtggtgatgcagcccgagggccgaaagctggtggacccctccaggagcaggaactcccccttgctctgaagctctgcgtccagctgctcacaggggtcatcgtcgaggtcagtgacagctgg

SEQ ID NO: 559756 - DNA, 1549 bp, Homo sapiens
  misc_feature (233)..(233): n is a, c, g, or t
  misc_feature (408)..(408): n is a, c, g, or t
  misc_feature (520)..(520): n is a, c, g, or t
  misc_feature (637)..(637): n is a, c, g, or t
  misc_feature (1549)..(1549): n is a, c, g, or t
aacctttactgtatataagaaattctcaaacacagatccaaatgatcacctctgcattagtatgcacgcattgctggaaggatgctaattcattgagtgaactaacaagggaagttgctcgtcatgatatccaagcaattagatagaacagggtgatagtgccagtagatgaccgacgttactataacatcagtacatacgacatgcgcagctaagctggaaatgacaatagncacgtagggcactctccagtagattacgaaatcccgagacataacggtgactgactgatgttcaccatgggcgacgactgctcggcactaccacaagagatggcaccatacataacatattacgcactcattcggctgtatttcacatgtacacatccattgcgcattactgaanctccgtgcgccacggttacacagcggcaatctgcaacacgtggcaaaatctttcaccgagagagttctacccggcgcgcgagcgccagagttcgcgccaatgcttcacatangatgcgcatacgcattcgcgtagcatatggacaccttgctacgaggtaaatgcggtacgtactgtgtgcacgtaactggagaaacgtgccatccccttatttgcgaaaggcggagancttctatccaggttacgcatcctacgaatgaaaatcgcctttattccattacaattaggtccctcttatacgaaaaatctcccgttatttccaactaggaataccctcattgcctttccaagtcgcactaagatcttacaatcaagcctacatggccaaaacggcctaaaagtcgcaaccggtggcttttcaacagccaacaaggcaagtcaaattgtaggagttcttcaaactctgtggctgaattaatacgaacggtccgtggctcgatttgggtccacacccttatccgccatggttccggcgttcgagtgtccaaaggtctccaaccccatgtacattcctctgtacagtggtgaccccgtggcaccgttgcaagacttgtaccactgaagaaatgcaagcttggttggcacagtgaggtggacatcccccactcccctcaattcattgatggaagagggaaaaacacattacaaacaaggttgcccggaggaaggtgccaagcggtggcgcaaacttccaaacacaaggtatttttccacacagggtgttttttaactaacaagggattacaaaatgcttcgacgtgaagaaaaaaaacggcatctccacctacgaatgggttgcgacttacatggcgtaatggcaaccacatatgggccatggcacgtgccctaagtacaccgtaacggacttccaccaggaaacacagttccaactctaagcagcgagagaagttcccgcgtccatttcaccgacaggaaagccgcaaggtgagaacaccaacagggacacattatcacctgcgcgtgcgcgcagaacggggacaaagagagagaaccttcggagacgggtacaaacaacaaggggcacccggcgatggataaacgtgcaaggggtgcacacaan

SEQ ID NO: 559757 - DNA, 148 bp, Homo sapiens
gtgtgaggtgattagaggatcccgatttttaattgcttatcactgacgaatagctacgtttggggtccagtttcctaaaacgtagctattcgtcagtgataagcaattaaaaatctcaagatccagtgtggatccagtgtggagagag

SEQ ID NO: 559758 - DNA, 207 bp, Homo sapiens
gtcacagctgcccaacttcaagcacagttgttatgcagatgtcagtttaagatatcagcctgtctgactacaaggaatatgttgtgtcttcttttaaccctcttgacttcacctttggttgttgccccacggaggatcattgctatcaagtgataggggcagaaagacttttaagaaaactcaacgtgccagttgatttgtgtgctt

SEQ ID NO: 559759 - DNA, 126 bp, Homo sapiens
atcgagctcggtacctgccagaagttgcgcgcgctcttcatctagctgccaatacatgtcgcggatagcgacggaggtcgcgggagcctcttgcgcgacctggccgaggcggcgcccgcgggcgta

SEQ ID NO: 559760 - DNA, 619 bp, Homo sapiens
  misc_feature (7)..(7): n is a, c, g, or t
  misc_feature (32)..(32): n is a, c, g, or t
  misc_feature (38)..(38): n is a, c, g, or t
  misc_feature (45)..(46): n is a, c, g, or t
  misc_feature (52)..(52): n is a, c, g, or t
  misc_feature (56)..(56): n is a, c, g, or t
  misc_feature (58)..(58): n is a, c, g, or t
  misc_feature (66)..(66): n is a, c, g, or t
  misc_feature (69)..(69): n is a, c, g, or t
  misc_feature (74)..(74): n is a, c, g, or t
  misc_feature (79)..(79): n is a, c, g, or t
  misc_feature (95)..(95): n is a, c, g, or t
  misc_feature (97)..(97): n is a, c, g, or t
  misc_feature (110)..(110): n is a, c, g, or t
  misc_feature (113)..(113): n is a, c, g, or t
  misc_feature (116)..(117): n is a, c, g, or t
  misc_feature (119)..(119): n is a, c, g, or t
  misc_feature (131)..(131): n is a, c, g, or t
  misc_feature (136)..(136): n is a, c, g, or t
  misc_feature (152)..(152): n is a, c, g, or t
  misc_feature (169)..(169): n is a, c, g, or t
  misc_feature (174)..(174): n is a, c, g, or t
  misc_feature (176)..(177): n is a, c, g, or t
  misc_feature (195)..(195): n is a, c, g, or t
  misc_feature (202)..(202): n is a, c, g, or t
  misc_feature (210)..(210): n is a, c, g, or t
  misc_feature (213)..(213): n is a, c, g, or t
  misc_feature (217)..(217): n is a, c, g, or t
  misc_feature (223)..(223): n is a, c, g, or t
  misc_feature (225)..(225): n is a, c, g, or t
  misc_feature (231)..(231): n is a, c, g, or t
  misc_feature (239)..(239): n is a, c, g, or t
  misc_feature (255)..(255): n is a, c, g, or t
  misc_feature (273)..(273): n is a, c, g, or t
  misc_feature (276)..(276): n is a, c, g, or t
  misc_feature (295)..(296): n is a, c, g, or t
  misc_feature (299)..(299): n is a, c, g, or t
  misc_feature (303)..(303): n is a, c, g, or t
  misc_feature (305)..(305): n is a, c, g, or t
  misc_feature (310)..(310): n is a, c, g, or t
  misc_feature (313)..(313): n is a, c, g, or t
  misc_feature (322)..(322): n is a, c, g, or t
  misc_feature (328)..(328): n is a, c, g, or t
  misc_feature (334)..(334): n is a, c, g, or t
  misc_feature (421)..(421): n is a, c, g, or t
  misc_feature (475)..(475): n is a, c, g, or t
  misc_feature (544)..(544): n is a, c, g, or t
  misc_feature (612)..(612): n is a, c, g, or t
ggcggangcgtcccgcagccggctggtccctntcgctnttccttnnctcgtnccantncacccgcncgntgcgnagtcnctatggcggttaccgncntggagcgcttttngantgnngnttcagagccccngagtnttttcttggtcggttntttgggttttgatagcntcccngnncagtttgtcagcaagttngttactnagggcttnagntttnacattntntttttnggggagancggcattggcaaattnacactgatgaatacactnttnaacattacttttgagattnnggnagcnanttacnatnatgtatgtntgctcntttttntccagatctatgacttccatgagagtaacgtgcagctcaagctgaccattgtggatgccgtgggctttttggatcatattaataatnatgagagttacatgtccatagttgactacatctatgtgcagtttgaaaattatnttcaggaggagcttaatattcgccgctcgtctcttcgattactatgacacataggatcctacgtttgtntctacttcatcacgcccacagggcactccctttagtctctatatctagtgaccatgaagaaactaganagcaagg

SEQ ID NO: 559761 - DNA, 1707 bp, Homo sapiens
  misc_feature (1099)..(1099): n is a, c, g, or t
  misc_feature (1704)..(1704): n is a, c, g, or t
  misc_feature (1707)..(1707): n is a, c, g, or t
tctctttgggagatttaaatggaagcaatccaaatttttttaaactctcttttttaagcaccaaattttaaattatctctataagttcaatttgtgggggaaaaaaacaccactcaaaacttttcccctccagcaaaacaagcgagtgttcactctcctgctccaaattatctccaaattgtgaaaactcataccaaaaacaaaaaacaaaaaacaaagagcccacaacgagaagaaaaataaagagagagaaccaaacatctcacattctcatagaggggggggggtctcagggccattttagccagctctcgcgcgcgtggggcgtgtcttatacccatctccttctcaggcgtgatccttatcacaaaagaatacaaaaacaccagcctctaaagagctctcgcttatcacaaaatataaatgaccatatgtttcaccatgtgggcgcttctgtctcaacaatagttcacaaaatatctatatctctatgtcacacaaagagcggggcaaacatatctttaaagagagaatatttcacacacaagccacaaatgtgcgccgctgaaaagcacaacactataacagaggacagtggcaacagtgtagtcacaacacacgcatatataggggagcaggtcgtcacgacgcagaccacggcgccaaaatctgcgagccaccacaccacactctgtggtgcgcactaccaacgggaggggaacacaacggagcatccctcaccaagggaggggtaaaaaaagacatatctaactaccaccaaaaaacagcggtgtgcaaaaaatatcaccccgacaaaaattgtgcacaacggtgcttacttagcaaggggggccacaccaacagcacggagaaccctccccttagtagaggaaaaaaatgtctccccagacagcggcgcaaaccaaaaactaacgcaggggagcgcggccccccacaaagagggggtccttactacaaaatacggacagcggcgaccacaacggaggcggcccacatcctgcgtagaccagacgacttttgaacgacgacacacgggattacccgcccggtggtgggtgtagcaaacaaacgaatgttntccacccccaactcaccccgttgggttcgaccaaacaccaacactactttacaatgatggaggaggacggggctctcacagacaatactacgaccgctttggagaaacaaacccgccaatgtagtgcgagacaccctactcttgggggacacacacgtggcagacatatggcgacaccaccgcgcgtccaactaccgtagaaatgacaacaattacgcaacaaaacttccgccgccactatcgtgggggggaaccccctaacagacagcggggcaaacacgcctcatatataaacccgtgtaaatgaacagcactctcttatcaaagtggcgtcagagcatagccgccacagttatttacggtagtgtatgtatattcactgcccataaaacacacgtgggtgcacagtccccacagacgcaccttgcgcgaattgtgatcatctacacacggcgcgcgccaccccaccagaagcattctgccgcgagcatatcacgcgccgtagctatatgcaggcgatcactagcgcgcacgctacgatgatacgtatcatgacgcaccaatcgtgttatatgtttctcttttattcgtagtccgttgggggnggn

SEQ ID NO: 559762 - DNA, 439 bp, Homo sapiens
caggagaaaaatgcagatgtatacagatcactaattacattaaatggaaagagtgtaaatactacaattattagcagagaaggtcagactagactttaaaaaggcaagagctcctaagctacaagagatgataaagacaggttaaaaagaaaggttgggaagccatattccatgtacacactaatgaaaaaaggctaggtggctctcagtataagacaaagtttgcttcacaacaaggattagtaacaacaaagagggggatgctgatgctgatgatgatggtggtggcattaattcaacaattagaaataacagtgctaaatggtaaataacaacagagctcaaaatacctaaagtagaaattgaaataaatataccaatccatagttacatttagaagtttcggccgggcgcggtggctcaagccttaacccaagca

SEQ ID NO: 559763 - DNA, 244 bp, Homo sapiens
attatagaagtgcatagtgtggcccggcacaatggctcacggctataatcccagcactttgggaggccaaggcaggcgaatcactcgaagtcaggagttcaagaccagcctggcctcaagtgcctacctcggcctcccacagtgctgggattacaggcgcgagccaccatgcccggatacgctatataatatctattaacctcctaaagagggtcttcttaatggtaagttggggaaattttgc

SEQ ID NO: 559764 - DNA, 245 bp, Homo sapiens
ctgtacaatgctgcctccatgatacttccaagtggtgagactccatgagggagctgcctctaccgtataatgctgcctccatggtacttccaagtggtgagaccccatgagggagacgcctctactgtacaatgctgcctccatgatacttccaagtggtgagaccccatgagggagccacctctaccatacaatgctgcctccatgataattccaagtgctgagactccatgagggagccgcct

SEQ ID NO: 559765 - DNA, 192 bp, Homo sapiens
agacgtgagaccgtctcaaaaaaaacgaggtggactatgaggatggaacatcttcagtattacgtatctggcatatctatttagccttagtctactcggaaaaatccttattttccacaccataaaactatgtcatatacgcggggggaacggagttaacctcacaactctcaaagggatcgaagaaaaata

SEQ ID NO: 559766 - DNA, 143 bp, Homo sapiens
cgggatcggcccacacagcggaccgcccgcccgcccgcgcgcccaatggatcccggcacgcggaggacgcgggctaactgggacgccgacgctcgccccagggccccgcgcgctcctcccaccccctgggcgcatggcggccg

SEQ ID NO: 559767 - DNA, 282 bp, Homo sapiens
cggttatctcttgaatgaccatacaggtatcccaactttctgtttttaagagcctgggtgacagaacgagaccctgtctcaaaacaaaaaaagaaataacagaaaatctgaattgcttcaataatcccaaactttttgcttttcattgtgacatctcaagggaactgctcacgggcggcacttcagattttcagattatgggattacctcagctattgttacgttatattgcaaatttttgcaaaattctgaaattctgaaaccacctgctggttcccacag

SEQ ID NO: 559768 - DNA, 786 bp, Homo sapiens
  misc_feature (768)..(768): n is a, c, g, or t
gccatcatggctcctcccactaccttcgtccagaactcgtcatccagtacagcacatacctttcagctgggaagcatacgaagtccctctttaacatttttccatgtgccgtcctcattcccaggcttctctgtgcaatatatgacgtcatgtgttctggctccatcccacatgcctgatactccacctggcttacatctcgagcatcggtcagatgataagacttctcccttagttaaggactttcctcactgaacgttcagctctgtacattctcttgatttcacttgacagttgcaaaagataccatttaggatattgagttcttgcagaaggtaaaatataacaacgattgtacaggaaattcgaatacttgaacttaagtaggagtaatggattacgtgcagaagatagtactgtggttatctagtttaatcatatgatgtaacataatttatagagtagatataggaggtaagcataagttgcaaaggagcttcatctcttttatatgaagactgatctcgttaaataatcaaggactcgaaaaaagtcagcacaaagctactggaaaattattctgatgagattctgaagtgtttatctgtctaagaagattactcagaaggtaaagaacaatattttacaagctcttactaagagaatacactaatccaagaaaacttattttgaactagagaatcaaacaaagttctagttttgcatcgtgcatatgtgatactaatgctgatattaaccggggggggnaatcaattatcactcatt

SEQ ID NO: 559769 - DNA, 449 bp, Homo sapiens
tgtccacagacagcgctgacaacgctgcctcaccgccccacacctgcagggttctgacgaagcccccgagacaaggtggcaggagggcgagtctgggtacagaccggcatacaacagatccagaggtaggccagaagggaagcagggaagggggacctccgtggactctctttcctcctcttcttactgtctgtcccttcttttgacccgtaggagtctctctcaacaaactgaccctcaatgtcaagagtgaaaaggattacaatcgaccatggggtccccatctcagtcacaggcattgcccaggtgaagcttccacagcctttaccccacagtccacttccccatcaccctctctcccagacattaagacatcttctggccacagtcttctcaacccttgcctgcagagaagttcctctgctagtctcatctttaccaggcacccc

SEQ ID NO: 559770 - DNA, 236 bp, Homo sapiens
ttgatctacggatcctttgctttggtcaggaattcgagaccagcctatccaacaggcgaaagcccatctctattaaacaatacataacttagctgtgcatggtggtgcacacctataattccagctacttggcaaggcagtgggagaatcacttgaacccaggaggtggaggttgcagtgagccaagactactgccacttgctttcccacctgggccaccagagtgagaccttcct

SEQ ID NO: 559771 - DNA, 234 bp, Homo sapiens
catgactcgtactgacgaaggtgcatgcgctgaatgatgtcacggcagtcgttgaacacacggtgtgatgttctctaatatgagggtacgcatgtagtgacgctctacgtgggtctctcgagctcgggaatagcatcgctcaggagtagtgttagcgagcaaattctggaaaagtagtcctcaatcttcgatttccccagcaagactttctcagcgagcagatttggttgttgc

SEQ ID NO: 559772 - DNA, 1651 bp, Homo sapiens
  misc_feature (362)..(362): n is a, c, g, or t
  misc_feature (488)..(488): n is a, c, g, or t
  misc_feature (530)..(530): n is a, c, g, or t
  misc_feature (608)..(608): n is a, c, g, or t
  misc_feature (611)..(611): n is a, c, g, or t
  misc_feature (1009)..(1009): n is a, c, g, or t
  misc_feature (1034)..(1034): n is a, c, g, or t
  misc_feature (1087)..(1087): n is a, c, g, or t
acgcgtgctgtttgctgctgcccggtcacagtgcggccctggcgaggcgccgcactcctccccagcgtgtgtgtggccgcgccccatgtagtagccgcccgccggggggggctgaagtgtggcgccgcttcgctgggtgtagtttacccgcttggggccgccgggggggcgccgggttagccatccgtgtctggtcgtgcagccgcacgggcgagaccaccgacgtgttcttgcgcccgccgcgtgttggtcccgagcatgtttgtagtggggcggcgccccccctgatgttggagggcccagccggagtgtgtgtgtaccaccacgaagaagcccactgggggttgggtgagtcccgcggntgttcgcacgggggagttttgctccgccccgcgggagtgatttttctgctgtcttggagaagcgctccactaccctcgccgtttctcctcccgcgagagaaggcttggtgcgcgccgcccacactntggccaggacagttctcaacagagcgaacttgtggggggcgncacaacccacacgaggtgttgatgggaaacccgcttctctaattgggttgctctactacaaagaaaaaaaaggagagngtnttgttgtgctgccgcacaaaaaggggggggttagaaagacacgatagtagggaagtgtgtggccgccgacatagtgtgcagcaaggctgtaggccccccacatgttgcgcacaccaccacccttattggagacacatttcttagtattccgcacataatagagagagaggtggtgagagcccccaccataatataggagggcgccacgacaaccacccaacaagtggtggaggacgacacaacgcgacacagcagggtggttcgacgtgagacgcacgcgccctgtatatgttcactctaattatgcccgcccgcccatatatcttatggagagatatatgggcgcccacacacctatgggccgcagcttcgtcgcagcatctcgtgggggagatatngagagaatatatacccacgccgcanatctgtgtgatatatagtgttgtaatatacacaccacgtcgtgagaatatatntactctcccgcgcgctcactcttaaagtagagagaaaatatagagagtgatcttctgagagacacacacggctgacacacacacacagcggtgtgagagcacctctctgagagaacacacctctgtgatgcccacacactctctcacaagagaaccccactctctcgccacacaaagcgcgctctctacagagatgtgttatatgacactttggtgttctcacatgtataaaatgcgctccccacaagaagagagaaaatctctctccagagagaccgcgagaacacacacgagattatatctcttttctcctgtgcgccctcgggagagtgtgagagtatagggtggtagaagagcatctgagcctgatataatgggcgccactttctccttgttggagtgcaccaagaaaatgtttttataaaattaagaatatgtgaatgaatggcgtgccagaccctgcgcccaatataaatggagaaatgcccccgagcgtggaccacattttaaaccaaatggattttctggcccaataaattgttttccaaaaaacccttttttata

SEQ ID NO: 559773 - DNA, 766 bp, Homo sapiens
  misc_feature (659)..(659): n is a, c, g, or t
ttaaaacgccgagcgcgaggacccctaacaggggccctctcagcccttctaaagacctccggcctagccatgtgattgaacttacagtccataacgctcctgatactaggcctactaaccaacacactaaccatataccagcgatggggcgatgtcacacgtgtattcgcatacgaaggccaccacacaccagctgtccaaaaaggccttcgatacgggataatcctatttatgaccttagaagttgtcttctgcgcaggatatgtctgagcctgtgaccactccagcctagcccctaccccccaatgaggaggcgactggcccccaacaggcatcaccccgctgaatccgctagaagacccactcgtaaacacattcagattactcgcatcaagagtatcaatcacctgagctcaccatagtctaatagaaaacatccgaaaccaagtaattcaagcactgcttattacaattttactgggtctatatatgaccctcctacaagcctcagagcactttgaggctccctttaccatttgcgacggtatgtacggctcaacatttgtgtgagccacaggcttccacggacttaacgacattattggctcaactctgctcactatatgctctatacggcaactaatatttcactgtacatncaaacatcactttgggttcgcagccggcggctgatctggaattatgtagacgtgaatggaccattcctgaatgtatccgcctattgatgagggtctaaaaagaagca

SEQ ID NO: 559774 - DNA, 117 bp, Homo sapiens
aaaaaaccccaaaaaaaaacaaccaaaaaaaaaccttatttatgtaaccaaataccacctacctgttccccaacatcatactgaaaattaaaaaaaaatagtatctaagaccaattt

SEQ ID NO: 559775 - DNA, 353 bp, Homo sapiens
tgagaaagcgggtggtgtcttaagagtactgagatgactcagtgtgtgactaaggctgcaaaggaagtagagtgttcagataacacagacgagaggttacatcattcttagtttgtagtgttatataaacacccccagtttttagttttatataaccagataaatatggttcacttttatttaaattcaaatgggtgctatactgtcacgtgcctaatccccactttacaacttcatgctggatgctggtagcaaactaagatatttttctcttttatgtattaaattccacttgtgcttcatgaaacagactataagaacaacaattcaccataatccccctttgccatgag

SEQ ID NO: 559776 - DNA, 306 bp, Homo sapiens
ctgacccagaacctggatgttgacgggcccacctctgatcttgtgagcaactagtcggcgagcaattgctgaagctgcaaaagaggtgaggtcccactatgttgcccgggctggtcttgaactgctgggcacaagcgatcctcctgcttcagcctcccaaagtgctcagattacaggtgtgagccaccatggctggcctacttctgtagttgctgagagaagaggccttagcaccttcagcttgccagcaccttcagcttggattcccagtgttcagaactgcaagaaataaatttctgttcttta

SEQ ID NO: 559777 - DNA, 780 bp, Homo sapiens
ctcccaaatcgtcacgcagatgtatgacctgatccgggcgttcctagcaaaactgtgcctctgggagactcatttgacgaggaataatctggcccactttcccaccctgaaattggtttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacagaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaacacacaaaaatactgctcccagttcaccggattcccagtgggcattctgtactccacaatcgcaacgtgatggagagacaaactcctggcagggccctatggtggcgaccggctggcgctcttctagatcccaacgggcatggcgcacgcatgaccactctgcaattgcctcgcctcgcctcttctggccatggcaggtcttggctctgctcgccccacggttggccgttgcagccgccgctgaccctcggcttcactggcacttccagatccctgggtccgaaccgactctcctggcctcccgcctccgg

SEQ ID NO: 559778 - DNA, 370 bp, Homo sapiens
tggttgtcatatgtaatcactgagggccattatgttacagacaacgtggagagggttcattcctgtggatcgcttcgtccttggataagttcttgaattgcaaaactcttcgtggcctggaggcgctcttcacggcgcttgcgtgcttccttggtcttagacctgcgggcctcagcctggtcagccaggagcttcttgcgggccttgtctgccttcagcttgcggatgtgttccatgagaatccgcttgtttttgaacacattccccttcaccttcaggtacaggctgtgatacatgtggcgatcgatcttcttagattcacggtatcttctgagcagccggcgcaaaatcctcattctcctcatccatg

SEQ ID NO: 559779 - DNA, 176 bp, Homo sapiens
agaagaaggaggcaggcgcggcggcagggcggcccccccgagccggccggaggcgagggtgggaagatgcggacgttcttagcgtcctcgacagtacaacattcagagaggagatttttgttaagggagacgagttatttttgggagttttcttgccagaattttagaccaacttt

SEQ ID NO: 559780 - DNA, 178 bp, Homo sapiens
tatatagacaaacttcattatgagtaaacaaagaactaataagtaaacttagtgagataactggatacaaagtcatcattttttttttggaaaaggttgaatcgcctttgggttttgggccagtccggttggtcaaagataaaaactaagttggagagatgaatggcagggaaaaaaa

SEQ ID NO: 559781 - DNA, 387 bp, Homo sapiens
  misc_feature (25)..(25): n is a, c, g, or t
  misc_feature (31)..(31): n is a, c, g, or t
  misc_feature (55)..(55): n is a, c, g, or t
  misc_feature (111)..(111): n is a, c, g, or t
  misc_feature (121)..(121): n is a, c, g, or t
  misc_feature (124)..(124): n is a, c, g, or t
  misc_feature (255)..(255): n is a, c, g, or t
  misc_feature (384)..(384): n is a, c, g, or t
gcggtgtagctgcgcagttcgcgcngcttanccgcacccaggttcggcccgtagngttctggcagcccggcgccatcttcatcgagcgccatggccgcagcctgcggccgnggagcgcggngtnactgcttgctcctcggcttgcatttgtttctgctgaccgcgggccctgcctggggctgggaacgaccctgacagaatgttgctgcgggatgtaaaagctcttaccctccactatgaccgctataccacctnccgcaggctgggatcccatcccacagttgaaatgtgttgggaggcacagctgggttgtgattcttataaccccaaaagtcattacagtgtcagaacaaagggttgggatggggtattgatgttacagtnggg

SEQ ID NO: 559782 - DNA, 244 bp, Homo sapiens
cgaccactcacacacacacacacacacgcacacacaaacacatctcttctcttcaccgctagtctccgctcctcacacacaccacaccccacacacacaccacatatacaaacaccacacaccacacacacaaaacacacacaccacagataccacatacaccacacacacatccacacaccatacacacaccccacatcacacacgccacacacatacaacacatcacagtcgacgcggccgc

SEQ ID NO: 559783 - DNA, 474 bp, Homo sapiens
  misc_feature (44)..(44): n is a, c, g, or t
  misc_feature (399)..(399): n is a, c, g, or t
agaaatataaatcattctattataaagatacatgcacatgtatnttcactgcagcactattcacaatagcaaagacatggaatcaacctaagtgcccatcaatggtagactggatacagaaattgtggcacatatacaccgtggaatactatgcagccataaaaaatgaataagatgatgtcctttgcaggaacatggatggaacaggaagccatatcctcagcaaactaatgcaggaacagaaaaccaaacactgcatgttctcactttacaagtgaggagctggaacaatggaggaacagatggaatctttgatctttctacttgctcctgcttctgggaacatgttggttttatccaggggatggcctcggggttattgtctggtgggtgtgtctnatctggcacaggcctgatgcccttgaagctgcctgctaccccaaaggacaacttccaaccttggtaacggtttgg

SEQ ID NO: 559784 - DNA, 235 bp, Homo sapiens
actaagacctgcattgtactcgatgtgtgtagtggggccctatagtccccgtatgaggtctcactatagactttcgtcgagcgaagtctcaatcatgaaatattatatactgtgtagagaattgatgacctacagatgataggatatatcatgtggtgtactgcatcgggggtagtccgagtaacgtcggggcatccggatagcgagaagtgtttatatgtatcggttactctaa

SEQ ID NO: 559785 - DNA, 378 bp, Homo sapiens
  misc_feature (247)..(247): n is a, c, g, or t
  misc_feature (317)..(317): n is a, c, g, or t
cggtctacggggatcaccatccggcgaaaactggcagcgctggccagcctctttgatcacctcctggaaagcaatgcgctttccggcggcaatcccgtgcacggcgtgaaacgacccaggatagaaagcaacgaaggtaagacgccggcattaggtgaccatcaggccaaagctctgctcgaggagcccgatgaaaccacttttggaagggaatggcgggatcggggcgaatatgggctgtccttcntactatcagcggcctgcggcctgtgaagacagcggcgctgcttgcaggtaacgcgacattccaggaacgnccgtgggatccaaacaccttgaaagattcacgggcaaaagggcggcaagggtgccggtacc

SEQ ID NO: 559786 - DNA, 696 bp, Homo sapiens
gcggggttcagcccagagagaccccccgagcccgcggcacaggccgaggctgcgctaagcgggctcgaccagccgatcgagcggtggaccacggctactcctcgaacggagccagcagacagtgccccgcgactgaactaggccagccaagacccgacttctgaccgtacgccgggctagtgagggacgcgccgagccgggcggcctagagtggcggtagctgagagcgcatgcggctccggcactaaagagcatgcggcacaccgacaagcgtgatgtgcatactagccatgatctaaaccatggagctactcattcaaccatatagccctgggcgtacccgtaaccgatcacattactgccggcgatctactcatgcacttaataggaagcgccagcctagcaatatcaaccattaaccttcactctacaatcatgatattggcaattcgaattctactggctatcctagaaattgctgacgccttaatccaagcctacggttacacactactagtaagtctctaactgcacgacaacacatcgagggataataatagaatctgagggggggccggcgaccgaattagccctattgggagccgcttaaactacactgctccgacggttacaccttcagaactgtgacaaccctggccttacccacacttatcgacgtatggggacatttcgcct

SEQ ID NO: 559787 - DNA, 88 bp, Homo sapiens
gagggttgggctcgctacctctgcacacgagcgaccgcggctccgtctctcaggtgagctgctctccggtggctctctggggaccgtc

SEQ ID NO: 559788 - DNA, 228 bp, Homo sapiens
ttcctgagcacacaggagtagtatattgcgcagcctgctctaccccaatctctccttgtagtacagtgggccagtggaaaatctggatcatgagacaaacccgtatcacatgcttgcacaactcgtcccacgtcttcaggctctggactgaaccccagatatgcacatccaacatctgcttcagcggtccctgtttctcctgttccacaatcgccaataactccctta

SEQ ID NO: 559789 - DNA, 870 bp, Homo sapiens
tagcaagcgagaaggatagtcaaagaacagagagaggaggaaaactcacagggtccgagcggcgaaaatcgcgggacgctgttaagtgccccgtccgccctgggaaccacagtcggttaacgcgtatcgattgtaaacgcgggtacgcgaagcccactacgaccagggttctccccgatgcaaaagatatgggtcactctctagtaaaaaagaagcggttcttgaaaaaggacgcttgtggggtgaacatccaaggcagtttccaggcaatttgggggaccaaccctttcaaacagtgcggctcgtgccctggtcgccacaacgggtgggcggttcacaaaaaggccattcacaccggcgataattcgacggtggatcccggcaagtgggaagagagtgccccatgctgtggtacaggaagagggccccgagagattgctgtgtggcacaaaagaggtggcccgcgcggccgcaggcctttgggaacccccccgtgggggagacgccaacgaggacaaacccacgggggtgaacaaccacgaaccaccacaagttgagcattgcgtacgcccacgcgaacatcacggtcttccatcaaggcaccagaggtaatctgacacgaaggagatggagcactggggagcaccacattagcgccactgggaacgccgaattgggttttgacgagtaccgttaaattttatttctgggatagcaccatggggcgaacaaacggcgttttacgtcttaaacatctttgtcttccgcattatatattcgttgcgattatcccagaagacgcaagtttatgacttttaaaacggggttactttttgtgaaaataattcccccgatcccgcccccaagaca

SEQ ID NO: 559790 - DNA, 776 bp, Homo sapiens
agtgcgcagagattgcaccattgcgctccagcttgggcgacaaagtgagactccatctcaaaaaaaaaaaaaaaaaaaaagggaggtctcctcgttgttccctttaaaactttctcgtgttttttttctaaaaccccatttcggaaaattttttttctgagcctgttgaagggctggtgtgtgctgtggactcctgagcttttggctgggggattgctcagctcggactaggggcttgggtccagctgggcagatttgttgggggccccagggttccatgagcgaaacccctcccatagcaattgttctggggcccctggcagatcactggattctgtgcagaaaccctgggcgagggggaactccccggggggccttgaagccacattgaacgcttggcccttttccttcccttcaacctgtggaaagctcccgagggacaagacttcgaaggttcgtttttagctccactttcacagcactttaagggaagccaccccactgtgttgccaacttcaagttcacagcttcaagcccagttaagccactgcaaagcccccgaggacttgttgctgggtttctgcgaaattttggaggggaacaactctagttggggattgcattgcagctcagcaggaaaggaaagtgtgctataggttaaatacgctctgggatggcctgagcaacacaccggggagggggccccgcttccggtaacccctctcccaaaatgccactttagaaagaggcagggaccggtgatccgtcccctcaga

SEQ ID NO: 559791 - DNA, 205 bp, Homo sapiens
gaaacctctgcgccatgagagccaagtggaggaagaagcgaattcccaggcttgaagcgcaaaagaaggaagatgaggcagaggtccaagtaaaccgtagcttgttgcaccgttgaggcacaagagcaaaacattggatgtcagacgcttggatgctcgtacaagttgttggacttcatgctactcgtctagagctctctcaatg

SEQ ID NO: 559792 - DNA, 190 bp, Homo sapiens
cttcaccgtttctcatgtgcctttagagagaccgtccacctctctcctttcaactaccaaacttctggaaagaataaatttagattatatttttcaccatccatttattccctcaaagttggcttatgcttccaatcattcaactctaaagggcatttactataacgcgtcaccgaatgttctttcctct

SEQ ID NO: 559793 - DNA, 313 bp, Homo sapiens
caatctaagacgggatctgttaaccattaatctctatccactcttaaaatttcatgactaattcagcaaatatttattctacgcttcaggcactctacataaagaaaaacagatataaggtgatacttttatgtgtaaaactaacagattaattagtgttatgagtatcttggtagagaatgtggtggagagggatatttggacttgaatcctaatttcccagcaagccctgtctcaaccgtattctctaggcacaactattttagttctaaatgcatagctccaaattaatgcataagcccgtatcttgctc

SEQ ID NO: 559794 - DNA, 492 bp, Homo sapiens
cagagatgctatggacagtacttttgtcaaggactgggagtggagaaaatgacttatagtggtctttccaacatgaagtttgtattaatccgttttcacactgtgaggaagaaatacctgatactgggcaattataaagaaaagaggtttaattggctccccagccgtgtggaactgtgagtcaatgaaggcttttttcctttaaaaattacccagtcttggccaggcgcggtggctcatgcctgtaatcccaacagcttgggaggccgaggcgggtggatcacttggggtcaggagtttgagaccaccctggccaacatggtgaaactgtctgtagtaaaaataaaaaattagtcagacgtggggccaggtatggtggctcacacctgtaatcccaacactttgggaggccgaggcgggcggatcacgaggtcaggagatcgagaccatcctggctaaaacggtgaaaacttgtctctactaaaaaaaaag

SEQ ID NO: 559795 - DNA, 1161 bp, Homo sapiens
gcaaccagccagaacgcctgaacgcaggcacatacttcctattctaacacacctagtaggctcccttccccgtagtccatcgcacataatgtacgactcaacgagacacgcctaggctcgacgtaaacattctactactcacatctgcgactgcccacagaactatcaaagctacctgagcccagacaaggcttagatactgacctagcttaaatcaactacgacttaggactacgctacacacgactaccctcctttaccgtgactcccacgttatgaacttccctacaagaccacattgtcgtaaggccccacattcgactggtgtcaatttaggtaacattgaccgccaagatacatcgtatacaaatctagagctgtgcataatggctcatcaatacagccctctagcaacatacgcattcctcaaacacaccgcgtggaacaaagaagcaaaagtaaggcactaatccacacattaccatatggtacatattcaccgtaatgcagggcaagtagacttaataagacagaggcatcaccatcctgtcgcttaccgtaacaaaaacaggaaccttaaacagagttcggcgtcaatttggcaattaccttcatgtcagagtcaaagacgccacattacgcaccgtcgggttaggataacaccaagtcgcaaatgtcgttccaagcccccagaaagcccaccgcactttggtctcatggccgtttatcctaacaccagggggagcatggacgaaacggattcacagatgttccgttccgaaagtaagactatccgtgtgccagccgaagctggtggtggcccctgtttcatcccaaagattcccatttcgtagttctaaaacccttaacacttgtcccgataggttaccccacttaaaaggagccccaaaccagatacacatggttttacaaaacgtcagccacacccgatttacatcacgggtgaacagtatcacgtgctccacatattcatttgctcacattccacagtgagactgtcgtggtgcccacatacttccgccacagttttcaccagacgtttcccacgtttcccgattagcctcattgcccaaccaaggtgggtctacaacccgtcttttgccccactagaacgctgcattttccccttatcagaccttc

SEQ ID NO: 559796 - DNA, 151 bp, Homo sapiens
  misc_feature (1)..(1): n is a, c, g, or t
ntcggtgatctagtaggatccccgtcgctcttggccggtcatcgctcttggggttcacaggtgaggctaagatatccttattctccctggggtttaagtgtggatggtgatgtaggggatgggcagcttcgggaggagattcccaagagcg

SEQ ID NO: 559797 - DNA, 380 bp, Homo sapiens
ctacagagaaacagatcatacattttgagtggaaaaccctgctagccttttaccacagaaaacaccgtatattacacttgttatgaggtaaaaacctcatggaggtatgtgccacaactaacgattattgcctagatggataaaagacctcatgagaaatcatatattaactaaatccatttatgctgctataacagaatacctgagactgggtaatttataattaacaaaaaatatatttttgaacataactggggcctgggaagtccaaaattgagaggccagcatcttgcaaatgtcttcttgctacatcatcgcatggcagaaggcaaaaggactcaataaggacaagacaaaaagaaaagctgtagctgtagtaa

SEQ ID NO: 559798 - DNA, 325 bp, Homo sapiens
ctctccttgatgactttatccctttaccactctctaacgacctctctctcctcttttcatctgtcgtggtttaaagtctgttttatcaaaaactaaggtttcaaccccaaagcatggaaaatttttaaaaatcgtatggtccaaagtaagaataccgaagttcttttaagagtctgaatatataatattaagcattaagaacattgtctatgggatgaagaagggatgactctacaatataactctggctccaatatttgctaatatgtaaattttgctcagctactcttaatcttggttttctcatgtgtatattggagacatt

SEQ ID NO: 559799 - DNA, 472 bp, Homo sapiens
cacgaggatgatttctgtgaaaaatcactctcacaaggacttctatttctggtagtatggtatatgagagaacctgaaaatctatctcaactgaacatctgacaatgccagattttcaaaaagtgccagatagaatatataaaactgtgcatgagtctgcaggatagtgagtctataaaccaggcgagggttgaagtcaaatgaggtagttctgtgctcaagatactctatggcctgtgtccccatggacccagatgacctaaaaatttgaggaaagtttggggagcagtctggagaagccttgggcccagggaggggcagtaacaaagtggatacccccatataaggctggtctcacagagggatacagcagacactaccaggaaatgatgaagtgggcaaactactactctaaacttgactgcagaaacagtatctcacttggccatggatgtggaaggtacatctttaa

SEQ ID NO: 559800 - DNA, 149 bp, Homo sapiens
  misc_feature (55)..(55): n is a, c, g, or t
  misc_feature (77)..(77): n is a, c, g, or t
gaacaaaagccggtattgggcccggcctcgaaagcccaggcccttaaggccgganccgcggccgcaacaataataancccccccccccccgacctccaggccgagccgggccggcggaagaggcacgtgcgccgcagaaaggagcaggc

SEQ ID NO: 559801 - DNA, 590 bp, Homo sapiens
cgtggttcgatcagcgccctgttgtgcagcaacgagacggggaagccggaacagcaactacggcaatgcatagacctgaccaggaaatagctgtgaactgctctcaagtatgacacagatcctcggaagacagggcactgctgtaatacaaattcagttaaaggaagatcagcaggctctttcaagctagccctagatggaaagtgtgtcctgagacaggtttctctactgggttacagcacggggctttaccatccttcagatcttttctaaagacaaaaatgacaaagtctatagaaggaagagggggtaatgaagcagggaaggggaaaaagatgctgatttgtttacttttattatcattttttaaatgtggtcaggggttttatagtatttttagtttaatctttttggttattgacaaagatagaacagtccactgtccagcagaggctgcttcaactctattgctcgcagggctcattctgcaatggatctgtgtttcaggatgctgcaggacaactctgcgggcaggacggccccttacccaacgctgtagcataggtctactctgtggtggggaaagcagg

SEQ ID NO: 559802 - DNA, 218 bp, Homo sapiens
tgaagcaagaaaagccatatggtcgcctcctgatacagccggggcccagattccactgaggttagagtccattaacaaagctgccaggaaaccggccacttatagtaaaccacgtcgtgcctcactgggtcctcaccccctcatttctgaatgtgcatttccagccttcttgctctcagagatattgttcaagcagaaaacaagctgcttttcttcca

SEQ ID NO: 559803 - DNA, 231 bp, Homo sapiens
  misc_feature (220)..(220): n is a, c, g, or t
ggtagtaattgaatcatgggggcagtattccctcatgctatctcatgatagtgagctttcatgagcatctgatggttttatcagtgcctggcatttcccctactggctctcattctcactcttaccgccctgtgaagaggtgccttccaccgtgcttatctctatccggcgctaccgaggctccaacttcgataatcactcggtcatcgcttcgtttccntgttgtgaaaa

SEQ ID NO: 559804 - DNA, 252 bp, Homo sapiens
tgccacacggctggtctggtgcgtttccgaagcctgtggactccattttactgaggttctgtctgctgcctgcttagtttttgtgtcgatgattcactttgctcccagtacttttgtaactggatgaaagtattcatatattatgcagatgtgtttgagcctgtgtgctttccttttgtgattctgggtaacttgtttgacttttgcgtacggctggtgtctactgttgtagccctagcttggtgctgggac

SEQ ID NO: 559805 - DNA, 242 bp, Homo sapiens
ttcgaccgaagcaagaagaacagagtgagacagagaagatgtaaggatggaagcataggtcagagagaggtgaagatgctaggcattctggttctgaagatggaggaagaggtcatgagcagcctcctgaaggcagaagaggcaaggaatggattttcctatggcgcttccagaaagaacctgccctgttgacagctcgattttagccccttaagactaatgttgtacttctgacctatgct

SEQ ID NO: 559806 - DNA, 501 bp, Homo sapiens
ctaaaatagtacatataataagaaacagagcagaaagaaatccgtggtgacaggtacaatagaggtctttaaatattagagatctaaattcatatacatataagttggctagcatacaatataagggtgatagttttaactctgacaatagtgtagtaatataagaagttgtggaacgttaggaaaataaagaataactgtacatataagagctggtcaaaacctcaggccacatctagacatgaccctcaggtttaaaggtgaggagactgagaactgagacagtgatgtgacttctcccaggtcacatgaagctataaattatggtgaatcataacctcactgctgtttcttctgatgcagaacccgggattcttaagtctccatctgaagcctcttcgagggcctcacattcgctcttagacctggctggtcccacatcaacgtggcccacattgtgacttagattctttaataatgtttacgcgtgattgtatgtct

SEQ ID NO: 559807 - DNA, 463 bp, Homo sapiens
tgaaggagatgttgacacgggtagggatgctgttgttggtgaatggacggaaggcctttctgtcaaacactgcttggaagacagcagggtcaaccccatgctggtcaaagcctgagcaattgatggtaaaagcgtcgcctcttcctatagagagcagagactccgtgagagagggactctatttccagggctggagtctctctgcagagagataaaataggggacgtactgagaggagcaggtgagcccctccttcccatgccaagactccccaaggccatggttggggaggatgggctgggctggtaggcaaatggtggaagtggatgtggtgagctgaggtcagggctctattctcattcccattgcttcatcctcatgcaaagtttgcccaaatctgtatgaaaacttggcctaagtgcaatggcagctacttccaggagtcctttaatgtacccatcaa

SEQ ID NO: 559808 - DNA, 199 bp, Homo sapiens
caggcagcaagctgtggttgacagtgagggtaataatgacttgttggttattgtatgatattcgggctgttaatttgtcatgttcagtgttttaattctgatcgcagagctatattgcgccaacgcttgactgccgtgcctaagcttgtcatgccgtgcctacgcttcgcatgcctgggtgtaccgatgctcgcaattt

SEQ ID NO: 559809 - DNA, 1258 bp, Homo sapiens
tggacaaatctacaaaccctttttttaccaaaaggattaattgcaccttggaaaaaaaaggggcttcctctttcccctcaaaggctctcatgtgccccttctcccagaggggcgaggccagccgagggaaacaagagaggaaccccgagggtttgcaacccgaggcgtggaatctcagaacaaagaggtgtgactccggtgtctccgggaaagcctttgacctgtgccagaacatttgagcctccctcaattttctcactccagagagagaccgcgcctgtgtgacacactgtgtgcgcggggtgtgttataacgccccagcgagagaatcacacacagacggcgtctgtgctctctgtgtcgctctcagagagagaaacaccggggagacaacacttctgggcggcccccccctgtgagagacaccagagttctcacagcgagagacgcgggtgtgcggcaaaaaattttatctcacacaatgttctgctggtggtgaggctctcctctatgagaggatctcccctaataagacgtgtgtctcttgtggccgccccctgttgtgttgttctctcctctataatgaaagagagaagagaagtctctcctttgtgtgaaacaaacttcctcctcccatatattaacgcccctgtagtagtgtggggcgttcgatcatttctccacactatcctctctcttctgtttctcctcttcccaacaccaccacaacaattctcacacccacaaattttctctcctacagaagaagcgcgtgttgtccaccaaagaaggcacaacgtgtagaagaaaccaggggtgggctcgaccaacaggagaatataatcgccccagaagaagaaggtgggggtctccccggcggggggtgacaaaaagaaaaagtgattatattcaggacgggggtggggagggaatcctcccccttcttattaaactaattaatcggccccccacaaaaaaggaggccggctttcttcttcttgcggcgccgcctcttcctaatttttctccttccccccgacacggcggtgatttattgttgctcgcggttggtccggttggtggtgaccaagttggttaataaggaccttccagggcgcctccgaaggaggaagaagaaatcttctttgctgtttgtggggagcacccacccccccgatggttgggtgaggggcgctggtggaaggtattcttcctcttccccaccaaggaggagggctgatgtttgctggtccccaca

SEQ ID NO: 559810 - DNA, 112 bp, Homo sapiens
gaaggcctcatatccaattacctcactcattacatgtgagaacaccgcagacatccgacgagggccagcgtcaccagaccagctgcgggacaataccccagggcgtgtagcc

SEQ ID NO: 559811 - DNA, 374 bp, Homo sapiens
cgggcagatcacctgaggtcatgagttccaggtcagcctggccaacatggtgaaaccccatctctactaaaaatacaaaaattagccaggcatggtggcaggcgcctgtaatcccagctagttgggaggctgaggcaagagaatcgcttgaacctgggaggcggagtttgcagtgagctgatatcccgccattgcactcccacctgggggacaagagcaagactttgtcttttaaaaaaaaaaaaaaaaattttttttggttctggtctggagggccctgcttctcttctagccttttctgtggttactctgccactgtttgcattgtgtgtactccctctggtgacctgtttaaactccaagggttccactac

SEQ ID NO: 559812 - DNA, 1243 bp, Homo sapiens
gaggcatgaggcagccagcgcaggggcttctgctgcagggggccaggcggcagcttgcaggcaacaccgccagcatccagctttttcttctcctttgcacacagcatagcagcattcacatcaccacactcacgttcacacacacacatcatcagatccacatcagtgcttcacgtcacagcatcattagcgttcacgcgtctccacagctctctctctcacaccgctcacatctcttcacatcagcctctcaagcatcctttcacagcagcacaccatcatgcacagcactgtcagcacacgcagtcagccatgcagcgcaccaggcaacacagcatcacaccaggttctctccacacaccatgcaccgcgcaggctttgcagcatgcacagctatctgtccataggccaggtaaacaacacaatggtccttttaatcacagccaccacatctggagcagtacacaggcactcacgagcagcgccccgcacattccaatcaccgcaattcagcacaagggccgagatgctagtttcaaagacaatggaaaatccacggcacagggcagcagcatcggaaacagcacgaccccacaccagatacaccacatcacacaaacagcacaaccacaagccggggcacggagagaatacccacacaggtacacgatgcggcaaccgggccgcacacgctgcgtacagagacaggacgcacttcaagcacccggcaccgggcgcgacatctacaccacacaagcaacccttcttgccacaaaatgccccattggaaccgacatgcagggaacgcaaatttctggccgttcccaatttgtcacaacgggccactacacttagcacactggcactttcacacctccaaccccgcccagcaacgacaatcattggcgcatacagcatctcacatttggtgtgaaagttggggaacgggacttgcacaaccaaactttgcgcgagcaaagcaataccgcacaggctctggcccgttgggcaccaaccacctggggaacacaacaacacgacacacctacacgggccacgcggccgcaacgacaacaggcacatctgcccacacagactaggcggcacacccagcaacaccacatgaaatcacacaccccctcaagtcacgcaacaacaatccacaacaaccgaacgcccaggaaccactcactcggaccagcccgcacctacatcaaacgagccacactaggacaacacaaca

SEQ ID NO: 559813 - DNA, 264 bp, Homo sapiens
aatcagctcggcccttatcaaaagggaatatagaaggatgttaaacattcttgttaaaataaacaggctgggcacagtggctcacccctgcaatcccagcactttgggaggccgaggtgggaggatcacctgaggtcaggagttcaagaccagcctgaccaacatggagaaaccccgtctctactaaaaatacaaaattagccaggcatggtggcgcatgcctgtaatcccagctactcaagaggccgaggcaggagaattgct

SEQ ID NO: 559814 - DNA, 732 bp, Homo sapiens
  misc_feature (128)..(128): n is a, c, g, or t
ctctcaggcagtggctcgccgccctgatattcatatcctgggcctgctgatcctggcctgtctagcacactgcgaacttgacaggccacacacccgtgtagcttatgcacactgtggcagagcgtgcncatttgacatgctcgctagtccctggtgaccctccagagctcagttgaggtcctctagagacatatctcgccctggaccacagtacccctgacgttccccctccctcatcacctcctcgggccaggaggacatcaggtgacaccttacatgggcaatgaccttctcatgtcgctggttttgacacgacacccgctggtctgaaccacggagcactgcacaattacatgcctcattctagcatccttccctgcgtccccttgacctcaccctttggtccgttgcccgagacagccacctcagcagccccagtagaacgtggggttagtagactcttctgccgtgaccccccttcaatgcgttctacatccacaccacccattttcaggggtcactgcccaccattacaaccttgaacaccggggtgtccccccactcccatttcctggcctctgccataatttggtgtctcgaaatgctccctccttcctgaggggcctcagggcttttggggggtaggctgagacacccaccacccaaggttaactgaggtccccttgattgaggacttcaccccttgattaaagcaacgtctggttcagtgga

SEQ ID NO: 559815 - DNA, 241 bp, Homo sapiens
ggagttaataattgatcatctattattagcctccatgaaaacttcaggaactacagaatttggagagcttccaggttggtgaacacatctgtgtgctggatgaggtgatggtgcacccctattccacagggacagacgccccttgccctagacccttccagacctctccctgagctcttcctctgactgtctatttgtatctttttttttgagaaagagtctcactgtgttacgtctaggt

SEQ ID NO: 559816 - DNA, 217 bp, Homo sapiens
gacataatcaggcactctgagtcagagcacgtgcgcaatgacattcaggcgagtataactcaatccagacctggccccttcacatctgcacctccagcccccacatcctgtagttttcatgtatcaaattcagtaattggtctgaacttggttattgtactttccaaacctttttaggcaggatattgaactacatctggttggccccttatccgag

SEQ ID NO: 559817 - DNA, 1105 bp, Homo sapiens
  misc_feature (1105)..(1105): n is a, c, g, or t
ctgttgcgcgtgttccttttctcgtctgtcccttttctgtcatgttgtgttttttcttgtctgtttcttgtgtggcctttcggttcattccgtgttttcctggttcctcggggtccatttgggttattgtccgtccttttctcctgtatccggttgtccatgtccggtgcacttgtccctatgggctggatacttcttatgctggtttctctttgcttgtctgtcgctattctattcttttgctgttctttggtattcctttggtcccttgcctgctatttcttcggggcgcattgcagtaggtttctactttttctctgcacccttcattcggatactttgtaggcctgtctcactgcttctgtggcttctcgcattgcaccgggccgccctgcccgcccttctctatttggtgccatttactttattgccactcctcacgatggcctatttaaagggcgacctccggcggatgtggtctgagcctttccacttccatagtcctagcagctcccgattcctggaagtatgatggatcacgtggtatagtgtacctagttggccgtcatagtccttttctctcaactcatggtttgtttcctcttagagctggcctggtactcagaaatgtacctgtgtttaaggaactgccgtgtgactggatttggcatttaaagggagctcgtttgcaggtagagtaggtgtctggtagtccctgtttcggttccttctcttcctgcggatgtagaggtggggccccttccaagtagggactaggcctctccccagcgcgccttcctcccacgtttttatggatctgcaccagaactgttaccttactgggggagatggagaatttagaacatagatattaaaaaacatgaacaaacagacgaggaagtcatattacataagaaactatattgaacactaaaaaggatgaaaaaaaattagcaaaccgaagtcttcattcaaatgacccctcgagaactttgggacctagtttcctataggggactcagtttcagagaaattgagactagaagctcttctgtcgttatattttacacccaggtctgactaagtaccggcgcccccccccccn

SEQ ID NO: 559818 - DNA, 239 bp, Homo sapiens
ccatttttccaagccctgtgactagcaggagcatgagaaagcacctcaggtatgagtatgcactcacctacagtagcgtattggtggagtatcccgagattcatgacagcctctagcaagaatgaatgaaaacagagatgtgagcttcctttacatttatgtcccttccctgcaacccaaacactttgctgttgtccttctgggctctgagcaggaccaacaaattggatctcttaata

SEQ ID NO: 559819 - DNA, 324 bp, Homo sapiens
agactgtcgacaggttgggtgcatgtgtaatgattttctgtacttttgtatcaactcagaattttcagagatgctcttcctggctgaaaagatcttcaaggatcatctccggaatggaagaggtgaggcctgttagacttgtgggctgcccaatccatcctacccttggcattgggatcaatgtttatgaggactagaccttcaacagtgtccagggtggttaagagcatatctcgccaggatgttcgctccagctccaacacacgacactccaattattgtagagaaatttagagtactgcaggacgcaaggggtcatgtctg

SEQ ID NO: 559820 - DNA, 569 bp, Homo sapiens
  misc_feature (218)..(218): n is a, c, g, or t
  misc_feature (467)..(467): n is a, c, g, or t
gccagttagggactagtccgagtctggaaggcaggataacgttgtgggtgatgcagttaatagtgttcccatgatgcccgggtcaagtgccagggatacatattctccctgcagacagctctaggcgagccaagggctgcatgggtctgtacgaacgtcaagaatcgggagttttagtcactgttgctgctagtggatgtagtcgtaatcttttaacntaggcaacgtagtcttcgtcatcgtcctctaatgtgctcttgtgtcgtatccttggagagctgtcctctctataggggaatagcggggactgtatgggtctctcaactgtagtgcgttgggctgcttccgctgtactggcattggtttggacatagttcgcatgggacgatcgctgggtctcaaggttgggcatacagattatgatgtgacctctctagtgacgagtaaacctatcatatgagcatcgngaatagcatagcgctagcctttatcttcagggaacggagccccttaggcgcagagcgtgtcagcatgattcatctaacaagggaacgcagaacctaatcagt

SEQ ID NO: 559821 - DNA, 302 bp, Homo sapiens
ttaaaagcccccccatttttttttaaggagaagggcccagtcttttcccaagtccccccagggggggggaaagcatggctttggggtaaattatgtaaggcaaaatttttttaattttcgccttaaaactttttttttttgtttttttttgaatgatgggccttggggcccccccttcccccttttttgtcccccaacttgaaaggtatgaaggcttttggtttccctgggggggggggggggcagccagggttttcctgtaccttgatttgggcccggttgaataaaggggccccccttta

SEQ ID NO: 559822 - DNA, 298 bp, Homo sapiens
tcctgggtgtgagcagactgcgcacaccagtaagcccatgagaaggaaacagtggtttgatgtgggagtcattaagggcaccaatgtactggtgacacactattttcctggcacagattattgtgtcccataagacgatgatttgggcaccgtccctgactataaccagctgaagaaagcggagcttggggcagggccacgcctaataagtttcgtgttgccggaatcaatgcctggtggcggggggcccctccagggaaatctcagcctttaagacgtgcctgcctggtttcccagg

SEQ ID NO: 559823 - DNA, 191 bp, Homo sapiens
taggcgaatctcctcctcccctgctctattatgggggttagaatgatgttaaggtgtggttggcctgtgttattcttctgaacttttgggggaggttatatgggtttcatagttttgtactttatttagggggaatgatggctgtctttggctatactacagcgatggctcttgaggagtatcctgaggca

SEQ ID NO: 559824 - DNA, 210 bp, Homo sapiens
ggccatgtccttctggttctttgtgaaggcagctagttctgtattcatgaagtataggaactctgtctatggagagagtgtagttataaccatcctttccagcatacttactggaagacagcaatcaggggactcgatgcaccgatcagatctctgatagggctggaagatttttagccatgttaggagactgagacgacaggggtaccg

SEQ ID NO: 559825 - DNA, 216 bp, Homo sapiens
gccctgtctccatccttgcacagagataactataaaccgtaaaaaatactcacaaatatgtaagttacaacggtggaacctttgatcgctcataatgtttaacataacaacatttatttcaaatcactgaattcatggagatgtgaacacgcttggtttgctctatttttgtttatgtgtgatagtggttctgtcatcatcattcatgtttattaa

SEQ ID NO: 559826 - DNA, 623 bp, Homo sapiens
gtttttctccttctttattccatttatttccttagttcatccaacggtatccaggccatcaccaatcattctatacgacaaactgtttcttcttacaaccccactatatcaccccttaccacaagacctcccttcagcttaatctctcccactctaggttcccacgccgcccctaatcccgcttgaagcacccctgagaaacatcgcccattctctctccataccaccccccaaaattttcgccgccccaacacttcaacactattttgttttatttttcttattaatataagaaggcaggaatgtcaggcctctgagcccaagccaagccatcgcatcccctgtgacttgcatgtatacgctcagatggcctgaagtaactgaagaatcacaaaagaagtgaaaaggccctgccccgccttaactgatgacattccaccattgtgatttgttcctgccccaccttaactgagtgattaaccctgtgtatttccttctcctggctcagaagctcccccactgagcacgcttgtgaccccgcccctgcccaccagagaacaaccccctttgactaattttccattaccttcccaaatcctataagatggccccacccttatctc

SEQ ID NO: 559827 - DNA, 504 bp, Homo sapiens
ttgctgggactgtaaataaatgacctttttttgagatagtgtcttgctctgtttcccaggctggagtgccacggggcgaccacagttcacagcagccttgacctctcaggctcaagcaatcttcctgcctcagcctcccgggtagctgggactacaggcgcccaccaccacgcccggctaattttttgtatttttagtagagatgaggtttcaccgtgttagccaggatggtctcgatctcctgacctcgtgatccgcccgtctcggcctcccaaggtgctgggattgcaggcatgagctactgcgcctggcctcaaaccttttttttatatctgttatggggctctgtgatctgcgatctttaatgttgctattgtaattgtttcaagggcaccatgaactctgcctgtatgagacggtgagcttaatcgatgagtgttggctgtcctgacccactgatcagccattccctacctccctctctctctcctaggcctccatatt

SEQ ID NO: 559828 - DNA, 1007 bp, Homo sapiens
atctaatgcttgcatcttattgccacgcttgtactcataccttattctggccatgtgtactgtcattacctaagatattctcaacttcataaatagttacaacacctgaatcacccgttggggatgtcgccactaatttctccagtgtttctctaactgactcgtgagtgctcacttgttacctattaatcctcagttactaattggtttcaataactcgtgcatgtacaaacatatattcaaatcgaccgagacataaactcaatgaccgctatcagtgaagaaaactaaattcccaagtgtatcatttctttcactatgcaagactgcataaccaaatttattcttataagttgccaagaactctatgtactgacaattaggttgacattggaaaaaccgcttccaaattgggggagacaacccatgctacttcggtttagttgaaaacaaaccaccaattcgcgtaaaacttataggcattttagcctaattttcatccaagcgcgccatagaattcttgaggcgcaaacccgttttcgtcacaaagtaaccttactcccaataggggttggggggcgacaaccttaaaacaaagccgggctcctttaacgttacggtttcgactttttttgtaacctaggaactgtggcgctacgagttgtggcttatcatgcgccaaaaagcattacacctatgcggttgccttctccaagagaaaatccatggaaacaactttgaaacctttccaaggtgccacccaaatatttaagagacgctgttgagaaaatattggctcgcgcctacattggcaatgcaattggttatctctggtccatatcgggatttagacccaacatggcggaaaacaaaaaccttatattctcaaacccttctgttataatgtgtccgaggcatcgtggggcagcaaagttaaccaatagccttacctctgtggagacaagcttttttccaagttcgtatatcttaccacttccttgggcagc

SEQ ID NO: 559829 - DNA, 752 bp, Homo sapiens
  misc_feature (70)..(70): n is a, c, g, or t
gagacgttcttcgccgagagtcgtcggggtttcctgcttcaacagtgcttggacggaacccggcgctcgnttccccaccccggccggcgcccatagccagcctccgtcacctctctcaccgcaccctcggactgccccaaggcccccgccgccgtccagcgccggcaagcaaccgccgcgccgcggctctccttagtcgccgccatgagaccgcgtcacctcgcaggtgcgcccagaaataccaacaggactcagaaggcccgcatcaaccgccagatcaacctggagctctacgcctcctaacgttacctggtccatgtcttactacttttgaccgcgatgatgtggctttgaagaacttgtgccaaatattttcttcaccaaatctcatgaggcagagggaacatgctgagaaactgatggaagctgcagaaaccaaacgagtgtggccggaattcttcccttcccgggactatcaaaggaacgcaaagaacgttgtgaatgaatgggagaaaacgcgggcttgaactgccatgggagtgggtgccctctaccatttgtggacacacacactctggtggacttccacgtcacctactgggaacgtggcacaacgctgggcactgacaaaaaagtgacccccttgtgtgttggccttcatggcgacacatacctggaaggagcaggtggaagcctcaaagatatgggtgacccgtgaccacttggcaagatgggagcggccgaatctggtg

SEQ ID NO: 559830 - DNA, 350 bp, Homo sapiens
cttgatgctcgtgcaatctgcaatccgcgtcgccacacgaggcttcattcgttatggctggcgcttggggttggagaactgcagtgttttcctgactatattcaacacagtgaacactagtctgaatgtataccgacataaagatgccttaagccattttgtaattgcaggagctgtcacgggaagtctttttaggataaacgtaggcctccgtgctggttgctggtggcataattgagccttgctgggcactcctgaggagccctgctgatggcatttcaaagtactctggtgagactgttcaggaaagaaacagagggatcgaaggccctccatgagctaaaccttga

SEQ ID NO: 559831 - DNA, 721 bp, Homo sapiens
ttactgagaatcaggtatcccctgccctacccatcccataggcccctagatcaggtatgctgcgcggggccggccacgcagactttctttccccataccctaccccagggcagagcccggcaggcgtcatggttccagaggctgggatggaatggtatcacccaagtcctctcttgtcagtccttcatcactcaccgacccatcattgggtacctacgatatgccaggcccattcctgaatccgtcagagatgtggcaaccttctggaggtgcccatcagtgacagggcccaatacgcataggtaggccaggtggaaggcagatgcagagggctgaatccctgggcccctatggcctctcctacccacctcagtcctagaatacgctgggtgtagtcaggctctgcctttgacttgggccttatgttcccagctcaaattggacaggtcccagggtctctggggcccagcttcaccaggccacccatacaggtacccattttctgattccctgagatacgaggctctgctgtctctgtgccgctaaggtgcaacatgctggagtatatgatatggccagtctcaacccagcaccaagcttggctaaccctcctggtgcggacccgcaggctagcataacagtgccatatctaaccccttatccacctggcaaaatgccacagttctagcctgggcctgcagcctgtgccgatgacacgcaa

SEQ ID NO: 559832 - DNA, 371 bp, Homo sapiens
  misc_feature (4)..(4): n is a, c, g, or t
  misc_feature (26)..(26): n is a, c, g, or t
  misc_feature (40)..(40): n is a, c, g, or t
  misc_feature (136)..(136): n is a, c, g, or t
  misc_feature (165)..(165): n is a, c, g, or t
  misc_feature (362)..(362): n is a, c, g, or t
gganccatcgtgccccattagaaganaaagaagatcttgnactcttgcccccaggctggagtgcaagtggtgcggatcacaagttcactgcatccctcgaactccctgggctcaagggattctcctgcctcagcancccgagtagctgggactacaggcatgcanccaccacaccctggctaattttttaaattaatttttttgtaaagaccagggctcaccatcttgcccgggctggtcttgaactccagggttcaagcaatcctcctgcctcagcctcccaaaatgttggtattacatatgtgagccactgtgcctggcctccgttaaattttctaattggttgttgctgattaaaaacncggctaatg

SEQ ID NO: 559833 - DNA, 184 bp, Homo sapiens
  misc_feature (11)..(11): n is a, c, g, or t
tttggacaaantgggtcccttcctcttcccatccccccccccttgtaagttttaaattggatttattttttcgtgaggggggggctttggggtccttgacacacataaaggggccccccccccttcccccttttagcactgggggccccaaaaatgaaaccatcaataaagattgagttgccca

SEQ ID NO: 559834 - DNA, 193 bp, Homo sapiens
atcgagccggcctgttatgggcacagaaatttcagggtatgacagctaagggtgtttttgaagaaaagagtttttgaaggaaagagaaagtctaaaatttatcaggtgatagttgcacaattttgtgaataaactaaaaaccactgacttgtacactttaagtgaattgtatggtacaggaattatatctcaa

SEQ ID NO: 559835 - DNA, 227 bp, Homo sapiens
ttctaggttatattttcctttaaaatcccttagggtaaggttaagccttttaaaagttagttttgagaattgagaccccatactaatactgtaggaattggtgaggccctgacttaaaaccttctttggactgtgatttccctttggggggattttgctaagtgaaacctggtaaattttttgttaactaaatttttttcttaaaataaagactttttccccatgga

SEQ ID NO: 559836 - DNA, 408 bp, Homo sapiens
cgtattgcacgcccgactctgcgagtgttaactcctgggcgtcctcgagcaggcaccgtgtgctccggtcgtctctgtcagagtctagtaccgtggatgaggcatgggattaaatctagcgttcagtccttccgagggtgactctgtcccctaaattcggcagtagctgtaagggattcatgttctgtgattgagaacacaagaagaaaccgcttccccactccgaacgtagttattctcgaatggctgcttagtcctcttgcccagcggtgtccagaatatctatctaaacttcttccccatcaagaaccactttctttctatacactgtcagctattggtagggttcataagtcttctacaaagtcagtcatcgagagaaccagaattaggtaaccgagactcggc

SEQ ID NO: 559837 - DNA, 100 bp, Homo sapiens
aaccttataatttttttttaaaaattgtaattttttttgccttttggaaggggccgctgctgttttaatatttttttaaaattaataattagttagttga

SEQ ID NO: 559838 - DNA, 205 bp, Homo sapiens
ttgctgcggtgctctacgacggctccctcgccgctggcggttggggtctgttacgtacttcgtgctgcccgccgctacggctggggcgacgactcggacgaccgtcggactgctgtgacttacggacggactccgaccgaccgacggggcgttgggtactggggttactggcacgggggtttcgttttggacgggtcccgacgct

SEQ ID NO: 559839 - DNA, 169 bp, Homo sapiens
gtgactagagtggtcgcatgtagtggatacctatctggggctagtaaattttcaagactagatatataaatgcacggtaatatgtacacaagttagaaaccaaattacaagtattcagttccaatacttcattagtttcaatcaaccaaagttagttcagatagcttat

SEQ ID NO: 559840 - DNA, 764 bp, Homo sapiens
tatttatagcctattgactgcacaaacaggactatcttaaggcacatgtgcaatggcatgaataaatgacgtggcatatgtccatggaatactgtaaaacagtgagcatgtatgaactagaagtccgggtaataacgcagctgaatttaaccaaccttgctgaatgcaagactccagacactaaagcccaacattgctgtatgattcactctgatataatacttatcactagtacgggcaattacttgtatatcgtcggtttacaaattaggatacgcagttagccttgcctaagagctgaaagagtggcatttatctggtgctgggaataatctgtttctaaacctaggtgctaagtatttgagtgtgttctgagctgtgcacttaagatatgtgtatttttctgcatcgtgtgttacactttccataaaagttttctaaaatcacacaatggcataacatttcgtgtcgctcatcactctaatcgatatgtttctctagatgtgtatgaatgatgcgtgcacaacaggaattaaatggcagattttgcataattctgtgcaggaaatacatatttatagtaattttgatggcaactactaagatttcctaccctgtccttaaagcttagcataatgtatattttaagtgaaatatttgagaaggttaaagaatcattacatactttgtcatcctatacttttgcatatataaataggtctgagctgcctattaccctaagaagctaatgtacatcatgctcg

SEQ ID NO: 559841 - DNA, 337 bp, Homo sapiens
  misc_feature (25)..(25): n is a, c, g, or t
  misc_feature (33)..(33): n is a, c, g, or t
  misc_feature (190)..(190): n is a, c, g, or t
  misc_feature (230)..(230): n is a, c, g, or t
  misc_feature (236)..(236): n is a, c, g, or t
  misc_feature (277)..(277): n is a, c, g, or t
  misc_feature (295)..(295): n is a, c, g, or t
  misc_feature (317)..(317): n is a, c, g, or t
  misc_feature (326)..(326): n is a, c, g, or t
agagagagaggacaagagcgcgcanaggcatantggaagggcgggactcgactttgttgtcgcctgcccggagagtcgagactggtaccggagagctgtctcaccaggagacacgtcctggaagtgtccgggactcgcgggacctgtggctgcagacccgcccggcacgcaggccagagctggcgcactncctgaggatgagactctgggggccctagccggggttcacnggaggnctgtcctttgggactcctaggattgcttcgttctggcccgngtcacttctggaactgtnagacccaagacaaaaagggctnagggatttntcaattgcaaa

SEQ ID NO: 559842 - DNA, 444 bp, Homo sapiens
tggtttttcttcttggttcagggaaaaggactttatggggatgtagttgggaaccttgaaagggtgaatcccaggaaataaaccctaggaccaaggggggggccccttaaaaagccataaataactcttaaaaaataatttagggtgaggaggtcccccgtgtggggaggctgcgtgggcaactatcgtgggacattcctatagggagtggaatttggagaattgggcaacgggggacactaaaaatttcccagccgctcctcacaacagggggtgttgaaatgtgatccacttcacaagaacctcccggacgtgcccatagtgcgtggaagatggggagccgggggcctccaggacaaagggagcggccgtgggccccggcgtaaagggggtgaaggggcccgggctcacggcctccgccccccagggaagccggacagctgg

SEQ ID NO: 559843 - DNA, 143 bp, Homo sapiens
tctaacagtgggttaaacagtgtctttaatgtggcccagttaatagacttaaggcagataaggtccaaggtcttccaagggctggtatatacctatctaagtcaaatccgggtgtcctccatcattcacttccacttaagagt

SEQ ID NO: 559844 - DNA, 761 bp, Homo sapiens
tgttgatccgtctgcgattttatctgttaaccaaataaaagataatagaatttcctaatgagatatatctttatacttaaacagctttttgagaggtgagttttaagcgaagtctcttgagttactgatgctaggttgtgtttaaaaccactatgcgaagaactcaccagaagccaccttttgtagtgttctccactaatactggttatcctgtgctacagagaaaatcaacagcagtcataagctccagtttgtgcgtattgcaaataagactcttacctacaagcatgagattcatgtcgaactaactttggtttgttactcaagccaaattaagaaaagtttgattgtaagggaagaattagcaggttgggtctatgtgcagaatcaaacgctttttatattttatactgcactttagtgtattttctgtcactgtaggtatagaagatctgcgctcccctgtggaaattggggtctggttggtgggcttgcccctgaagcctggctctgggttgaagaagtgttcccgccctaaggccttggtgccctgaacctctgatgcctaccgggttctcctgattcgagttgcctttaaatactcccttgtagagtaactttgctcgatgggagcaacagtagcagtcatcatctccttggtgtgcaggctgtgctcatttatttgcaggccatggtcgtttcattcattgagtgtacatatcaaccgggtgtcatgtcaaagtgaaagacatttcaaatcg

SEQ ID NO: 559845 - DNA, 193 bp, Homo sapiens
gttctgcatggcatcctcttcctccttcctctcagaggacacagaacggtgctgtcgctatgatggtactttctgagtccctggctggccagagacgattcctggtggcagcaactgatacacctggtagggctcagcaagcatccatgcgggccctctcaggaacctccttaaattcagaactctggtggag

SEQ ID NO: 559846 - DNA, 330 bp, Homo sapiens
cttttttaaacccccccccccttgggggggggttttttgttttttccccccccccccctttttttttggggcccccccggggcccgcgtttttttcccccggggggggggcctttttttttgggccccccggggttccagggaaccccttaattgttttcccccttttccccccgggggggggggtttttaacccccccgggcccttccagttttttttaccccccggggggggggggggggggccccacccccggccccccccccctttttaaggggttcccctgggggggggtttcccccccctggttaaacccatttttttttttta

SEQ ID NO: 559847 - DNA, 202 bp, Homo sapiens
attaaatacatcctagccacaaactgttcagggaaccaggtacatcccagcccattgtcttgcacctggtaggcactccacagaatgctcacagggctactgcccatgccactcaccctccaagcctgcctccttctaagtgcagaagtaaaaattcatctctcgccctggtgcacacctggagtccccaggtgcacttaac

SEQ ID NO: 559848 - DNA, 174 bp, Homo sapiens
ggtgtggccataaaaagaaaaaaaaattattgcttctttctccctgtttcatgcccacattgagccagtcaccaagttcttaatttctcacctcctctccttagtgctacagccattgtttgaacactgatcctgtctgatctactgtaataatatcctagccagtctctatgt

SEQ ID NO: 559849 - DNA, 661 bp, Homo sapiens
cggtctccagttgcctcctgactgatatccatggaagagaaaagttgtgacttgggcccccaagttgtgagagaactgggcttgcggcgcggggggacagaggaggctcgtggggagcttgccccatggagcttacccagccgtgcagaagacctcatccagacccagcaggacccctggctcagaacttggggaccctgaagaccccggagaggaggctgcagatggctcagacactgtggtcctcagtcgtctttcccgtgcacccctgagcctgtgaatcctgaaccggatgccagtgtttccgtctccatcagggcagctccctgaaagcactccaccgactcgtcgaccaaccggacagaggagggaacgaggtgtcagcgtcgtgccgggccaaccctagactccctgtccaatccaccagctcgcgagcacagggggagctggaccagctgaaggagcatgtggctggaaaggtgacaacctcggcaacaagccagacgagcgcggcttcaggctcgcctctcatctgggtcctccgggctatgggagacgattgaggaccgttgcgcttcctagctggagtggggtgccgaacgcccacatcctggcgaaaagagcgagagagcgccctgggcggtggggcagcacgaggcgg

SEQ ID NO: 559850 - DNA, 439 bp, Homo sapiens
  misc_feature (8)..(8): n is a, c, g, or t
cctttgangtctttcagagcatgctcttgcgtgcccggatgaaagactgagctgggctgctttgccaatccgcatcactcccagagcaggcgttgagcagaatgggaaccgatgccataatacctgtcgaccagctccggtttgctctgggtctctaccagataaccggggctgacatatttgttccaggcctcttgaaatgtcgcgacccttttttgatctgcccagtagatttggcaccggatgatacgaactcacccgtggttcgaggcgaccggccagatattttttaaaaaataagcgctcggtctcctcatcggggtccggcggcagaggaaattcgtactttgggattatgaaaggctggccagccaccggggccaatacctcgctcatagcctggttaaaggtcttgttgtcgtcttgggagccgttttct

SEQ ID NO: 559851 - DNA, 342 bp, Homo sapiens
aggaggccaaggcgggtggatcacctgaggtcaggagttcgagaccagcctgggcaacgtggtggggcctcgtctctactaaaaatacaaaaaattagccgggcctggtggcgggcgcctgtggtctcagctactcgggaggctgaagcaggagagtcgattgaacccaggaggtggaggttgcagtgagcggaagtcacgccactgcattccagcctgggtgacagaacgagactccatctcaaaaaaaaaaaaggagggaaaacctagggtaattttcttcggtttaacccccccttggggaggctggcctaatgagggggaagggcggtttttgaaatt

SEQ ID NO: 559852 - DNA, 487 bp, Homo sapiens
tccctttttccccgggcacccgccttggccctgctttcgccttttatcggcccccccttggggggctttggccccgggggcccggctttgggccgggggcccccctttttgcgggtgcccctggggctgtcccccacccccctctgcccccaggcccgcgtggggcccgggggttttttggggcttgcttgcggtccgcgtcttcccttccggggggcccccctttcttccttggggggtttggtgtgggcgctggtttccgcccggggcccccccctgggggggggttcttgccgggtgggcctttttcccggggcccttcctggcctggggggggccttttccccccccccccccccttcccccccccccccccccccccctttcccggttttcccccggcccctgctgccttctctgtccctctgtctgtttcttttttttggggtttgttggtctggtcccctttccccttccgttttataga

SEQ ID NO: 559853 - DNA, 399 bp, Homo sapiens
ggagtgtctagaggatcccgggcaggtgctatgatgctgctcaggctaaccaggtccggggcctgttgcccaccccctgtctttcatgtcacgtcgaggaagttgccctgaactctcggtgacactgctgtcagggcctgacttaccaggagagcatgaataattaaaagctgtagctgaggcttgttccgatttaaactgtattagtgtggccaacggtcctgacccatttaatattcatgccattcttggctcctttaaagagaggggagtttgctacctgatttaaatggtgcctgtcagtttcgatactgctcaggcctaacccaggtcccggggccctgttgcccccagccccttgtctttcatgtcacgtcgaggaagttgcctgaactctcg

SEQ ID NO: 559854 - DNA, 320 bp, Homo sapiens
  misc_feature (17)..(17): n is a, c, g, or t
  misc_feature (25)..(25): n is a, c, g, or t
  misc_feature (308)..(308): n is a, c, g, or t
cctctagcctgggcaanagagtganagtgtctcaaaaaacaaagaaaaaaaaactccctgggtcccaggtccggtactcacacctgtaatcccagtgcttcaggaggctaaagcgggaggattacttgaggcaaggagttcgagaccaggctgggcaatatagcaagaccttgtttctacaaatatttaaaaagtagccaggcatgggggtgcatgcctgtagtcccagctactctggaagctgaggcaggaagagcgcttgagcctaggagtttgggctgcagttagctctaattgcaccactgcanctggaccctggg

SEQ ID NO: 559855 - DNA, 955 bp, Homo sapiens
gcgcaacccacagatgtgggggtttcccgctggggaccaccgaaatatgtttttttctagagaggtgtgctaaaagttgggcccccaaagagaccccccatatagttttggtcgggccgctttccaacgagggtttattgcaaatagcagcttctctcggggggggacaaatctcttgttagatatacacacctttctttcgcggtggacaaatcgcggttgttggggggcgacgtctgactcacttggggcgcagaatacataagaaagatgtgtgggtggccacccactctgtgcccgagatatgtcgtgaggcacgctctgtggtccgcacatgtagcacaaccaacactagcttttctctctcacgagagttttatatagagcaggagatctttggtgcacgaacaaacaggacttaataatgtttttgccggcccgacagatagtctctttcactgcaaaacccctccttggcccctaaattaatagtcctgtgtgggtcacaggcacacaaccccctcttcggttgcacacctccgtgtgtggcgtagacaacacaaagaccgccatctccgcctctcgtgggtgcacagctcacggcaacgtgcttgcaggggcgccccgagcgcaaacacactctgcaaggggtgccctggattaatgttatgggcccccctccccgctggaggtttggtcggcggttcctttaaaggactttttatcacagaaatccacagtcttccctcggagaaccctgtgtggcacgctctaagctttgcacgagttgggtgtataatatggcccaacaaggactactgcttttttttcccccacatttcccccacaggttttagagtcatgggggccttgcggttattctccgggggggccccaggggagattcccccggggtttttgggtccaaaataaaagcctccgggaccccagagga

SEQ ID NO: 559856 - DNA, 702 bp, Homo sapiens
  misc_feature (244)..(244): n is a, c, g, or t
gtttggtgaatttcgtggttggcccacgcacgatcaaggttcaatggtggttcggaatgggtaaggaaggcccccggtgacacgaggccctacgccaagaacggccgtttttaaagcaacattgaccgctccctgctcaagacctagagcaggtgttggagaacctgaattaaaaggttccagctggtggatcaaggttcaagggcggttcctgggcaccagccggagccggatgcagtaggantggactcgggccatatccgtggtgccgtcaacatgcctttcatggacttcctgactgaggatggcttcgagaagggcccaaaagagctccgtgctttgttccagaccaagaaggtggattttttgcagcctttcattgccacgtgccgcaagggagtccccgcctgccacgtggccttgggtgcctacctttgcggcaagcctaatgtggccgtgtacaatggctcctggtccgagtggttttgccgggcccccccaaaaaaccgtgtgtcccagggaaagtttaaaaaggcctaacccgtgaccttttttgcttactgtaactgcggccggtttagtgaccccatgacttacagccggtttttaccttttaggtgaaggaaatgacatgtttttaaaattgctgggcaaggctccccctttttttgtcaacactggaataaactttgccttttttga

SEQ ID NO: 559857 - DNA, 1194 bp, Homo sapiens
gggagagacaagtaaactctcagagtaactgtcccctctgactaccatttctaaggatgccccggaggcccagctagccccagacttcggccccatgcggctcacccgctgccatggctgccctggctggcgcacatacaccctcaaacttcttggtcctcattctatgtctcgtggctgcagcaccatgcctaggaattacccgggcccggtgggacccgatcgtgcctctgactgcctggaccccgtgtcaccgtcctggtgcgggagttcgaggcataggacaactgctggtgccctgagctggatagactccttcctgcaggcaagacccagcaccagccacgtggtggtggcagccgacacgctcccctacgccgaaccctggccctgccccgaatcccacaacagtgcgtcatggcagcatgatccagaagccgacctgtgaccggcacagccgcagactcgaagcccggaagacctacgtggacaccgagattagtggaccctagtacctgactggcggcgcggggactgagagaaacctgggcacatgaactaaagcagacactgcgtcggagagcagctccagagcccacgcaaacagacaagatcaatgaatgacacgcccccgggatggacacgggcacaaacccatgcaagcgcagccctgggccacaagacaaagggccagcacctgcgccagcagtgaggacccagacccgactattgggcagcaaagaccaccggcacgagcaccagagatcaagagacgacacgagacaggcagacacggtgagagcgggaccctggcacacgcacagcgagccgcaacaaacacaccaacaggacgcacacccaaagggcacaggcgaggaagagaacaccacgaactaaaacatgaaggagaacgccaacagaggatggcacgagcgcagaaccgagaggatcgagagcaatgaccgacgcaggagcaccaacacaccacgacctggccgcacgcacccaccgaccgacacaaaccgcagaaaccacacgcgacacaacagcaaagacaggaaacaagaaacacacaaaagagacaaaggaccacaacagaagaaacaacggcaccagcgcgagcccacaacgcacagctagcaacacaaccacccccaagccaacacacgcaacgacgcagcaacctccccaagg

SEQ ID NO: 559858 - DNA, 376 bp, Homo sapiens
ttccgggggggggcccccccaaaagggggctccccctttgtcccccaaagggggggggcaacccaaacccccccatgttgaatgtggtggccgaaccccaacagggccccccggcgggggggttccttccctggatgggggggcaaaaagcccccgtttgttttttcccttgggaggggcccccctgggggccccccacccctagaccgggtaaatttccctcccggggccccttttgaatttttggaggggtttttttttttccccccctggggggaagatgtttttcccaagcccttggggggccctccccctttttttcccccccccccggccccctggggggggccattaaataaagggatttttttttcca

SEQ ID NO: 559859 - DNA, 140 bp, Homo sapiens
  misc_feature (132)..(132): n is a, c, g, or t
gatctctatgtctcgacgttagtaagtagcatgaactacataagtgacgctctagaacgtggtagtgcatgaggaaggattttatcttatgtgattttaattggcttaaactttaaacaagcgcatgtggtntactgtat

SEQ ID NO: 559860 - DNA, 114 bp, Homo sapiens
atcgcgcaagttgcattacggcgctactccactgccctggactcaacgttgctttgccgggcagttggggccacggcttgtctcaacagaataaggccagcatcgatacatgca

SEQ ID NO: 559861 - DNA, 322 bp, Homo sapiens
attttaggtagaagagttttgaggctgggcgcaatcgtcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgta

SEQ ID NO: 559862 - DNA, 320 bp, Homo sapiens
attgtcattcagggggatgaaacgaatgcattggccatgtcctacagagtccagattgtaacagtgccctgatggatgaagaagacatggacgacgtggtaggatgtcgacaattacgctcatcccacagcgagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagac

SEQ ID NO: 559863 - DNA, 230 bp, Homo sapiens
agcggcccgcctttttttggaaacaggtctcactttatcatccaggctggaggcagtggtgcgatttcggctcactgcaacttcaacctcccgagttcaagcaattctcctgtctcaccccccaagtatctgggactataggtggcgtctggctacagtatgtttccttcttttttttttatttgagacagagtctcgctctgtcacccaggcgggaggggtacggagct

SEQ ID NO: 559864 - DNA, 272 bp, Homo sapiens
  misc_feature (33)..(33): n is a, c, g, or t
ggatgacatgatagaatcgagctcggtaccagnacgtccattcttgctagttgtagaatcataggtaagtcatgaacctctctatgctgccgtttccttactttttaaaattagaaatggagtctcactatatgtctagtctcgatctcctgacctcgtgatccacccacctcatcctcccaaagtgctgggattacaggcgtgagccaccacgcccggccctaaatcatggttaaagctttcaaatgtatctggcaattccttcaatgagt

SEQ ID NO: 559865 - DNA, 343 bp, Homo sapiens
tgtgttacccaggctagagtgcagtggcacgatcccggctcactgcgagctccgcctccctggttcaagtgattctcatgccttaacctcctgagtagctgagattacaggcgtgcatcaccaagctcagctaattttggtattttttagtagacacgggatttcaccatgttggtcaggctggtctcgaactcccgacctcaggggatctgcctgcctaggcctcctgaagtgctgggattacaagtgtggaccaccgtgcccagctggttttctgtttcatacatcagagtcaacttgtgaatacatttaaagattatttcatttggatatcacgaagaaa

SEQ ID NO: 559866 - DNA, 178 bp, Homo sapiens
ctctgaggatccccgcggcctgctgctcctggatgatatctttgccacttatccagcggcacctggaccacgttggccgcgctgtttcccggcgatgtgaaccgcctgcgcaggatgtctgtgatcgaggagggggactgcaagcggatcatgattgcctcctacgggtgattgggag

SEQ ID NO: 559867 - DNA, 188 bp, Homo sapiens
ccggcggagaggtacgccgtatagcagacggttcggcttgatcgacggcacggccgacgtgctgcgagctgaacaaggccttcaactggagctgtccggtcaacgtaggcgcgcaccgtctaacggcatgctgctcgaagagctggaagagatccccgaaatcggcacccggttgcgtatcggccatt

SEQ ID NO: 559868 - DNA, 181 bp, Homo sapiens
atcattgattagacagaataatagggtatagtagtgcatttgtttggttattgccatattccaagatactgagacaaagtgcttgctctatatttctctcatggtcatacacttgggagatcctcataaagttcgaccgtgcaggctatgcaacgcttggacacgtggcctgtctgtttta

SEQ ID NO: 559869 - DNA, 907 bp, Homo sapiens
  misc_feature (90)..(90): n is a, c, g, or t
  misc_feature (842)..(842): n is a, c, g, or t
attatccaccttctcggtcttagcgtggctctccgtgtctccctctctatctccatctttatttctgtctctctctctatctctctccangctcccctctcttatctctgccccaccccaccccgtctctatttttctttctttcctggcgttagccctctccctctccctgctctccttttctctctcttgctctctctctctctctctctctctctctatttctctcccttctctgtcctggcagtgcttggtttcctgtgtgtgcctctgtctcttttttctcactctcattttcacccttcgcttctcctttgtgtctctctcttcctctctgtagtgtaaaggatctctctcccctttctctgtttctctctctgtctctttctccctcctgtgtctccgtctgtctctgtcacacacacctctctctccttctctctctctgtgtctctctggcctctctcttacattcagtctctgtctgtctctatccctttccctctgtctcccctcaaggtaaaggagagagaaagagaaagagagagagagaaagagagtatgtgtgtgtgtgtttacattcacccaggtgcgggctgttccacagtctgagggggctgtcaggccttgaagggctgaaagggagcccaccaaccccatttctgctcagcccgctgccctagcactttctacagtactagtggggcctcctgtcatgggctctgagatctcagcgctgccattaaaaagctggtcgggcgcagggctcatacctgtatcccaacacattctggaggccacgcgggcgactcatctcggcgtaccagttggaaccacgctgntagcatcacaaaccccgctctttctaaaaccacaattacccggtgggggggggcgagaaaaccga

SEQ ID NO: 559870 - DNA, 210 bp, Homo sapiens
ccaggtaactgaaaagcatcaagacaagctgttgtgtatggagtagatgacaatcaggattatactaggcctgtaatcaacgaaaaacataaagatctaataaaagatcgggctctcagttctgctgcagcagaaatggaagaaagaaaaccactgactacatctggatatcaccactcagaggtatacatctctatctgtgtacctact

SEQ ID NO: 559871 - DNA, 191 bp, Homo sapiens
ctctttcttcacacctccagtcctccacccaccctcgcttcccagtcgcgtacgtgtgcagttcacaccaacccccaccctgatcggccgcatctgcatcgggagcgtgaaggaagaaaaaataggaggccatgacgctgctgtgtgtgccgctggtggggcggacggtcgaggagatgaagatcgacgcg

SEQ ID NO: 559872 - DNA, 414 bp, Homo sapiens
ttataatacttcacagcgttcttcgaacgtcttatcatgcgccacccctagagatgctcgctgcacaaatgctttcctattcagacctctaaaacaacgccagaccccacgtctctccacccttgggaggcgcctggaagcaaaagatctaccgtcgttacatagagatcctctccacatgcatcttcccccccacacaagcaccacgctctgccgcacccttctcacaacatggcaaagaaccatgttttgggctaaaaccttttgactttcctccttgtcacatgtcacgcccgagtcagaccggaaagcaagtcacccctatatagggttaaataaaactcatctcatcacactttatcgtttgttgggcctcactccccaggccccttagctaggaatttgggccagatt

SEQ ID NO: 559873 - DNA, 108 bp, Homo sapiens
gttattcccagcccctggccccccccctaatattattgcccaaagtcaggatctcccatttccccccaggctcaactgaggatgtggcttattaaacccggaagtgca

SEQ ID NO: 559874 - DNA, 128 bp, Homo sapiens
aatcatgatggaacttcacattgtgactacttgccttgatcagagtctctctttgtccgtggatggtgggaccccaaaatcatcactaacttgtcaaagcagtccactctgaattttgactttccact

SEQ ID NO: 559875 - DNA, 221 bp, Homo sapiens
cctgttgggaccccgcttgggctttggtattgactgaggggctgacagttttcttccacccccaactggcttgggggcaggccaagggttaggcttaatggtggccaggcttgcctgctccccccctgggatgcccctgctttggccctctcattttttttcattggtttatttttcaaggcatctttaatttgtaaagaaataaaataaattaagatgta

SEQ ID NO: 559876 - DNA, 259 bp, Homo sapiens
tgccgcgtcattactagaggatccccaagcagttcatacagattcattttcatggtttggtagagcttcaatttggtctaagcctccacattcttcaatcattatactaagtttctcaggtttcacctagtttctcagcagcctgaagggatatttggaaagggcatccagggataaccagaaataatctgggtatctattggcagtataagaggttcatcaagcggttctatatatgccacagctgaacaaggtacac

SEQ ID NO: 559877 - DNA, 360 bp, Homo sapiens
ctactccccgcggagaggaggacagcatgccccccatcagcactccccgccgttccgactccgccatcctcgttatcaatagcctgtgcccatgcccgtacccgtgcaatttcaattgtattagtaagtcttaaataataccttgcatagtctatcactgagctagtatgttgtactgagccacaaccaagtacttactatattctctagcagcagtggaagaatgagtattgttaaaaagtcgatactcccaaaatgattctgcagagtgagtcaatgcaatagctatcaaaatagcaatgaattctttacagaaatagaaaaattagggatcctataatttttatggaatcacaaaag

SEQ ID NO: 559878 - DNA, 602 bp, Homo sapiens
gggtttagcacagtgtgtggtacacgataagcactaagtgaatgattgttattattattatcaatggtaaagtagctaccatttctgagcacctatactaggctagacactacaaatcagttatgttatggtgtctgtaccatactaaagctgttggttagcaccaaactaaagctgaagcctcggtgaagtattttgtttctgaagactgactctgatttcagtttgggacccactctggaacctgaggaagtggtaaacaggctgatgcatgggattctgactgagcagaagatgatttttattccatcttctatagcttttttaacaacattggaaaggtaagtgacagttaagaaaccttagaaatgaaaggtaaaataacaattatctattgcattttttactgacatttaaatcaggcagttgataaagtacagttaaatggaattgacttaataaaaataacaggctcaataacattgaggcaagattgatacagctcttgggtaaatgaaccgagtaatttccacacatttttactttttgtaaagaaagaaatttgtatatttctgcaagtcttgtcttataaatgaatgact

SEQ ID NO: 559879 - DNA, 571 bp, Homo sapiens
tctcccacttgggccgaattcggcacggaggctcttcagagtgatccaaccagaactgctgggaccccagaagttcgtatccagagaaatgaaccagaaaggtactcacaagatgctctcaacgcttctgtctgacacaaagcaacactgtccttaaagtggtgatcacttgatattatttatgggataacaacttccggttccccttttcctgccagctgtgcatgctgtggtaaattccttagggaaaagagggcccattccaagccaaagattttagagcatgaatttcaaagctttagttttaaaacaaaatggtatatcctcagaatgacaatggtgcattttattgagactatttttagttcaggtctggaaatggctgggtgggcaaagcacttgtcacacaactgtacagatctgagttcagatgcaccgacatatataaagccagatgtagtagtggcagtttccacagtctcagcactcctgtagtgaggtggaaggcagaggcaggagaagctcacgggtagctagcctggagcaccagaggtgagatggcaactgagac

SEQ ID NO: 559880 - DNA, 368 bp, Homo sapiens
  misc_feature (17)..(17): n is a, c, g, or t
  misc_feature (31)..(31): n is a, c, g, or t
  misc_feature (53)..(53): n is a, c, g, or t
  misc_feature (195)..(195): n is a, c, g, or t
  misc_feature (197)..(197): n is a, c, g, or t
  misc_feature (204)..(204): n is a, c, g, or t
  misc_feature (331)..(331): n is a, c, g, or t
  misc_feature (344)..(344): n is a, c, g, or t
cagggctgcaggaattnggcacgagggagcntaccccagcttggtaaagcacntgtagccagacatgcctctctagattcctcctctgtgggcagggcatctccgaaagaaaggaagcggccctagtaaggcacttactacatagataaaactcccatttccctgggacagagcacctgggggaaggggcagctntnggcgcanttcaacagacttaaacattcctgcctgctggctctgaagagagcagcggacctcctagcacagcactggagctctgctaagggacagactgtctcctcaagtgggtccctgatccccatgcctcctnactgggaggacanctcccagcaggggtcaacaggcac

SEQ ID NO: 559881 - DNA, 961 bp, Homo sapiens
  misc_feature (22)..(22): n is a, c, g, or t
  misc_feature (24)..(24): n is a, c, g, or t
  misc_feature (32)..(32): n is a, c, g, or t
  misc_feature (45)..(45): n is a, c, g, or t
  misc_feature (49)..(49): n is a, c, g, or t
  misc_feature (54)..(56): n is a, c, g, or t
  misc_feature (63)..(63): n is a, c, g, or t
  misc_feature (65)..(65): n is a, c, g, or t
  misc_feature (70)..(72): n is a, c, g, or t
  misc_feature (78)..(79): n is a, c, g, or t
  misc_feature (82)..(82): n is a, c, g, or t
  misc_feature (92)..(93): n is a, c, g, or t
  misc_feature (112)..(112): n is a, c, g, or t
  misc_feature (116)..(117): n is a, c, g, or t
  misc_feature (168)..(171): n is a, c, g, or t
  misc_feature (173)..(173): n is a, c, g, or t
  misc_feature (176)..(176): n is a, c, g, or t
  misc_feature (178)..(178): n is a, c, g, or t
  misc_feature (180)..(180): n is a, c, g, or t
  misc_feature (185)..(186): n is a, c, g, or t
  misc_feature (348)..(349): n is a, c, g, or t
  misc_feature (392)..(392): n is a, c, g, or t
  misc_feature (398)..(399): n is a, c, g, or t
  misc_feature (405)..(405): n is a, c, g, or t
  misc_feature (407)..(407): n is a, c, g, or t
  misc_feature (409)..(409): n is a, c, g, or t
  misc_feature (436)..(436): n is a, c, g, or t
  misc_feature (514)..(514): n is a, c, g, or t
  misc_feature (525)..(525): n is a, c, g, or t
  misc_feature (574)..(574): n is a, c, g, or t
  misc_feature (646)..(646): n is a, c, g, or t
  misc_feature (694)..(694): n is a, c, g, or t
  misc_feature (702)..(702): n is a, c, g, or t
  misc_feature (706)..(706): n is a, c, g, or t
  misc_feature (720)..(720): n is a, c, g, or t
  misc_feature (774)..(774): n is a, c, g, or t
  misc_feature (802)..(802): n is a, c, g, or t
  misc_feature (811)..(811): n is a, c, g, or t
  misc_feature (841)..(841): n is a, c, g, or t
  misc_feature (862)..(862): n is a, c, g, or t
  misc_feature (893)..(893): n is a, c, g, or t
  misc_feature (896)..(896): n is a, c, g, or t
  misc_feature (930)..(930): n is a, c, g, or t
gagaggagcgtggctgtctccncnctccgccntggcgtgtgcccncccnctgcnnncggtgtncnccgannngggggnntcntctggcaaanntgtcactttgcctgctgtnttcnnggctcctattcgaccagatattgtgaactttgttcacaccaacttgcgccnnnncnccngncngcccnntgctgtcagtgaattagcaggtcatcagactagtgctgagtcttggggtactggcagagctgtggctcgaattcccagagttcgaggtggtagggactcaccgctctggccagggtgcttttggaaacatgtgtcgtggaggccgaatgtttgcaccaaccnncccctggacgccgttggcatcgtagagtgaacacaaacccccncccgcnncgcccncngntctgccctggctgcctcagccctcccngcactggtcatgtctaaaggtcatcgtattgagagaagttcctgaacttcctttgagtagttagaagataaagttganggctaccagangccccaggaagctgttttgctccttaagaaacttaaagcctggaatganatcaaaaaggtctatgcctctcagcgaatgagagctggcaaaggcaaaatgagaaaccgtcgccgtatccancgcaggggcccgtgcatcatctataatgaggataatggtatcatcaangccttcanaaanatccctggaattantctgcttaatgtaagcaagctgaacattttgaagcttgctcctggtgggcatgngggacgtttctgcatttggactgaaagngctttccgnaagttagatgaattgtacggcacttggcgnaaagcgcttccctcaagagtnactacaatcttcccatgcacaagatgattantanagatcttagcagaatcttgaaaagcccagagatncaaaaagccttcgagcccacgcaagagaatc

SEQ ID NO: 559882 - DNA, 156 bp, Homo sapiens
gtgtgtgtggtgtctctgtgtatgtggggtgtgtgcgtgtgatatgtagtgtgtgtgtggggtgtgtatgatgtgtgtgtgatgtgtgtatgatgtgtgtgtgatgtagtgtagtggagtggtctgtgtgtggtatctgtttgtggaggtagcact

SEQ ID NO: 559883 - DNA, 752 bp, Homo sapiens
ggttgagagctaaggcagacatcaggactaccagctgcagagaggagctacccacggtgggcttcgtctctgctgagagctgaacactcacgtgggacgccctgcctatggaaaccaggtgttcactctgggtctcctactgagctgttctgtcgctcagtaaaggtcttcttctgcttactcgccctccattggtctgccttacctcattcatcctggacacaggacaagaacttgggacttgccggtagtggtggagctaacatagctgtaacagaaacaggattgaaagcatgccccttgctcgccaacattgtgtgatgagcaacgagggagggaagaaaggagagaagatctgcgacccgtatacggtaaagccagacttaggaagatcggagacggcaagactgtgacagccttgtctggggctctgtggttcctggcgtctccaagcttctgggcaccgtacggcttgccccggtgccagtccgtgaagactgttgtcgcggagtcttgcttagtcaaccgaggctggagtacagtggcgtgatcacagttactgaaaacgtctccggtatcaaggttcaagcggattttgctgactccaggctctggtgtaagctgggaattaccaggttagcagtccagctgagtgcttcacaacatgagaagactgggacatcccatcagattagaacaggctgcaccaaagggtctaaactactaagtgagcgggttggaccatgaaccca

SEQ ID NO: 559884 - DNA, 448 bp, Homo sapiens
cagatataatcctatccgtttcctatctctggtaaaacttttcttattctaattattttctttgctgtactggaacagcttgtgccttcaggtcttgcctgggcacctgggtagcttgcggcccacaagataggatatattgcgttgaactgtaatttatgttgattgctgagtgattagcgggaaaggggtgagcaccccctgaaattctgccctagaggagtggcctcaccctaaccctggccatggctggtaatagggcccacctcttagggccgtggagtgagataagttttccaggtagtgcgcagtggagccctcagccctccgctgaagttgcgtagcgatcggaggaagggagaggtgaatgctgagcccgcggcgacaggtctgtgcctcggagagaaactttatcccaaccttgctgggggccttgacgcccaccttg

SEQ ID NO: 559885 - DNA, 139 bp, Homo sapiens
  misc_feature (65)..(65): n is a, c, g, or t
ctgggcgcgggggagaggcgggtctgtcctcgaggaactgcaaggccctggtgagcgggaggacntgggatccctgtgccagcgtgctgctgtgtagagcgttcggaagcgttcacgcgtgcggtccgctggtactaac

SEQ ID NO: 559886 - DNA, 482 bp, Homo sapiens
acatcttctgaatcctagaatgctataatatctgggctttcaaaaactcctccagaatcaccaatcagtctattgtttagatatcaatcctcattcattatataattccctcattctaagccttatcttctaccactttcaaccatatcatcctctatcattatatagagcgtcattatatctgtactccaactctttaggaacatagggcatctaatatcttgtccatccatgaatccatcactattgacatcatgtcattagtaaaatgtcttgtggtctaagtcattaggatccaatccatacagtctcttactccataacctacttatatgttgatactatggcttcctgaggtgattaactttagggtgcttttcatgctttatgttcattttcttcaatacagacgcttcttctttgtactcttttcttgcattccatgtttttaaatatatctctcctatttcatgtatccttca

SEQ ID NO: 559887 - DNA, 143 bp, Homo sapiens
ttgtcgaccacgaaacaggatcacattggtcgccggactcgatcaccgtgtcgtcgtgggcgatcagacctgttcgtcgcggatgatggcgccgatggtggtgctcggtggcagggcgatgtcttcgatggcgcggcggatca

SEQ ID NO: 559888 - DNA, 885 bp, Homo sapiens
tccaagttttgccattagggcccctagcggtcgcgggcaagtccaccctgggccgcggtttttgaggcctgtctcgcccgtatcgtgttgacgacaccacgccaccagagaacatgttgcgccttctcccctcctgtcggaatgcaagtgcccgcccctctttggcgtgcccccccttggtgggggcccccctctatgcttctatcccgtgcaagtggccccacctgtgaccagggtcaggccacccacccttgcgtgcagccaccccagggcgaccacaagcacgtgctcttactgcttcccccagctggggccccccagcgccccccccatctgagggtggcagcaaaaaaagcccccgcccctcgggcggatttcccccaaaagggaacaagcagcgttctcccacgagatcctctctctgcgtggcgccatacacaagcacaggccccccactgccccagggtaacacagtcttcaacacgggtggccccccacggggagcaccgcacgaccccatacaaaggaagcggcaccacgccagacaccaacatcagcgcagctacactgcaccacctggatcggcacccagtcggtctttttcgaggcccattctgggggactcgagtgtggtctcaacgcaccgcgggacacctccgcgccctggctccgcctccaccactcacacaaggccatccaccctttcacaggccccccctgttgggtgcgatttcgtgtatgatgcaccccccctccggtgtctattgggcgcctccccccccacccagcccgccttctccctcgcccccgcccgccccgcccccagggagccccccccggccgtgctccccccaaaataaaaaccaaatccccccccacaaaaca

SEQ ID NO: 559889 - DNA, 1500 bp, Homo sapiens
  misc_feature (924)..(924): n is a, c, g, or t
  misc_feature (948)..(950): n is a, c, g, or t
  misc_feature (956)..(956): n is a, c, g, or t
caagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctgtgtcacagactggctatggttaagcgacttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtnattcctgcttgtgtgatttagttnnngggttnctttgagacagggtctcactgcattgccctttgctgagctcaaatgctggggttcaaagcaatcctcccagctcaaaccagaagtagctacgactgcaagcacctgccaccatagagggctgcatatttgccagccatagagggctgcatgtttaaacaagcctagggaagtctaacattcatctgactatggaccacaaggcaagcaagtacccgtgatttacatccttagcttctaaaagaatcgtccaaagttgcacacaaacgtgttcctatccccagttagagacacaggcacttaccagggccgtagatgtgttcttaacgagtacagaagggatgcaattaataaagggctcagctggacgcgttgccaagacgatgtctagcgtgagtgaaatctgggtctaattgtgcacctcctgttgcatcattaaattgtgccaccgccatcaacatgggaagccgggtgtgagaccgtgcaattgtactcgaggaatgaaggaggcagacaatggcagaggcactatgtcgagaagtctag

SEQ ID NO: 559890 - DNA, 787 bp, Homo sapiens
  misc_feature (18)..(18): n is a, c, g, or t
  misc_feature (102)..(103): n is a, c, g, or t
  misc_feature (107)..(107): n is a, c, g, or t
  misc_feature (114)..(114): n is a, c, g, or t
  misc_feature (127)..(128): n is a, c, g, or t
  misc_feature (137)..(137): n is a, c, g, or t
  misc_feature (157)..(157): n is a, c, g, or t
  misc_feature (169)..(169): n is a, c, g, or t
  misc_feature (174)..(174): n is a, c, g, or t
  misc_feature (176)..(176): n is a, c, g, or t
  misc_feature (178)..(179): n is a, c, g, or t
  misc_feature (189)..(189): n is a, c, g, or t
  misc_feature (192)..(192): n is a, c, g, or t
  misc_feature (194)..(194): n is a, c, g, or t
  misc_feature (196)..(196): n is a, c, g, or t
  misc_feature (200)..(200): n is a, c, g, or t
  misc_feature (286)..(286): n is a, c, g, or t
  misc_feature (289)..(289): n is a, c, g, or t
  misc_feature (305)..(305): n is a, c, g, or t
  misc_feature (308)..(308): n is a, c, g, or t
  misc_feature (323)..(323): n is a, c, g, or t
  misc_feature (392)..(392): n is a, c, g, or t
  misc_feature (394)..(394): n is a, c, g, or t
  misc_feature (430)..(430): n is a, c, g, or t
  misc_feature (439)..(439): n is a, c, g, or t
  misc_feature (515)..(515): n is a, c, g, or t
  misc_feature (577)..(577): n is a, c, g, or t
  misc_feature (596)..(596): n is a, c, g, or t
cactgtaagcctgcccantaggcagtgttttgcagactttggggagtggtctatgtggccaaatattgtgtgtatagacagaatttgaaatcaagtcctgcnncatntacaagnattttggtgggcnncgaatcctncataatgaaaaagaaaaacngcccatttaaanacccngncnngattatatgnaananantaantactaaaaaggcacaagattacactgaacatattagctactaaaaaggcactgctaagacattcaagcaaatagccattacacacnacngcagattttacaggtnccnaattctaacatatgntggaaaaacccgggagtatcccaaaatatatttaataatggaatatctgcattaatataccacccatgngnttttaccatttgccctaatattgaatatactgtttncctcacacnaaaaagaaaaccagaagccttatttgtgattttgggagtggaagcttccatttttgtgtcaaaaatgaatcctgantcttatggaaatctctgttattaagatatttcaagatgagacaacactgaagatcaaattgngtttagtatcactatcttntctcctcgtttctctcttactcctcagtactccgggaatctaccagtttatggtagaaagatgggaaccttaattgaatgtgtatttttaaaacatgatgtccaaatttgtaaaagaaaaggatttgaataaaattatagaataaatttaggtagaaaatataattacaaatttaaataaaataatgtttt

SEQ ID NO: 559891 - DNA, 822 bp, Homo sapiens
caagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctgtgtcacagactggctatggttaagcgacttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtacgtttcagaaaacagggcaaccaagattagctggccagggaggttgaggagcaggctggtcactggtacctaggcatttctgagcttcagcctctggatgtggctgctggagaccatggagatctgctactcagaggaggtagtgtagaggccggatgttt

SEQ ID NO: 559892 - DNA, 430 bp, Homo sapiens
  misc_feature (35)..(36): n is a, c, g, or t
ccaaaatgatgaacattctagttttaaaagttganngggggggagtgtggactgtattctttgaaaatgttcatgtcatgaataataaagaaggctgtgggaatgtttcaggttaaagaaggctaaggagacctgacagctaaatccaacacctggcccctgtactcagtccagtgctggagggaacaaattctacaaagggcatcattgggtcaagtgataaagtcagaatatgaacggatagattagttaaaaagtattacggtgttaatgtaaatgttactgaaattggtaattgtactgtgtttatgtaagagaatgtccctattattaggaaatgcaccctgaaatatttaggagtaaagtgatagaggcaggaagaagagaaattctaggcagacaggggtgggtccctgggcaaaaccccacc

SEQ ID NO: 559893 - DNA, 158 bp, Homo sapiens
ttcccgcccccccttttttccccttgaacttggataaaaactcgtgtttcctgagtgagggagggccccccatttggtccccaatttttgattttttccccccccccccccctccccagttttggatactaataaaaaataagccttttggttttcca

SEQ ID NO: 559894 - DNA, 394 bp, Homo sapiens
atgacacccaggctgatggggcaccccacagtgcccgtagctgggcggctctgccagccagcgaggtggtgagaggcgacacgtagcatggggatacccagcggctggtcacaggaggagttgatcatgttgcgcaaggcctgcttggcgttctggatgctgccacgctcggggttgcggttgcgcaggaacacccagctaccatgactgctgcccacaggacgcgcacgcactcccggttcaccttgatgtctactgttaccaggttttacaatgcaaattttcactaatacctgggtttaatacagctcacatcactgaatgttacacatgagtttaaatgggtaatatacaggttttgttataataaagttactgattaaattaaaaaaaa

SEQ ID NO: 559895 - DNA, 517 bp, Homo sapiens
taactcccaaaggcctaaaggtaagtacgacaaacctggagccttcctgtggcaggagagacaacaaagcgctataatcctaaggtcaagagtagagtcagcctcacctgattataattagtaatgaggacttgcctcaactccctctttctggagtgaagcatccgaaggaatgcttgaagtacccctgggcttctcttaacatttaagcaagctgtttaaatagcagctcttaataataaagcccaaatctcaagcggtgctagaaggggagggaaagggggaaagcgggcaaccacttttccctagcttatccagaagcctgttaaaagcaaggtctccccacaaagaacttctctgccacatcgccaccccgtgccttttgatctagcacagacccttcaccactcacctagatgcagccaggaacttggatccttgtgggcatagatacataatcggtttcaaggtaacgaaattgtcgagatctaaaatgagggttaattgggcggggtta

SEQ ID NO: 559896 - DNA, 1635 bp, Homo sapiens
  misc_feature (924)..(924): n is a, c, g, or t
  misc_feature (948)..(950): n is a, c, g, or t
  misc_feature (956)..(956): n is a, c, g, or t
caagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctgtgtcacagactggctatggttaagcgacttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtnattcctgcttgtgtgatttagttnnngggttnctttgagacagggtctcactgcagcttaagctcactgcctgggctcaagtgattttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaattaaaaaaaa

SEQ ID NO: 559897 - DNA, 1030 bp, Homo sapiens
  misc_feature (81)..(81): n is a, c, g, or t
  misc_feature (90)..(90): n is a, c, g, or t
  misc_feature (121)..(121): n is a, c, g, or t
  misc_feature (130)..(130): n is a, c, g, or t
  misc_feature (133)..(133): n is a, c, g, or t
agcgggctcgcccctaggtgttcccgcccctccccctcccgtgtcgctcgctttctgtcagcctctctccctctccctctnccctctccntcctctcgcttcctctctcgcacctgagcgntacgcaccntgncccgtggcccggctcccgtccgtcctcgtcctctcccctctttcgcccgccccggtccgccggggagcctcgtggcttgcgtcacgcggcgccctgcccagagcaagatggagcaccgtggaagaaggccatatgtagagtgtgatcaggctcagaaaggaacacctgaagaaaagcgatatcatccatccctgtgtggtctggtactcggcatgccaaaagagtgtaaattcattcaaggaagtgcttacgttgtctagggtgcctgaattactcacgctcagaacaacgcactacaggtgaacttatgcaagcacccagcatattgggctatttaactagccacattgactacctcgcagattactgccctttccacaggacttttgccaacaattcaagtcaccagtaatcaagcctgggaagctggggcttacaaaagatagttgagccaacatgccaaactacagaataactaggtatgcaattactacactttgtgggccatatagccaatgagataggaaaagaaaggtaacacatctataacgagataaaatcccgccagtcataacaagaatgcaaatggtataaccatgagctaccgagagaagcctagactacttgaacagcatgaactattaaacattattgcttgttgaaccagcgagcaaagtattgacaggacaacaaatgagtttggcaccggagctgatccaagagaagaagacagtcagccacaagatgatattacaatttagaatatgtcacatcgctcagagtcacaagaacaagccagacataatcatagacaaaaccaaccaacaattgaattgaaagcactcattgtacccccacgatcacaaaacaaaacggcaaatcccaaaataatgtccc

SEQ ID NO: 559898 - DNA, 246 bp, Homo sapiens
  misc_feature (52)..(52): n is a, c, g, or t
  misc_feature (60)..(60): n is a, c, g, or t
  misc_feature (117)..(117): n is a, c, g, or t
  misc_feature (130)..(130): n is a, c, g, or t
  misc_feature (147)..(147): n is a, c, g, or t
  misc_feature (178)..(178): n is a, c, g, or t
  misc_feature (188)..(188): n is a, c, g, or t
  misc_feature (207)..(207): n is a, c, g, or t
gtcggcaccggccgatacgacctggtcggacgcgccgcatccctggcgccgntacttttngcgcagtgccgactacctggtggtgggcctgccggtgctgatcctgctgttcatccngctgttcgcgatnttcggcgccagctcgcngatgatgaagctgctgtccaacgccttcgtntgccagtttntgctggtgtgcctgttccngttcagcgaagccttcctgctcagcacctggggcttcgc

SEQ ID NO: 559899 - DNA, 1008 bp, Homo sapiens
tcgctgatgcactccgctggtccaactgttttttcggggccacctatcgccctccgggtgacgagcccagcaattcgctgggggccactctagcggcagtcatgtcccaagccgctgtcaccaatcccctccgagttagtagggtcgccgtgtttaccactagtggctgctggactcaggcatccgggagacgccatgccaatggcaggccctgggagacaattccctcaggactagggacagggcctgtgcctgccatgggccagggcccacgtaccacgcagcctcagggcgccgcccacgtcgtctgcaggcgggtgcgccgcgggtgttccctcgcgtctcttcaactgcacatttgcaatgcattttgcgattcccatttctctgctaggagtccagcttgggtgggcgctgctcccagagccgtgggtcccagacacttgcgttccttttgttcctgtccgtttatcaggacacgggccccacctgtcacgtgcccgaggccaccctagcccagcctgcggggcgttccctactgcctggatgccggcttgagttctgcgcacgcaggattcagtgtggggacggcccctgccggataggctagcctggcccaggtggtgagcggtttgcagtgtccgttctcatccacctgatgggcaccagataaaggccccagcatgtccagccttcactggacggccctcgcggtcccttgcagcccaagatgggactcagacccatgtgcacaccagagctcccctgccgcagaatggggccaccagccggccccgaccagggtcacaggagcactgctcgcatgtacatactgttgccatagcccacactggtgcaagtgggagccacccccaggtgcatgggggcacagcccactcccacacatccggcaacgcccccacccaaccccgagtgtttcatgcacatgtgactccatggtacactgcgtcctccccaaagccaaattaaaggcggtggtacctaaca

SEQ ID NO: 559900 - DNA, 849 bp, Homo sapiens
  misc_feature (215)..(215): n is a, c, g, or t
cttgctgactgtgctcatcactttctctcaaagttagaacttttcagtataaaaataattagctttaactgattatacttttcttaatagtttctgtcaaaattgtgtctaaaattgtgtgtgtgtgccaaatggaaataccatataatatggtgcattcagtttatccacaagtggttaacattttaagtcctagattttgagatgtctgtgcntttgtataagcatcgcttggggaataccaagatgattcattattcagtgattattttcttgacagataatatgatgatgggtgtaaaatcttcacctaataacggagtgagatctctgtgtaaagacagtttctgaaggatgataatagaatagaattgcagccaacaggctttttccctttcgagacgaggatcgtgtccggactgctaaggtaagacttcatttgtccatagagtgccatatcctgtgaaacgatcatacaacaatcaaaactcatgctttcagcaaacaaaggacacaacagatcttttaacctccactttgtcctattgaccttaactgtcctagacacaccgctgacctattttaaacgtgtgccacatttactcaattctggtggtgactggcacgtcctaacaggccatatattggttactcttactgccggaacgaacaaatttttccttctacgcccaggaaagtaaattgtggccgcgaaacccaaactggcagacggccggacaactggcgcgtgggcgccatggttacaacttatgaggaaacacctctttatctgggaccagcaacacttccacgcggtctggcgcggataacacggctcccctcacactg

SEQ ID NO: 559901 - DNA, 449 bp, Homo sapiens
aaagacacaagcacttgtatgttcatcgcagcattattcacaatagcaaagacatggaatcaatctaggtgtgcatcagtggtggactggataaagaaaatattgtatgccagacatggtggctcgtgcctgtaatcccagcactttgggagtccaaggtaggtggatcacctgaggtcgggagttcaagagcagtctggccaacatggagaaaacccttctctactaagaaggctaaggcagaagaatcacttgaacttgagaggcagagtttgcagtgagccaagatcacaccactgcactccagcctgggcgacagagtgagactctctctaaaaaaaaaaggctgggcgctgtggctcacacccgtaatgccagcattttgggaggccaaggtgggtggatcacctgacaccagcctggcccaatggtgaaaccacgtctctgct

SEQ ID NO: 559902 - DNA, 552 bp, Homo sapiens
  misc_feature (202)..(202): n is a, c, g, or t
gggcgccaacacacgccgcccggcgccccgggcgtttccccccaacttcccgcccgggcgggggactcggtttggtcccttgttctggggcaatccgcgccctcgaggaacccctcccctttttccggggggccctgctttagggggacccaaggtttcaacacgcgatctgtggggtcccgccccacgggtctacgtcggntaaaaaaaccccggggggggggggctcctggggttttccttaaaagggggccccaacccttggggggggcccccccccgggccccaaggggcccggggcccagaggggcctccccccccgccggggggggccgggctaaggggggttgggggccccccaaaaaaatttttgggggggggggttcccccaaaaccccccccggggcgggcctggggaggaacaaattcttggcccccccggccccccccccgggccccccggggggatccccgggggcccgggcccccccgggggggggcccccccccccccacttaaccggggggggaaaaaaaccccgggggtttttta

SEQ ID NO: 559903 - DNA, 799 bp, Homo sapiens
tgaaagtcagcccagtcaccaactccgacgccgaagcgttacactggaagactatcttaggaggagcaagcaaaagagtctaatgacaaaatacaacatttctatacacatagcacagtattccagcaaagagtctacttcttaacgagaagcaactcaacagatatccctctcgaccaggaagatggaagtgctggaagagaagtgctcatctctcacacagtactttggatggacaggagtttctaagtatcatggctaccagacaagctgtagagaatgatcaccctggaacaatcaagatcaacctgtcgcctttgtaagcagctcgacatccagatgaatacaaaattgcagcccttgtctactatagctgtatcttcataatcggattgatagttaagcatcactgcattatgggttttcagttgtaccaccaagaagagaaccagggtaaccatctatatgatgaatgtggcatgtagctggacttgcatatttataatgactttaccctttcgaagtgtatcattatgcagaagatgaatgggcatatggagagtacttgctggcagattcttggagctctcacagtgttgtacccaagcagtggtttatggcttctggccttgtattagtgctgacagatacatggccattgtacagccgaagtacgccaatagaacttaaaaacacgtgcaaagccgtgctggcgtgtgtgggagtctgggataatgaccctgaccacgacacccctctgctactggtctataaagacccagataaagactccagtcca

SEQ ID NO: 559904 - DNA, 114 bp, Homo sapiens
tgctgctgcggttgctctcgcgagctcccggtcttcgctctagtgtgtccgcgcgcgcccacacagggcgggcgagcccacccgggcgggcgagcccccgggcgggggttcggg

SEQ ID NO: 559905 - DNA, 568 bp, Homo sapiens
gtagctcagggtaacgtggtgtctgcattacctcggtgtctctagagcagcagctggctctgagaaggtgctaagttacaaccactgactcgatgtccttgtgtgtgtgtgttgactatgcatagatgggcacacatatgaagtagaattgagtcttggggtcttggaacaggggagttctgggtttaggaatctgagctgcacagcctgaccgtcccatttgtctgcataggctgtgatggaaaacctctcctaatgccaaggggcactgcctggcatgaagctgtagtcctctgaggaccactaggtggcgccaactcatccttgtcccgtaaactgagtaagtggctgggttatccaccgctgagttatcttggggcctccaagatcagaggcaaaaattcaccatgacccccctgccaccgcatactggagttctggcctactggactccagttccaaagccaccaagttccctgtagctatcttcttcctagagggaatacttcatccaaaggctacacggcagatccagtctagttaggcctttccttgaacctaaaccctc

SEQ ID NO: 559906 - DNA, 486 bp, Homo sapiens
acctgctaccccacgctcgaaaaaataaacaaagctgattcggggggggtttagggaccctaagggaaaaaaaaattttttttcctcctttttgggggagggggggcctcccaaaggtttttcttcctaatttttccagggtgggggggcttagggggggaaaaaaaaagggggttttgtttttctttctcaggggggggcggggtataaaaaaaacggggtaaaaggggtccctcgcgttaaaccccctttttttaaagggccctttttttttttaaaccccctccgggggggggaaaaaaaaaaggtccggggggtttaatttgggaattttccccttttggtttaaaccccaagggaggggtttttttttgcccatttttttttggccaactggaaagggggggggtttctccccccttttgccaaaggggggcttccccccctcccccgggggacccttcccggggcgtgggttttttcccc

SEQ ID NO: 559907 - DNA, 509 bp, Homo sapiens
tatcatgagaacaaaaaccagaccagaggacaagcgcatggccacacagtaagtcatcgaaatctacctttacagtaagtcaggctcattggggaatatcgagcatttgcaccgccgcgacggtatgcatatcttcgcaccctccgcctaaccggacgccacgcaccgggcacgcatcaagataatcgataccaatggcgagtttcaactgctgattaggctggcaggtattgttagtcacgtcgaagctctgccagtgtccgtcgagccaggcttcggcccaggcgtgcatcgccacgtgggtagaatcctcggtgtagagatagccactgacgtagcgcgccgggatgcccaagctgcggcagcaggcgaggaacacgtgggtgtggtcctgacacactccctgttgggcggaaaacgcctgcgaggcgctgtctttcaccgtggtggtgccggggctgtaaggcattttcatcaacagttcgcccattaaggcgcgcaggctttcg

SEQ ID NO: 559908 - DNA, 436 bp, Homo sapiens
  misc_feature (51)..(51): n is a, c, g, or t
  misc_feature (76)..(76): n is a, c, g, or t
  misc_feature (126)..(126): n is a, c, g, or t
  misc_feature (134)..(134): n is a, c, g, or t
  misc_feature (167)..(167): n is a, c, g, or t
  misc_feature (186)..(186): n is a, c, g, or t
  misc_feature (208)..(208): n is a, c, g, or t
  misc_feature (229)..(229): n is a, c, g, or t
  misc_feature (278)..(278): n is a, c, g, or t
  misc_feature (300)..(300): n is a, c, g, or t
  misc_feature (333)..(333): n is a, c, g, or t
  misc_feature (343)..(343): n is a, c, g, or t
  misc_feature (427)..(427): n is a, c, g, or t
gaacagggtatttgaagcccaggccaaattcccggcttctttttttttgcnaccagaggttccagagttgagtttntctttatttagaaaaatgggaagatgcccaagagcttggaggcattgttntcttttcntgcagaaacagtttttcttcttccctttcagcnttgtggccagttctttttnacatgaagcccctggcatttgntggggaagggactggcctggnacttgctgttagggcaggaaggggcaaaaggaagacttgggtagtaatntgggggttcagatgggtagcantaagccagctggcctaaagatgcaataagttcntaggtagtcnacccttaccctgaggaatgggaaaatgaacctcagcccattaggcaggaaaagttgatatttaataaacaaggaaagagtgaantgagacccc

SEQ ID NO: 559909 - DNA, 373 bp, Homo sapiens
  misc_feature (35)..(35): n is a, c, g, or t
caggcttggaggctcacacctgtaatctcagcacnttgggaggtcaagataagagaatgacttgatcccaggagttccagaccagcctgggcaacacagtgagacctcgtctctacaaatataaaaaaattagccaggcctggtgacacacgcccgcagtcccacccacccgggagaccgaggcgggaggactacttgattttttgagctcaggaagtcgaggctacagtgaaccacgactgcaccactgcacttcagcctgggcaacagagagaaagaccctgcttaaaaaaaagaaaagaatcaatttatttgatatatgagttatttaagtactcaaaaatttttgttaaatcacacaatgtagagctta

SEQ ID NO: 559910 - DNA, 1027 bp, Homo sapiens
  misc_feature (6)..(6): n is a, c, g, or t
  misc_feature (94)..(94): n is a, c, g, or t
  misc_feature (133)..(133): n is a, c, g, or t
  misc_feature (137)..(137): n is a, c, g, or t
  misc_feature (152)..(152): n is a, c, g, or t
  misc_feature (165)..(165): n is a, c, g, or t
  misc_feature (184)..(184): n is a, c, g, or t
  misc_feature (201)..(201): n is a, c, g, or t
  misc_feature (239)..(239): n is a, c, g, or t
  misc_feature (242)..(244): n is a, c, g, or t
  misc_feature (253)..(253): n is a, c, g, or t
  misc_feature (256)..(256): n is a, c, g, or t
  misc_feature (281)..(281): n is a, c, g, or t
  misc_feature (331)..(331): n is a, c, g, or t
  misc_feature (354)..(354): n is a, c, g, or t
  misc_feature (375)..(375): n is a, c, g, or t
  misc_feature (385)..(385): n is a, c, g, or t
  misc_feature (401)..(401): n is a, c, g, or t
  misc_feature (406)..(406): n is a, c, g, or t
  misc_feature (409)..(409): n is a, c, g, or t
  misc_feature (416)..(416): n is a, c, g, or t
  misc_feature (432)..(432): n is a, c, g, or t
  misc_feature (454)..(454): n is a, c, g, or t
  misc_feature (457)..(457): n is a, c, g, or t
  misc_feature (501)..(501): n is a, c, g, or t
  misc_feature (504)..(504): n is a, c, g, or t
  misc_feature (509)..(509): n is a, c, g, or t
  misc_feature (521)..(521): n is a, c, g, or t
  misc_feature (530)..(530): n is a, c, g, or t
  misc_feature (553)..(553): n is a, c, g, or t
  misc_feature (555)..(555): n is a, c, g, or t
  misc_feature (558)..(558): n is a, c, g, or t
  misc_feature (567)..(567): n is a, c, g, or t
  misc_feature (608)..(608): n is a, c, g, or t
  misc_feature (671)..(671): n is a, c, g, or t
  misc_feature (902)..(902): n is a, c, g, or t
  misc_feature (1027)..(1027): n is a, c, g, or t
agaacnaaaatagaaggtatctgttgtacaacatgggtagtaattgactataactggagatttattatattctaatacagatcatttataaatncaatttctttattaaaaagcttccacctttttgtttgtntgtntacaatttgcaaaantattctgaaagcngaatatatgtgcacaagtntgcaaagagtgcaaatntaggatatggtaaatgctttacaagtcactttcaaaanacnnnctgccacanctnagcctttacattgtcatcttttttnatcaaaatattttgatgccagccttccttccactgccctaaactataaancattttttaatgagttgaaattnaggaaggactacacctactanaaaaaaaganaagaaagttctattantttgnggnttcagantccccccaaaccaggnccagtatcgtggtaaaggcaangcnggggccccggacagagtatgagaatgtgcagggggcatccctgnggnttcanagcttcagtggnccgtgagtnctccagctgcataactcactgancngtnttgccagtntctacactggctcgactgggcataattcaaaaacgaaaaantcattttctttccattcttctggggctctgtgatagcatttaataacaccccaatgggatgtnttccacatatagtattatggtatttcttcaagtaattgctaaaagatacagggtctaattgttctataatactcatacccattttatctagatgttcaatggatctataaatctccccctgggattcatcatagtaactgtaacggaacctttgaccccaatggcagaaatcagaagaaaccacaaagagattactaggatccgctagatatttactgatgagttttccgnattcctgttcttttgactcactcagagctccaaccagtacaggaataatggtaaactcatccttatggctttccatggctttagctgtataaggcaaatgcatttcaatactgtgttcatcttcn

SEQ ID NO: 559911 - DNA, 367 bp, Homo sapiens
  misc_feature (30)..(30): n is a, c, g, or t
  misc_feature (279)..(279): n is a, c, g, or t
  misc_feature (323)..(323): n is a, c, g, or t
  misc_feature (343)..(343): n is a, c, g, or t
  misc_feature (349)..(349): n is a, c, g, or t
gagatggagttttgctcttgttgcccaggntggagcgaatggtgcaatctcggctcaccacaacctccgcctcccgggttcaagcgattctcctgcctcagcctcccgattacaggcatgtgccaccatgcccagctaattttgtatttttagtagagatggggtttctccattttggtcaggcgaacttctgacctcaggtaatccccccgcctcggcctcccaaagtgctgggattacaggcttgagccattgtgcccagcaatccaaaattttttnagtgcgaaaagggttgccgcaagtgggaaaattccatgcctganctcgtgtgacaaggttgctntcaagncacagtcaaaatgttttt

SEQ ID NO: 559912 - DNA, 141 bp, Homo sapiens
acggcttgagccacatcaggggtgtctcctttttatccccctcgcttttagctacaacatccctcccgagttgaccccctggggtttcacataacccatgtgtccctagttggggctggggagagtgagaagctgagatac

SEQ ID NO: 559913 - DNA, 255 bp, Homo sapiens
gcgtcagagctgatcagtgaccgcagagctacgggagatcagacatgctcctgaagaccaatgcagcatgtggcccctgtagcacgactgacgttaccatgtacagcatcaaagctgcaatcaacaacaaaatcagcagaatactgaggcgtccaccaactggcgtagctgactatgaagtccattccccggtgacgcacgcacgggacacgaccaggggactccatctacgacgtcgacccatgcacggcctgc

SEQ ID NO: 559914 - DNA, 177 bp, Homo sapiens
  misc_feature (10)..(10): n is a, c, g, or t
  misc_feature (54)..(54): n is a, c, g, or t
gactatgctntacaaaccacaaagacattggaacactatacctatgatgcggcncatgagctggagtcctaggcacagctctgaagcctccttatgcgagccgagctgggccaaccaagcaaccttctaggtgaacgaccacatctacgacgttgatcgtcacagcccatgcatttg

SEQ ID NO: 559915 - DNA, 535 bp, Homo sapiens
gcatagctgttcctgagtatcctggttatccggtaatcccagcacgacgtatgtacaaggtcccgggttcgcaatatcgacaaagtccgtcacagattcagtccccgtaaggcatgacatcaaccgtcaatgtgaggcaatgtatgttccactcccccttataaccaagagttccctacgtaatgaagaaagtcatctgttcatggtattttcatactagaattcagttatcaacttcctttcctagaataagggagactcttcacctttgaaactttatgcttggccttgaataagttcatgttactaactgacttacaacaggctgtcctggagtaggtggttagtcttctccatcactccctgaagagatatcatctgcacctccaaataaatccatggttcccactattatcttcaatgcagaaggaaaaaggcattagagttactatctgtaactcaggttcttcacaggtgatcacttcaagacattcccaaggtttctgggccagcatcagaaaagcatcaagaacct

SEQ ID NO: 559916 - DNA, 356 bp, Homo sapiens
agagagtttgagagagagagagttagagagagagcgagagagagagagagagagagagagagagagtgagagagatatagacagagtcagagtgagagattgttcgagggacagatataggttgtgcaagttacttacacaagttatttcttaaattccaaacattttttaaaatctttttacagcctatgccttggatattaaaacctattggtggaaatcattctctatataggttaccatatttgacactgtaaatacttcccattttaattagactcatcttctaatagatttactgtggtccacttgtacgtattcctctttatgatttttttctagataatccgtgcccc

SEQ ID NO: 559917 - DNA, 406 bp, Homo sapiens
gacaaccctcctcaggctagccatggactacacgggtatgtccttctgccatcccgtcagtgcacctaggaagtctcattatcgaggctgactgatgatgatcatcactaatttctggggtccccattgtacattatccctactgatagtggaagcttacaaacaagattggcaagtttccaaaatccatggtactcatgcccgactgtctacctggctacacagagtttgagggagagggagtatgtcgtctgtgatccgcatcagtcatgggggtcggtccccttgggaaggcattgtttctttagcatttaccattctgcagttgtgtgtaaggaagttgtgtccggtcagcaggtcaccagactgggatacccactgtgggcatggcagttggtatactgct

SEQ ID NO: 559918 - DNA, 110 bp, Homo sapiens
gcacggattcgccatcgtgagttccaggattttcaaaatggctgcagctcctcaagcaccgaggcagggtcatcatccataagaacgagacctactagttaatataagaa

SEQ ID NO: 559919 - DNA, 468 bp, Homo sapiens
gaagagtgagcagggcaaaggacgcaagaggacatcgggtgctctccatcaccaggaggagacaggtgttccactgaagggcagacaatgtggaaagtaacaagaaaaaaaggctagcactagattctgaggcagcagtctctgctgataaaccagacgcagtaccgactcatcgtgtccccaggaacctgcagaagctgggcaaagagagggcccagaagttgtgcagaaatagcaccagggtgcctgcacagtgcacagtcccttcccatcctcagtccactcctgtacatagcccagacagaatgctggactcacccaaaagaaagagaccgaaatcccttgcgcaagtggaagagcctgcaattgaaaatgttaagcctccaggttcccctgtggccaaactggcaaaatttactttcaagcagaagtcaaaactgatccactcccctgaatatggttggctgg

SEQ ID NO: 559920 - DNA, 526 bp, Homo sapiens
  misc_feature (1)..(1): n is a, c, g, or t
  misc_feature (331)..(331): n is a, c, g, or t
  misc_feature (522)..(522): n is a, c, g, or t
  misc_feature (524)..(526): n is a, c, g, or t
natatcggccgagtcgcacaagctgccgcataaacagaaccgtggcacgatgacgcgcgccatgcgtggcatccaactacgatacctcgagtctctcaaagaccaggaagcgtgcgcgaggtttcgagacggcccaacgtcggctgaagaaggttacgtcttccaagacgggttcaataaactgttgaaagtttttatgaaggcccgcccgtggcgcctgcccctgcggaacggctccccttcttggaccagtcccccgcgagcccggagaagggagacccgttcccaaaaggaccccacgggcctgcctggaatctgtcttgtgaacgcncttcgttgcccaaggacttggcgttggcaccgggcgccccccatcccagtgtttgtgtgcgtccagttgtgttgcacaggcctgggccccccactgagtgccaagggtcccctgagcatgcttttctgaagagccgggcctcagagtgtgtggctgtgtgtctgttggactcccctcacccccaaaaaaanannn

SEQ ID NO: 559921 - DNA, 237 bp, Homo sapiens
gagtggcatgctcacatggacagatcccagtgctcaggctgagtgagtcaggacaggctctgtctcagccttatcggcatcctgcgtcactgggtgcgcctattgtgcaaagtgaccggccgggctggtaaccctgcctgttgctaagctgtgttgccggcctgccctctgactgtacgccaaggagcggtgacaggatgtgcctttctaccgatcgccttaggtacggtcgatcga

SEQ ID NO: 559922 - DNA, 737 bp, Homo sapiens
  misc_feature (600)..(600): n is a, c, g, or t
tgagcctggagaacccgctcagccctttctcctcggacatcaacaacatgcccctggaggagctgtctaacgccctcatggtcggctgagcgcttcaatggagcaccgggtacacagccctgctacatgtctacttgtccggtgcctggcacgcccagcgtctggccaatagcccctctcctcttgccgtcgcgtccaacaactaggactccggcctgttggtccatcgcgagcgatgggcacagtcctgcggtcgtagtgttccattgtgcttggtcggtatgccccgcagcggtttgggatggaccgttcgcagcgccagcgctttaggccattcggacgagtgccgctacggtgatcgccttaccaggccaaggtcggtccatcatagtcatcccagtgccaggtaggaatgagagctcgcgtcccacggctggatgcgaagcgtggttcggccacgggcggatctcccgcattcggaagcgacggtcgtcatctctcaggcagggttggccaggtcccgtcgtgtggcaccctcgtcctctccaagcccatcgcagtgccctggagctaacgttcccagacgtcctctccacgagnctgtcagagctcgtgcagtgacaatcctcgcgtggatccctgtgcggacgaaggcccgtacgtgggcctggcgttgagcccgtgaaggttcactggcccgggtcacacgttcagtgtaccctggactgggggaaagt

SEQ ID NO: 559923 - DNA, 338 bp, Homo sapiens
  misc_feature (160)..(160): n is a, c, g, or t
gagtatgaaagaactatcaaagccagtctcacttatgaacaaaagatccagtaatcttaagaagttaagtaaatctagcattatgtaaaaataataaaaatacatcagaacgaagttgtatttatcctagaaaatgaaagttgatttaacattagaaacnctttaaaaagcagggaggattaaaggagtttgtttattcttaatatattctgtttgtttatttcagtgtttttatatgagtatccttaaatttttaaactgtgttaagatgcatgcttatacttgttttacttttctgactggaagataaacctaaataaaggttgtgaaaaagaaaa

SEQ ID NO: 559924 - DNA, 122 bp, Homo sapiens
  misc_feature (12)..(12): n is a, c, g, or t
  misc_feature (31)..(31): n is a, c, g, or t
gcaatcatgtgnccatactatgatcttcgtngcatgaaacagccaatcgtggtattcaaggacacctaaaagcagtctcttatgacaagtttgtgagtggtgaggaaaattgtctctgcctc

SEQ ID NO: 559925 - DNA, 113 bp, Homo sapiens
tgtctaggctccaaatttcctggagttctcgaagtctgacatgctaatgtctgtcctgtagcttctgattgaaactcggtcgacgtcttcctgtgccgggctctggccacccc

SEQ ID NO: 559926 - DNA, 91 bp, Homo sapiens
  misc_feature (21)..(21): n is a, c, g, or t
  misc_feature (23)..(23): n is a, c, g, or t
gcagagggctgggctgcggangngcgcgccgggcgatgcaggggggcaactccggggtccgcaagcgcgaagaggagggcgacggggctgg

SEQ ID NO: 559927 - DNA, 106 bp, Homo sapiens
tcttcccagatctattactagcttctagaaataccctgggtacaacagcaagctcatgctgtccccgagtgcttgcacattctaacagcgtgcagagtatattgac

SEQ ID NO: 559928 - DNA, 421 bp, Homo sapiens
tcacttaaaaataactaatgtaatttttggccgggctcggtggctcatgcctgtagtctcagcactttgggaggccaaggctggcagatcacgaggtcaggagttcgagaccagcctcaccaacatggtgaaaccccatctctactaaaagtagaaaaattagccaggcacggtggcgggcgcctgtaatcccagctactcaggaggctgaggcaggagaaccgcttgaacctgggagacggaggttgcagtgagccaagattgcaccactgcactccagcttgggtgacactccgtctcaaaacaaaacaaacaaacaaagaatatacctttctccagcaaacaatttgattttggagtactggatgacaaaggttacgtggctcttctcctcgtacctgttctcaaggggatcctctag

SEQ ID NO: 559929 - DNA, 616 bp, Homo sapiens
atcacgaaaaaaactctacctctctatactaatctccctacaaagtctcgcttaagttataaacattgcacagccatcagaactaatcatatttgatatctgtcttcgaacaccacactgtatccccacgcgttagctatcattcagccgatgaggtgaaccaggcagaacgcctgaacggcaggcagatacttcctattctacaccctagtaggctccacttcccctactcatcgcactgatttacactcacaacagcgctaggcgtcactaaacattctactactgcactctcacgtgcccaatgaaactatcaatactctctgagcctaactaacttcagatatgagctagctgtagcacaatgagcttgctatagtacaagatacctcttgtacgggctccacttatgactccctagaagcccatggtcgaagcgccccatcgctgggtcaagtagtacttggccgcagtatctcttgagaaactaggcggctatggtgataatagcgccgtcagcactcattctcgaacgcccactgacagaaagcacatgagcctaggccgcttcctgtgtgactataccgctatgaggcataattcatgaccaagctcc

SEQ ID NO: 559930 - DNA, 137 bp, Homo sapiens
aaggggacgtactcggctcggatgcgtcagtccctcaggaaccggggatcttagtgtacctggctaagttcagaccttctcttcctttcctttcctttcctctccggcccattttccggtcctccggtccctctcca

SEQ ID NO: 559931 - DNA, 312 bp, Homo sapiens
aaacaccatctctacaaaaaattaaaaaaaaaaaaattagctggacatgggtggcatgtgcctgtagtcccagctacttgagggggctgaggtgggaggatcgcttgagcccaggaggtcaaggctgcagtaagccatgtttgtgccactgcactccagcctgggtgacaaaagtgaagccctgtctcaacaaataaaaataaaaaccacctctgctttgctcacctcctcccttaataaaacatgtatagaagactttgagctcaatggattacatatgcatcgtactcagatattttacaaagaacatga

SEQ ID NO: 559932 - DNA, 849 bp, Homo sapiens
agcggattcctggagaagctgcagtgtggggatgctctagaccgagtactgcccccagtgtctttccaccgtcctcctgcagcagcggcagcgtgcatgcagcagttagcagcggcaactatgaggcgtgcaccccagaggcaagtcccgcagggatggagcgtcagcctgagaaggagggctatggcagccccgacaggggtagtgttgtaccggatggagggcgaaccagactgggaaccagactgtatgggcccatgagaatacaccattcccaacgaactagacccgtacatgcgcacgaacagtgcagcgtatatcgatcagtatggcgataagataggccgccgattcagtatgaccctaggacgcgtccagtgatgatgaaggagtactagagttagttgagcctacttcagacccgtggttccagcagcgcgagtgctcacgcacagttagacgcagaccctgatgatagccttggcacacatcatatgcgcgaggggacccggtgtgccggactgctgtaccggaccgggaggacagacaaagaggacagggagacgtcctgcgtgagggaccgcgagcacggagccggctgagacgacaaggaccatggggcgtacgcggtattagagagggaacgtgaacgcggtcgtcgatcacacccgtgccgcagagtaccccaggacgaaaactcgcagacggggagcctcgggacatgaagagcgaggcgcacaggaagcaagggacggaggggcgcggggacggcgagcaggcacagagacagacgcccgcaacccggggcgatacgaggctggagccctgcagcgcctctgcgcccccgga

SEQ ID NO: 559933 - DNA, 945 bp, Homo sapiens
  misc_feature (651)..(651): n is a, c, g, or t
agcggaggtaacactgtcgagatccagtgctgcctgatgacagtgagctgtctccgagagaaaaattcctcagttattaactctctgttccttgcatcgtcatctccttatagagcctactcacctccctctttactctgtaggagacatagaccaagcgaaacaagagagaggcctttctgagagagatagtcggtctgtaagagtcctggtaacctgtcgtgtcgcaaacgttgagacgtgagtgctactacttggtcacaatacgcatgtaaggatggcctcctcatctaagataagggcacgttgaactgccctgataacattgcactcttcaaacgttaaagcctacttacagcatcatctgtaagctcacatctattgggtgtatgtccatgtacagttcgcctctaactttaccagattgaattaatataactatgtttccccttgagaatacccgcgtaaagggaccatgtgtatctagttgcgctacgtgtaaccctatcctctttttcgagaggccttcctgattccccgtgtggtagtccctggatagtgttccatttttgctttgtgcaagttgggtccgccaatccagtatgcttcgccatctctcaaaactacaggggcctcagttttcatcccaangcaaattacaatggatgggaatccctttcctttaccaagggtaaaaacacgttttgatgcggcatgcaaatgaggggaagatgccactggctcgatgaacgtaattcagagcttggagagacacgtatatctttgcagggggccgatctatttgataacccttgggggataacggtcaagccaaatctttcatgtgtggcttggattgccttaagcaattaaaccaatggggcccccccttttctaagaaccattgccctatggttgccgacgagatttggtaaaggattacca

SEQ ID NO: 559934 - DNA, 810 bp, Homo sapiens
ggtccaccgctgccgcctccttcttctgccgctcctggtgctgctgtgtgctcgtgcggtgcggacctggtacctctttgtgaagcggagctgaggagaaatccggcgctctgcctatggctcgagcagaaaagcccaaggtagaggagtcaaagactgagaacaacgatcatattaattgtgaaggtggcggggcaggatggttctgtggtgcagtttaagattgagaggcgtacaccagttagtaaacataagtgaaagcctatgtgaacgactagggatcgtcaatgaggcagatcaggatgtgcgattggatgggcaagccaatcaatgaaacaggacatatctgacacagttggaaatggaggatgaagatacaattgatgtgttgccaaggagggaagacgggaggtgtctactgagaagaggggaaccttggttcttttagtccagtaactctggtggcttttgaaggaccgaggattgacattagctcaaattgagaacaacctgcaagtatgggttccgaccaccactccctgtaggtactcacctggtcattcgtcccccacccgatgcgtgtctccattttccccgcctgtcccccgattgccctttcagatggtcgcgcgtgaaacggtccactcgggtcatcatggtcgccacgcaggcctcatcggcctctgccctctctctctgtagcctccccagcagccccagggcgtggcccggctcgggcctcccctcgcacacgggtggcgcgccacctcctggtcgctgggagaatcccctttttaatactgggcctgg

SEQ ID NO: 559935 - DNA, 434 bp, Homo sapiens
cgtccaaggacaagctgctagtgtccccgtccgactgggctctttgataaccatgatggtgatgatgatgacgactttttctcggcaacccacagcaaaccttctaaaacaggcaaagtccaatccactgccgatatctttggtgacgaagaaggagatctgttcaacgaaaaagccgtagcatcgccagccagccactgtgcgtcagacagatgaaaatcaagcaagagcagaacaacaggttacttcatcttccagcaaaaatctccaagccctcatcagaaacaacgactcaaaaaggcttattttcagatgaggcggcactctgaggattggttttcttctcaaagttgcgagtaagtaaaaaggtgcatctcgtgctgccgggaaagctccccaggtaggtatcccgggttgatggaagcgtcgggcat

SEQ ID NO: 559936 - DNA, 939 bp, Homo sapiens
tccggggaaaaaaaatttttttggaacccccccaatggaaaaatttttcccgggttaaaccccttttttctcttggaaatcgggtttttttatgggggcccccaggtagttgttttctcttctccccctctcgtgtttcgcggaagtcggcctgtggcccactacttggggggtggggtgccatatagaactcttagtgtcccatccttcctccgacgacaccccgcccgtcttcggtcttcgccccgacaagaggatcttttcgcgtgggtggttcataccaccccgcttttctggtgtcccccccacacaaactagctcttaccggttatgaacaacgactcttgggtggcccctctttcaacactattaggtgtgcgaccaacacgccccccccaggaggtgatgtcagacgtgctctcttgtgtcatacaaataagcgcggcacatcacgcaccgtggggagagggagctatctgtgttctctatggatcacatgatgtgcgccctgctcctcgaagaaaaggttgtaaccccctgtgcgcacatctcttttttataacacctttcttctctgtgtgtgagctcccccagtgcggggggcaggagtatgaggtaacctctttctctggcgcccgaggtgagtggtgcccacaagaaagaaggcgtctacctcggaatcatgataatgtgtccgttcgccccccatatgttacaggtggcccaccctgtgtgcgcgacgacggcccctgcgaggggcgatcttctttgtggcgggggggcagccctttcttcgtgagtgttgtgctgcccccacagctgtgtggtgggacacccccctttttgttagttcgccttttgtggcccctgtgtggttctccccaccccgtggtagtggacctcttctcaactatagttgttatccttcccctgtgctca

SEQ ID NO: 559937 - DNA, 205 bp, Homo sapiens
ataaaatggtgatgaaaatgtcatgatagtatgataatatgcaagtttcaaattcatttataattatttaaaatgtagttttagatccagctcattcataatagtagcatattttatattaaagatatgaaaatacataacataaacaaaatttggaatatatttgaaagacttaagaataacttaattgccaaaacaatcttag

SEQ ID NO: 559938 - DNA, 418 bp, Homo sapiens
ccccgttaatccagatcgcatcaaacaaacattgccattttccccaacacccaccaagtcctctccatgggatcccatgcccccctccagagctaatcagaagcataatatctccgggatatcatgaagcaagatataagagaagaccaaaccaaaatccgtaattcatggaaagaattgtaatcatcaatctttcatattattaatacttggtaattattttctccccaccagtattttccagtagattctaatcagggggaagggcaaaaggaaccccccctttgttgttcatttgtttcaagccaatagtcctgattaatttagctttgctaaactgacttatatctggaagtatataaccaagataagaaaataggttttaatatgatcatcttaagctaactgtaatgaaaag

SEQ ID NO: 559939 - DNA, 1096 bp, Homo sapiens
tccccagactccaccccgagccagtgtccgacgagagagaggtagccgaggcagcagagcggagggaagactgccatcttcgcacgctccgaaaaccgaggcagcgagacgaaccccagcatcccgcgggctccgaaggggccgccgccggcgacgcctcaccgccactgctgcgctgcctagtgctcaccggctaaggaggcatacgacaaggtgaagctgcagagccggccggcagacgccccacggacccatgggcccggccagctgacgctgacgatctgcgggccatgcgggacatcaacattcggcagacctcaatggactaggcaaggggctgtacagaccagactcccgccgactgacatgtcaactccagggcatggagggcgcggagtgtagtgatcagcaagtgggcgagggacgtcagagaccgcaacggccaggagaccgggtgatggggtagaaccaggtcagggatgtggcaggaagaggtgactggccctcggatccagaccttccatgattcctgaggccatgaccatagaggaagcagaaagaccatgactcgcacaacatgaccataacagcacaacaatggacccactaagcactaccggcaaccataacagacagagccaaagacgtcatggtacaaaatggcatcgcaaggaagaggccatggcatggacacccactgagatgagtcaacatactggcaagggggaacaacttcctgacacccatagacaaagacaacaacattggaatggacaacctgatgacgacccaaatgcaccagaaggacactgaaccagaacaggaggacaacgcataaggtacaagacagcagacgcggaagccacccgggccagataaacaacacatgggcaccggaatgaaagagaacgagaaaggaggaggagacaacccgtaactgagacacggagcagcacacagaggacaagaggacacaaagagagactaaaggacagcgacattggaagcgaacgagaaaaacaacatagacacaggacgagccagcgaactcaccaagcacagctgcaacgcaaaatgaaggacgagcggaacaatt

SEQ ID NO: 559940 - DNA, 262 bp, Homo sapiens
gtccacgctggctaatacggcaaagtccctgtctctactaacaatacaaaaatcagccaggtgtggtggcacacacctgtagtcccagctactcgggaggctgaatgcaggagaatcgcttgaacctgggagtgcagaggttgctggtgagccactgcttgcaccactctcacctccagacctgcaaacctatcttccaggttacagcacagtctgttatcagggcacacttcttcccactactcctgcctgtccagcgccg

SEQ ID NO: 559941 - DNA, 1306 bp, Homo sapiens
  misc_feature (601)..(601): n is a, c, g, or t
  misc_feature (659)..(659): n is a, c, g, or t
  misc_feature (772)..(772): n is a, c, g, or t
  misc_feature (775)..(775): n is a, c, g, or t
  misc_feature (1077)..(1077): n is a, c, g, or t
atgagatcacgcggcaaaggaaatgaacagcagcctcctaatagccagccttctttgtgatgtggaaataattatcagcatgtaaaagactatatatatattcaacaattctgatcccctgaaaaattcaaatctacaactgatttgcttcctgggctcctgaaaacaactttgtcaaaattgttcagaaatataatcagccaatcgttgccccttggggacgcaggataaagcaagtcagccatgaccaatgaggagtcggccgtgcacaattacatgcagacctgcaggacatcgagtccctgctatggtccctccccagtcaggcccccattgcctgggctgcagccagaagcattcaggcacaagtgcattcaacaaatacttatttaattgtattggtggttagagggttgcgattgattaaggcacattaatggatccgtgtcctccctgtatccaagattctgccatttgtctctgcagttcctcccactgaagaattggagtatatttctccagcccctaatgttgggtttagtcatgtgtctagctttggccactggaatattaatctgcatgaccaaaaacttggaaagtntgcattcatttgtgctcactcactcctgctatcaccatgagaacaagcccaggccagnctgctgcttccagcagaagataagagacaccaagagcaaagtcagagcttcccagacatgctcatgctagattaaccaatcctcagctgacccatagatccatgaaaataaangantgttgtattaagccactgagatttggagtgacttgttatgcagcattttgtgacaacaactaactgacacaagagtcaccgtcctttatctctgtagattttaaccaattttaatagctagatggagatcttctagttgcctttatttataatgaatatgactgtagagctagtttggcctgacactaccagtaacctacccagaaattcagaaatactttcttctccaacccgccccaaccaactttttgtttgtttgtttttgggttctccctctttgcctaggctagagtacaaatggnacagtcagagctcactgtagcctcaaaatcctgggctcaagtgatcttccccttcagcctcctatgtagctaagactacagacatgtgccaccatgcctggctaatttttttattcttgcagacagagggtctcactatattgcccaagttggtttcaaactcctggcttcaagcagtcctcctgcctcacccttccaaagtgctaggattataggcatgagccaccat

SEQ ID NO: 559942 - DNA, 769 bp, Homo sapiens
  misc_feature (656)..(656): n is a, c, g, or t
actagttctactcatgaggtgatgggccccaagaagaagcacctggactatttgatccaggctaccaatgagaccaatgtcaatatccctcagatggccgacaccctctttgagcgggcgacaaacagtagctgggtggtggtatttaaagctttagtgaccacacaccatctcatggtgcatggaaatgagagatttattcagtatttggcctctaggaatacgctattcaatctcagcaactttctagataaaagtggatcccacggttatgatatgtctacgttcatacggcgttacagtagatacttgaatgaaaaggctttctcctacagacagatggcatttgactttgccagagtgaagaaaggggctgacggtgtcatgaggacgatggttcctgaaaagctcctgaagagtatgccaatcctgcaggggcagatcgatgcactgctggagtttgatgtgcatccaaatgaactaaccaatggtgtcataaatgctgcatttatgcttcttttcaaagatcttatcaaactgtttgcttgctacaatgacggcgtcattaacttacttgaaaaatttttcgagatgaagaaaggtcaatgcaaagacgcgctagaaatttacaagcgatttctaactagaatgacganggtgtctgaattcctcaaggtcgccgagcaagtggtatgatcagggtgacattcccgactcacaaagggttccagagtcttatgagacccttgtaccaatctaaataccttaa

SEQ ID NO: 559943 - DNA, 117 bp, Homo sapiens
  misc_feature (75)..(76): n is a, c, g, or t
cccgacctctcggtgacaccaaccaccccaaagaggggtccctgctccgtctcacagggatctttttgtatattnngcttagcatcatacatttgccatgttgtttcatcatctgcc

SEQ ID NO: 559944 - DNA, 200 bp, Homo sapiens
  misc_feature (10)..(10): n is a, c, g, or t
acgagtctgnttggctcgtgttccgtcggtctgggctcccgcagacgctgtttctgctcactgaggtgctcttctgggcgccgcgctgcatctgctccctgtctggaatgggccgccccgggcttgggcggccggctgggccccgaggcgcttccgcccgtatggacgctggtgccgccccccccagatgaaggcgcagg

SEQ ID NO: 559945 - DNA, 263 bp, Homo sapiens
cgctctgtgagactctctacaccgtcctgccttcctctcgagacagatgttgcagctgggtacaccaatctgcttatgacgttgaaagaacccaggaagttaaagggttagtggcagcagcaccaaaggaagctaaaggaaatctgttgagaagaagctgggaaaggtgaagggtctctggcgacagcctcccgagaaggccttccaaggtcagagtgtgacaatgttggcagccccttctgcagagaagtcgctcaaggatc

SEQ ID NO: 559946 - DNA, 224 bp, Homo sapiens
  misc_feature (198)..(198): n is a, c, g, or t
ttgggggtactctctactagagtggagccacacttcgtagtgtgtggaacaaaccaagttaaagaaagaagatatttatgcagctggagatagattggtggtgctagcacgaaatcccatggcggtgaagaagaagaaggaatctatcgcaatatgtgtatgtcgggtagagaggaatcttctatgatacaacctaanttaacaagtgcgtgactttgagatag

SEQ ID NO: 559947 - DNA, 431 bp, Homo sapiens
tctgtcggtccgaaccttattgtgtagagggaaggttatggtcgatatgttaggtggcgcttccaattaggtgcatgagtaggtggtctgcagtaatgttagcggttaggcgtacgtgcagggctattggttgaatgagtaggctgatggtttcgataataactagtatggggataaggggtgtaggtgtgccttgtggaaagaagtgggctagggcattgttaatcttagagcgaaagccaataatcactgcgcccgctcataaggggatggccatggctaggtttatagatagttgggtggtaggtgtacatgacgtaatggcaggagtccgaggaggttagttgtggcaataaaaactgatacggatactagtataagagatcaggttcgtcctttagtgttgtgtatggttatcatttgtttttgag

SEQ ID NO: 559948 - DNA, 285 bp, Homo sapiens
gcttgggtgtcaatgatgatttttctgaggaagtacccaaacaaaaaaacctcatgaaagaggtaaccccctttgtaaagaatctgtaaccaataccatgatgttcaggcggtgatcggggctcccggactttctgaagctagaaaaatgctgtgtctcccaaccacttttccatccccagcccctctcatccttggagcactctgccgctcaagagctggttggtccattattggtaagacattatccgtaatggttgcaaaaaaaaacaaacagagggggtgt

SEQ ID NO: 559949 - DNA, 511 bp, Homo sapiens
  misc_feature (469)..(469): n is a, c, g, or t
ttcgggctccttgcaggatgtagcgctcatccaggttgtagccataggcctgggtgccctcccacgccctttgatacagtatagtacggtagagttttcccatgtcttgggagggggagatatgtggtgtatcgggtgaaaacgtatattggcccttggcttaatgaaatgtttctttatatttaacatcacttggatggacagaataaagctgggctagaacaatctcgggaggatccaccagactggtaacgtcaggatagttggcaagggcatttttcttatattggatctgactcatcattgccgggttctaagtaacccttacatggtccacagaatccagggggatccagccaatggcctcggagccactccaggtcagctcggtagacattatcactcggtaggtcataggcctttctggccttgaataacatcgtgcgggtcgggatgacacatccagggnggcaagtaattacgataatcaatatcatggacaagggtctgg

SEQ ID NO: 559950 - DNA, 135 bp, Homo sapiens
caaaacgaagaatacagtcctcgatgttttggcccatacacttcagtatttgtctaatacactgtcttctttgtagcgatgctaggccctgtctagcactgtgcttggtgtgagttcaccacatctagtggtaac

SEQ ID NO: 559951 - DNA, 115 bp, Homo sapiens
gctcttctctaatcgctccgctatgaaaggtcgttgtcacacgattaaagtcctacgtgatctgagttcagaccggagtactccaggtcggttatctatctacttcaaattcctc

SEQ ID NO: 559952 - DNA, 345 bp, Homo sapiens
  misc_feature (16)..(16): n is a, c, g, or t
  misc_feature (111)..(111): n is a, c, g, or t
  misc_feature (135)..(135): n is a, c, g, or t
  misc_feature (144)..(144): n is a, c, g, or t
  misc_feature (165)..(165): n is a, c, g, or t
  misc_feature (167)..(167): n is a, c, g, or t
  misc_feature (176)..(176): n is a, c, g, or t
  misc_feature (178)..(178): n is a, c, g, or t
  misc_feature (180)..(180): n is a, c, g, or t
  misc_feature (199)..(199): n is a, c, g, or t
  misc_feature (228)..(228): n is a, c, g, or t
  misc_feature (237)..(238): n is a, c, g, or t
  misc_feature (252)..(252): n is a, c, g, or t
  misc_feature (269)..(269): n is a, c, g, or t
  misc_feature (322)..(322): n is a, c, g, or t
tcgtattcctgtttgntggtccacatctgctggaaggtgggcggggaggccaggttggagccaccgatccagacagggtatttgcgctctgggggggggatgatcttgatnttcatggtgcggggtgctagggcngtgatctcnttctgcggttcggtcgggaangncagggtacntngnggtgccccctgataggacnttgttagcatagaggtccttcctgatgtnaatatcacnnttcatgatgctgtngtaggtggtttcagggntgccagcagactccatcccgatgatggatggctgggcagggtctctgggcagnggaaacgttcatttccgatggtg

SEQ ID NO: 559953 - DNA, 415 bp, Homo sapiens
gacacatggtactctatgatatgaagatatccgtaaaccatcctttccagtgacttaaggaattgttctcacatatgactatgttgaacacttcgagacctcttgaatatggtactgcattgcctcttacataaaagaacatagtatgatgtccgctgtagaactgcactgtgacaggttggtcatactgcaaaggatatcatataatattggaagcaggtgtttgcttggacagaccatgactagggtcgccagtctggctacgctgtagctaactcggatgccggagttccatgattagagacagactgatggcctactaccaagtgcattccaagctgaacgatgtacaaatctatcggtcgtgagtacgtacgactatccgcacatactattcatactactaggactggcg

SEQ ID NO: 559954 - DNA, 232 bp, Homo sapiens
agaagttcaatagcagttaagcatataactacagtctgcagggactattctaaatattcatattagtgtcttggtagagctctgattttatgacagtttatgaaacatcggtgcacaggtgaactcaattggtgctaatggctcttcacggtgaagagcaatgttagagaatacaagccaccacgtgggtggtatttgaatatagtgtgctattgaaacttctaacactagg

SEQ ID NO: 559955 - DNA, 415 bp, Homo sapiens
  misc_feature (415)..(415): n is a, c, g, or t
ctaccgcctgccggaggaaacaaaggatgttctgggcacgcatcagtgccctgagtgaaatggagctgcgctacaccatttacgttaacggcctttgctagagagagtatagtcctggtactacaaggcagggactgttttacacagtttttggttatacatgatcatcatcagttatgtaacaacaaatgagagcatggtagatgacatttaggggcacccatttagttgggtcaggccaacaagagtattaacgggaacgatgcatcatatttgccaacaacagaagaagtcctgctcgcaggcaccagagacgaagacgggatcgtctgtctgacataatggcagtagtggggatgatgactatgaccatctacattacgcacatccgcattcgacaggatcctctagctgn

SEQ ID NO: 559956 - DNA, 88 bp, Homo sapiens
  misc_feature (5)..(5): n is a, c, g, or t
  misc_feature (27)..(27): n is a, c, g, or t
attcnatctcggtaccccattggatangcggatgagggtagaggtttttgctcactaatgaatgacatgaacctagaaaagtgcttga

SEQ ID NO: 559957 - DNA, 786 bp, Homo sapiens
  misc_feature (162)..(162): n is a, c, g, or t
gtggggggggggggggcgccccccccttcttctctttattaataaaaaaaaaaaaggaaggggtgtgggttttttttctctcctccccaaaaaagaaaaaaaaattattttttttttctcaaaagggggggtggggtgtcaaaaaaaaaaaaattttctctnttctctcttttttttcttcttcaacaaaaaaaaaaataaaattgggtgtggggaggggggggctcctctcctccccccccacaaaaaaaaaaaaatatctctctccccccgcccggcggggcgcgcgtctttgttttttttttttttttttcttcaccaaaaaaaaaaaaataaaaaaaagaagagaggcggggcgcgcggcgcgggcaaaaaaaaaaaagaaaagggagggggggggggtataacccaaaccccacccccccctccctttttttaaaaatagggcggggcgcgggagattttttttcctccccccccgaggggggggggcgccccgcgggcgtggtggagaggggaaaaaaaagggagggcgcccccaaaaaaaaagtttttttttttttataaaaaaaaatgtttggtgggaaggcgaaatatattatatagggggtggggcgcccccaaggatttttataaaattttcttcgggccgccggaaagaggggggttataaaaatttttttttgggcccccaggggggtttgggaaggttaaaattaagccccaaataataggggaaagggaaccctcctaaggggttaaaataagaaagtatgggcctccgtc

SEQ ID NO: 559958 - DNA, 169 bp, Homo sapiens
  misc_feature (158)..(158): n is a, c, g, or t
gactcggcccgcgtggttcttgcagagaaggtgctgcagtttgacccaggaccaagaacgtgacggccctgctgatggaggcgaaagagctggaggcccgggtcatcagtcctttctgccagcgaggacgatgctgccagcgtgtataccgcgcagcncgcgatgctga

SEQ ID NO: 559959 - DNA, 296 bp, Homo sapiens
atcgggaacaagcccgttgtacccttggctggacatggccaagacccaaggcattccccggcggcaagctgaccgcccagcagtttggcttgattttcagccgtcatcattgggttttgttttgacagctttgctgtcccatagggacttcgactgggaccaggtcaaccccgccaggggggggtccccagccttttctttttttctttctttttttttttttcccccttaagctgctgtcaatccaaacccttggcatcatcgttttttttgaattaaaacccccatatcagcca

SEQ ID NO: 559960 - DNA, 349 bp, Homo sapiens
tacagagtctgagtaatctgggcgggcacggtggtctgtctgtaatcccttggaaggccgaggtgagtggatcacctgaggttgggagtttgagaccggcctggccaacatggtgaacccctgtctctactaaaaacacaaaattagctgggcgtgttggtgcgtgcgtataatcccagctactcgggaggctgaagcaggagaattgcttgaaactgggaggcggaggttgcaggttgagccgagatcattgcatttgacaccaaggcctggggaaacaagaagagaacctcattcttcaaaagaaatttaacaacaaatcaacaagggtttacacagccacccaatc

SEQ ID NO: 559961 - DNA, 119 bp, Homo sapiens
tctgtttcagccagtcgccaagaatcatgaaagtcgccagtggagcaccgccaccgccgccgcggccccagctgcgcgcatgaaggccggcaagacagcgagcggtgcgcgcgaggtgg

SEQ ID NO: 559962 - DNA, 140 bp, Homo sapiens
gtaatgcgcagtctgaggagaacgacatacatgggctccgcaacggtcattgatgacaccaatatcgcagcgactgcagctggagacagagatcgaggctctcaaggaggagctgctcttcatgaagcagcaccacgaat

SEQ ID NO: 559963 - DNA, 786 bp, Homo sapiens
  misc_feature (1)..(1): n is a, c, g, or t
nagaaaagtctgtggtttctaaaagtgcttcctgcagggtcttattttcaaagctttccttggaggcttttggtgtgttttaggtggggctactgtttctccctctggcttctgccctccctccttctctccctcgtctcctcatcttccatttctctctccactcaccttcttctctgcacccccgaccccagcaggagaggtgagagctgtggggaggggggggtttcagttcactaccccggattaggttttcctatcaatgcacattcctttgtcctcttcaacaaaaggacgaaaagcaaaaaaccacaacccacagctttctagttgctggacttaacccaattttcctgtaacccccaggcatgtctttctttctacctttgactcagatatttatcagcagatgataaaatgcaggcaaacccagaaagctaaagtctttggaaaaaaaatagctgttcttacacatctttcctcatttgcatgggcctttcccttaggggcactgggcaagtccatgtattcttgggtatgcagtgagcacagctcaaagggggttctaacacatttttataagattgcgtttcctaaatgaatctcttccatttaaggatttaggcataattaaaaatctgtagcgtttttgtgaaagcaaatttaagtttaacttttggaaaagttacagactgctcttaggtgctaaaaaattacaatggtaaaatacggtttagcctgtttttgacttgaaatggagaaaagtggcagaatctgggcagagac

SEQ ID NO: 559964 - DNA, 1773 bp, Homo sapiens
  misc_feature (1134)..(1134): n is a, c, g, or t
  misc_feature (1424)..(1424): n is a, c, g, or t
aaaagccaatatgggaaaggaccagactcaggtatcaatcattgtcatcataggaacacgtagagttcggagcgaaagtacaacactgactgagcacatctgagtctataaatgcggtgtggcatgtcgaccaaagaaaccattgaagaaacttatgagaacggagggctgcgtgagaatgggaaaagggcttcctatcacacgtatgccttggagtctatgcgataatcatgacaagcctgtacgcgctgcaacgctggataattgactcatttgacatgatcatctcttggtgagtgaatacttgtggagaacccaggcgaagtgttacttatgttgaacgtgagtcgagtttaggatgccgcgcctagggtacaacaggagcacgttatggatcaagaaaaaacaattgactctactaggggtaagcaatttttccgagggcgtggaaccgttgtggcgttgttcccttgggtagttgggtctcgcgtgggcctcggagtgtaagtgctcgcacatttttccgagacgcccttgtggtaattcttgcgccaaagggaaatttcgggggtccacggaagcccacaaggaatcgaatggcgaatttgccctctattatctatgaggcgccttcttagcgaaactagcaattgtggcgttgcgtgcgaataagacccacaagacttcaaccttggggttcccggaggtagttataaaagcaaaaccacatactctggggacttttccccaagccttgggaatggcacccaagaaaacaccggtaaacccatagggcgccgccacgtcaacaagggcaacgacctgactttgaaagcgccgaaacacacagtgtctggttgctccatacgccgcagacagagagcgtccctcacggtcagcgacacacgtaatttacacctacattttctgcatacacgggacacacaccaccacccttttgcgggcggagcgttctacccgagaaagagcccccacacgagacaaaccacaccaaaaggtcttaacgcagcccacaattttgcgggggtgaaggcgccacgaagacatctttatgcccgtaaggggagtttcgccgccgacaaacttggcgggattgggaccgcaaaacaactntaatttggtcctttagagagggcaacgaagcgccacaaaatagtgtaggaccttttagaaagaagccaaacttcggtcaccattatgaggggcgttcttctcacacaggggcagcaacgttcttgcggcatacggacgggtcccaccaccctgcggttaacacgcggaaatggtaggacaaaattgggcctcacaaaattgggagaataccccagactggcctctagagccatacgggacggggctctcgcatggcgagtagctcgtcgccaattctcccgtttaaaccnaaacccaaaaagagttgtagcctcctccaagacctgtgcgacactagagaaggccctcttgtttgtgaacggcgcgcagtgtgcgacaacttgctctccagacgcggcactggtagtctgctaacccaaaatagacgaactcggccgtagtgagcacaacttggtgacgtgaccgcacggggtaccgctccatagcctagtaggcccgagcagcagtacatggaccgacaacagctgtagcaggcgcttgatctgacgacactaccgccgggaggacagaggagggtagagcaaccaccaattagagtagcttcacgagatcaatacaggacgtactaaccctcgcggg

SEQ ID NO: 559965 - DNA, 131 bp, Homo sapiens
gcccaaacccactccaccttaccaccagacaaccttaggccaaaccattttacccaaataaagtataggcgattagaaattgaaaacctggcgcagtagatatagtaccgcaagggaaaagatgaaaattt

SEQ ID NO: 559966 - DNA, 233 bp, Homo sapiens
gcctggtataacactgcactgcgtagcagtactccttagcaggactgataagctcacgtaacctaccacatgctgcttactgctagtcattctgtgcatgccattacgctaggtcttgaactccttaaccccagttccttgactagtactgagtacatactgaataaggcactattgagttacctctttcgtgttgctcccctgtgttagatttctaggtgtacagaccgtcg

SEQ ID NO: 559967 - DNA, 162 bp, Homo sapiens
cacgaggctttttctcaaccctgactttcaaatgggctttccaccctaggacaatcatgctggatttgcgcttttcttttgaggtttccctggccctgataatactaaggggcttggagacctttgggccacatcactcctttcattgcggttgtctctgct

SEQ ID NO: 559968 - DNA, 799 bp, Homo sapiens
  misc_feature (40)..(40): n is a, c, g, or t
  misc_feature (80)..(80): n is a, c, g, or t
  misc_feature (116)..(116): n is a, c, g, or t
  misc_feature (767)..(767): n is a, c, g, or t
tgagacagggtcttgctctgttatccaggctgctgtgcantggtgcaatcacagctcaccactgccttgacgtcccaggntcaggtaatcctcccacctcaacctccaaagtagcnaggactacaggcacacaccaccacccgtggcttacagatattgctttaatttctgaaaatatttaactgagaagtcatagtacctcataataggcaattttaacagatatattgatctgaagatatccttccatgtaaagcaatggtacatgagtatgataaggagaatgtatggaatgatattgtttcttagcaattaataatttataaaaacataaacagtaggcctgagattatacttgactataatacaccgatatatgaaattaaaagttatatttcacctattaactagtttaagaataagtactttctacaagtctaatgtcaaaatcattttcatgtatatatattataccacttcttattggaatgggctagaaggaagtactccattgcaataaaatataaccacaaaggctgagtggagtggctcacatctataatcccagcactttgggaggccgtggtgggtggatcacgaggtcaggagttcgagaccagcctggccaacatagtgaaacctagtctctactgaaaatacaaaaattagccaggcatggtggcacacatctgtaatcccagctactagggaggctgaggcaggaaaattgcttgaacccaggaggcggaggttacagtgaaccaagnaacggcctctgcactccagactgggagtctca

SEQ ID NO: 559969 - DNA, 841 bp, Homo sapiens
acgttacatgtaaattgtcgctacgatttacagtgaaggcacagttcgtaggggtaacagaccatgtattgggctcaagagcctgctcactggaaggcttactggaaaacttactggaaggatgggaggacggggttggtaatctatttgtagaaaacatattcagccctgcgcaccacagccagctggctgaagagctcacaaggcccgaaatgagccagagagagagatgaagcatgagaaatgagcaaagaacacccaggacatcatattttttggacaggttagcagtacatgaaaatagatggcgctctccctccgggactggcgtatccctgaataatcacgatgtctctcacttttatcagttttttctgagctcgcattgggggaatatattttcggctgcctgcaccatggtcacacgaatctattacgaccacgcatacagcgcttctcccctaacacgaagcttattaggggtcacggcccccctatttcactgacaaactcgctaccgcggtcaaaaaacagggtcccagcccacccatacgcggcccctcggcctcagccgtggaccccccgcgccgctcgctttaacggggcgtcaaggcatgactcctgttgcctgctttataaccttggtgcgctcggcgccgggacgggcataactaacccatacgctgcctcatcgtttttcaccgatatatcggttccctgtgaatgagatcctcgccgcaggccgggccggtcacgcatcatgacaaggtcttttgtgggtgtcttccttcgcttcctcccctggagtgccgcccgatcccggccgcgagccacgtggtat

SEQ ID NO: 559970 - DNA, 244 bp, Homo sapiens
tgaggccactctggacagactgtctaatgccggaacatcctacttccctacttgattcctcactaaccaccttaacttcacaccattatacatctccatcctctccagccccgctgagtgtgaagccactactctccataccacaggaggcgcaaactcgccacagccctccccggaaagcaagggcccacaaaaccacaaaaccactccacacccaacgcaccccagaaccagacccccaccc

SEQ ID NO: 559971 - DNA, 260 bp, Homo sapiens
ttactgttatttgcggattttgttttattttttgaggggaaaattctatccttatgacactattgcaaccaaattggctttcccattttggctttagtaggaataaaagacaatggattcccatctttattgctgtaatgtgttaagcattaaaggctagaaaaatctagtttaattgtttcaggtggaaagtattttttgagtttccaaattgaatgggtttggactaaacaaacaatcaactactgatgtttgcagca

SEQ ID NO: 559972 - DNA, 451 bp, Homo sapiens
  misc_feature (35)..(35): n is a, c, g, or t
  misc_feature (61)..(61): n is a, c, g, or t
  misc_feature (68)..(68): n is a, c, g, or t
  misc_feature (94)..(95): n is a, c, g, or t
  misc_feature (116)..(116): n is a, c, g, or t
  misc_feature (123)..(125): n is a, c, g, or t
  misc_feature (256)..(256): n is a, c, g, or t
  misc_feature (273)..(273): n is a, c, g, or t
  misc_feature (277)..(277): n is a, c, g, or t
  misc_feature (283)..(283): n is a, c, g, or t
  misc_feature (287)..(287): n is a, c, g, or t
  misc_feature (314)..(314): n is a, c, g, or t
  misc_feature (325)..(325): n is a, c, g, or t
  misc_feature (340)..(340): n is a, c, g, or t
  misc_feature (352)..(352): n is a, c, g, or t
  misc_feature (371)..(371): n is a, c, g, or t
  misc_feature (373)..(373): n is a, c, g, or t
  misc_feature (450)..(450): n is a, c, g, or t
tgcgagaggggggcgagagtatgagaggagcaggntggaaggggcttgttctgcgtgcgangggatcngtttttaaagaaatgggtgtggaagnngggcacggtggcgtgcaggcntgtgatnnnatcacttgtgggagggcaaggcgagcggatcacctgagatgcggagttcgagaccagcctggccaacatggtgaaacccgtctctactcaaatacaaaaattagctgggcgttgtggcgcgtgtcctagtntgtgtgtgaagtgcctnagtnaacgtnaggntggaggtgttaagggcggacagagaanccttgtccctnccgtggtcccctctnaatgcttccacnggggtgtctggcggtagtnangagggagacccccggtccttacagctgggcagggagggcaggcagggcgtgtgtaaccgggagcaggggtgttcgtnc

SEQ ID NO: 559973 - DNA, 306 bp, Homo sapiens
  misc_feature (1)..(1): n is a, c, g, or t
nttatgaatagcacctctggcctccatctcctaaagtgctgagatttacaggctaatgcctggaggtggaggccaaaggatcacttgagcccaggagttcatgaccagcctgggcaacatattgagaccctgtctctaaaaataaaaattaaaaaaattagcctagcatggtggtgcatgcctgtagtcctagctacttgggaggctgaggcaggaggatggcttgagccgagtaggtcaaggctgcagttagttatgaccatgccactgcacttcagcctgggcaacagagcaaaaccctgtttc

SEQ ID NO: 559974 - DNA, 121 bp, Homo sapiens
ttaaggacctacagtaagaggaaatctagacagagactcagaatagtgtctgagcgctcagtcagctttaaggcaggatggcacacgtgctgcggctcgtccagtgcgcacgtctggcgtc

SEQ ID NO: 559975 - DNA, 109 bp, Homo sapiens
gagctgaggaggagtgacgggtgtggtggaggaggaggatgttcacatgcagtcccaaagaaggtggggagaggcgtgtgggggtctggaaggggaggctgtggtgtct

SEQ ID NO: 559976 - DNA, 1047 bp, Homo sapiens
  misc_feature (172)..(172): n is a, c, g, or t
  misc_feature (343)..(343): n is a, c, g, or t
ggagagaactagtctcattttttctttttgttggttttctcttaaaaatttattgggtcctggaaaaaggagaggcaaactcctgcctcccgttcaaagtcccccaaaccctcaatgtattcccgtggccattgattggggacgggttcacagtactcaaggggagcgccangagaaaggccattgagctttgggccggagcgcataacggccgccccaaattattcgctgaacagcagcggggaacagcattcacaggcacatcaggggacatagagaccatcagtggattcacgaaatggacagctccacgaacaggtttggatcaatacacggcaaaagngacatatcgtgtgtcttgccacatcaaagtgaggagggtactgtgaccatccccgtggaattgcgtggcagacagcatgaggggtatctgcagaaatgtgctcttacacttatgccaccggagacagagatgccttttacaaaattagttacatacctgtgaacccgcgacctttcaaaaatcagtattgggggtggtgagaaactgaaagggaaagaaacagatatgatcggcctaagcagaggaagaagattacacttccagagaagtcgcggattgaagaattattcgcaacgcaagttgtttaactacacacacacaaggggagtagaagaagtagacatacacgttgccagtggaatcccagtattccgctataaagagaggcccaacaaaagaggggtagtcgcacgtgaccacaccaagggttgagacaagacaacaagaagacaagtcggacaaattgtagcagaacacagggcgcaacccacaaacggacgaccaacagacgacgcatgcactcccgagaaaaacgctcggtggaacaacaacgatactagaagggagacaaaggccctacaccccaccaggacatcatcaagcagcaacggcaacagagaacgaatgaagaattagaacaggcaccccccaccggatcagcaacacaacaactaatctaccacaaagggagcgcgaacagagaa

SEQ ID NO: 559977 - DNA, 1513 bp, Homo sapiens
ctgtctcaaaaaaaaaaaaaaaaaattaatgatggtcaaagggtataaaatctacagacaggaagaatatgttttatgctttttttggagttctgtggtacaggtgtggtgcctattactttaataagtggggtattatacattttcaaaattggatgtttctcattcacagaaatgtgtattttgaagttatggcattatgtttaactagcttgtgatttacctattcccattattggtattccaccaattttattgattattcacctttggtaaccccattacattttattaccaatttattaaatttggtcaattttaccaattaacaaaattttttggtgggctgtcttttataagaaattcacgatatttcgtgagtgaattgggctcaccattaatttgggcgcggaccattgggtcttatattaccgtgaccttacctccaattaaaccatttctatttaacagtgttattaccatagggtgccttaatctaagcagagtggttccgtgcccctctcctaagaacacctctcactatagtgggtgggaacaagcacaacaaccattgttaccctctgacattacacattgccccgttacaaaaatatagccacggtgccataggggtctaacaaaggtttctcacgaggcgccagtgtctcagtgggcgccaccatttaagcgggctcggccattgcatgtttctttcctacactggggttggggcactgtgcagcacggcgcagcgcacacggcgcccagtctgggtcccacttgtgggcttctcgcacggcttaacctctctctccaacactccttgcacctaccgggttgcccctccccccgaggctcacactttctcgcgcactctgggacacagtactgcataagcgtcatttaagggcaaaacaacgaggtttagaccgcctccttttagggaaaagagattcgccacttgtacatgcgccctagatgtggtagtttacaaattccaccccaaggtcacatcttaggtgggggcaacgaacactctgtcagcaggggtggtgcggccaccagcaacttctaccctcttgcacggagtgctgcaggagacattccgtgacaaaaccgactgctaccgtggatcgacgaaaaccatgtgtgtgtagcaaacgcccccaagccttctctacagactagatggataggcttccccagcagctacgttcatgcctgcgtggtccctgttcgtgtagcttgaccacaccccctggttgtggcccccctcgcgcgcgcatttgtactagcgacgagttccagccgcgctacatacgtccgctgtgtgaccccgccggctcaggcgccaagcgatagatccactgcgtcccggcatagacctcccccgggtgttcctcaccgtgggtcacgacagacactcttggttcgtccgctgtcactcactaccacactgtttccttgtgtggtgcgatggacgtaactactgcgagggagtatcgtgtggcgg

SEQ ID NO: 559978 - DNA, 368 bp, Homo sapiens
atctggtaatctaaatccactccttccacagtaccggatcctctctttaaccctccccttcgtgtcgcccccaatgtttaagatatgttaggatggtttgttgtgctgcctggagacaaggtgctacgatagatttaagtgaatacattaacggtgctaaaaatgaaatttctaacccaagacatgacattcttagctgtaacttaactattaaggcctttgccacacgcataagtagtcccatctcactcttgccatgcgtagcttagcccattgtcttatcggcacatgggtggacagggatctgctgggctctgctttaaacacacattgcaatcacggtctctcagggcaccgagcctcagaat

SEQ ID NO: 559979 - DNA, 421 bp, Homo sapiens
acgtcttccatattactgatcaaaggggaaagtcaaaaggaaaagttgagatttctgccagtccacagtcgggttgtgagcatcgtctggattcctctgagccaaagttcttgtgacagttaatacgcagcacagtaaaggctgtcatatatcgtatgcaccatgactcggaagttggccagagtctcattgctctggctgaggaagcactccttgaactcctctacagctgcttcggtttgctcagtgtcgatgaacctctgaagatctgctttgtattcctccacagaaaccgatggatcgatggtcttttccacgacgctctccagaagaacgcaaccagaacctgcatagcagtaaagggggagggcagcaagcaggaggaccataaccaccttcatgttgaggctgctgtgtttgg

SEQ ID NO: 559980 - DNA, 724 bp, Homo sapiens
gtaaacagcctgaggtgatctgtgaaaatggtacgctatatgcatcttggagccggagaaacccacgaaatcgatgcaaatcaagcaggttccaatcttcggtgttcacttgaagaacagcatcgtgaaactgctcaggccatcaagggatatgcatatacgaagaagccacgtaacgttcaatctggaaatgatgctcatcgttgtagcagaagactagtgtgtaccattccgatgttcccgaagggtgggagttggacgaggtgtgcgcaggccaagacaatgggggctggacacgaggtcggtgggccaaaaagaggtgctgaatgttggctgcacatgcattagaaacaagcgcgagagagtaatgcatgaactataagggtttagatgtagattctctggtcattgagcatatccaatgtgaacaaggcaccgtaatgatgcgccggctggacctacaggagctcatggtcggattaacccagtacatgagctctccctgacacattgagatgatccttacggaaaaggaacagatcgttcctaaaccagaagaggaggttggcccagaagaaatcagatatcccagaagaaactgaagaagacaaaaaacttatggcagcgggagtaaattcagcattaaagataaagtgtagattaaaacggaaagaaaatcaggacaaagacccgagggctataaggcagggatgggaagacaagg

SEQ ID NO: 559981 - DNA, 765 bp, Homo sapiens
aacctaggctagtacgtgcctcgtgggttaatcggccgaggcggatgcccgtacatgtcgtgtgatgtcgtctattgttctcgggtactggtgatatatcgtgggctggctgcacgccatcctgcctgctcctgtgagttcatgtgatacctacttatgatgtgatgaaactggtacacgtgctggggaagctcctgactatgatcgaatgccaatggctggatgtagaaatatcaagctagacctagtgacttacctcaatactgccctacctcctggatgggaatgaacaacgatcacccagagcaatgccatctatgcgctacatcgctacgcaagcacaacatgtgtggttgatgacttgaagaagaaaatgattcgatgtggacatcatagagaaccaagtaatggatttccgcacacaactgataatggctctgttacagctctgaccacgaaaaactgaagcctcagtacttgtgaagagctacctggacaactgaaacaattctccatagtatctgggtgaaattctcatggtttgccggtggaaaatgctcacctttgtggatatttctcacctatgatatcttgcgatcagaaccgtatatatgaccccaagtgcctggcatgagttcccagaacctgatgtgctatcatgtgccgttctgaggcttgggagaacatcgctgcctacttacagtctgatcagtactgcaagatgcccatcaccacacagatggccagtgggcaacaggctgatgc

SEQ ID NO: 559982 - DNA, 360 bp, Homo sapiens
  misc_feature (201)..(201): n is a, c, g, or t
  misc_feature (258)..(258): n is a, c, g, or t
  misc_feature (262)..(262): n is a, c, g, or t
  misc_feature (313)..(313): n is a, c, g, or t
  misc_feature (356)..(356): n is a, c, g, or t
gagatgccagacactagaagatgaagaagagatgtggtttaacacagatgaagatgacatggaagatggagaagctgtagtgtctccatctgacaaaactaaaaatgatgatgaagatgatgatgaggatgagataaggaagataccgttaccattgtcaaagaaagcaaaatttgattcataataatggcaacggcctangatcagtacctgttgaaaaaaactggtcttcacccctccccatactccacacaaagngcantggctttgtgaatgctgacacagatcaagcctttaccttgcttctgttatnagtgccaatcaatggacaggagaagggatatcatatattaggngctt

SEQ ID NO: 559983 - DNA, 552 bp, Homo sapiens
agggaggtgctgaattcggttgtccaaacagtgcctcaggtggaatgtgtctcctggcatatctcttcctgcttctgctatcttgctgatgcacgctacttggacaagtggccttgcaccttggaactgggcctgaggagggagaagttattcattcccttaagcgttcagaccccagggagaatctttcattcctgtctatttggttatagaaaaaaagggacaactttctcaataactacttcaggcatgacataggagtggcatgggcaccttcgcaaaataaaaacttaatttttggggtcttcttgagagacgggttggtatccatcgtgtcattgtagcaggagcatggtctggattgtctggcagctaactttagtttcaataagagttttaatggcttttattattagtgggataacacaggagagaaacaggaggaacccagtgatgaagattactggtcctaccagcattttaaatccccctaaattagagaaacaacctccttaaagatttgtagggccccaccccttccaggtttggact

SEQ ID NO: 559984 - DNA, 1438 bp, Homo sapiens
cagcctctgctggtctacgataagagacggagggaagggagaggaaggcagtgctaacaccatccaaatgatttgtttgaacattctttgtcctgcgagctcgtcgcttcagttggtgatgaccctgcttatgtaaacgcgatgttctctctgttgcccccgtagtggtagtgtgcgctcgaaaacctggttgacataatctctctgctgtgtcttgcctcggtgaaaagaggattgtctccaccgagggggaagttctcgggaaccttgcacaaatagatttttggggtgctcaagacacccatgtggtcttgcccctctgtttatgttgttttctttatttcgtcgcgcgtctcgtttggcctccctggtctttcgccccccgattgtgtgttatagtgggcgctctgctgtttgagactttgtttttctcccccgtcggtcgatgggagttgtctgtattttgctcctcgtgtctttgctaatccgctttagggttgggaggaatcctccagatgtacgctttttcggaaggtttgaaggccgttccactggagccccctttgtcgaaatacgcccccgtaacccgtggttgttaaattcttgtgggcacaacacagagagggaagccccccgttcgcctcgcgataaatttaggtgaaccgcccttcatattcttgttatgaattgtagctctgtctaatgaggcgcataatatgtttaatgggatatatagaataaatgtattgttgtgtttctcgccacaatgtcgcccttttttaaagaatcgcttgtttatagggtaacttgtttggggaaattgtgggaaactcttagaggagattgttgtaatttgtgataaaagagaaaactcgggaaaatattttctttggaaccttgttttgcctctctcgtgatgcaccacgttatttgtgaactcagatttgttataacaaactcttggaccacacgtaacacacactctgggggagcacaccactcttgatgtgataaatgtgaataaagagaaagatatctttaagaaggtgttgtgtctcaaacccaccacaggggtgcactcggaattctttcttctggagaaagctagatcccactaaaaagtgttcccctcggaggaaaatttggtgtcacaagattgattctcgtgcacgaacccacttttggagaaacttgctcccagacccagcttgcttataataataagtaggatatttacacttttccttgcttatagtacttactataatagcttaaaaaacctcggaggaataacttgacccaagaaggagttaaccctactctggagggtgggattttgggggaatattttgtttgtttctgttttctataaatagtgaaacattttgtagtaagtatttttctaattgaagagaataaagatttaaaccaagggccg

SEQ ID NO: 559985 - DNA, 691 bp, Homo sapiens
  misc_feature (1)..(1): n is a, c, g, or t
  misc_feature (6)..(9): n is a, c, g, or t
  misc_feature (11)..(11): n is a, c, g, or t
  misc_feature (15)..(16): n is a, c, g, or t
  misc_feature (28)..(28): n is a, c, g, or t
  misc_feature (35)..(35): n is a, c, g, or t
  misc_feature (47)..(47): n is a, c, g, or t
  misc_feature (79)..(79): n is a, c, g, or t
  misc_feature (92)..(92): n is a, c, g, or t
  misc_feature (124)..(124): n is a, c, g, or t
  misc_feature (141)..(142): n is a, c, g, or t
  misc_feature (144)..(144): n is a, c, g, or t
  misc_feature (158)..(159): n is a, c, g, or t
  misc_feature (166)..(169): n is a, c, g, or t
  misc_feature (173)..(173): n is a, c, g, or t
  misc_feature (179)..(180): n is a, c, g, or t
  misc_feature (197)..(197): n is a, c, g, or t
  misc_feature (209)..(209): n is a, c, g, or t
  misc_feature (213)..(213): n is a, c, g, or t
  misc_feature (231)..(231): n is a, c, g, or t
  misc_feature (233)..(233): n is a, c, g, or t
  misc_feature (257)..(257): n is a, c, g, or t
  misc_feature (260)..(260): n is a, c, g, or t
  misc_feature (275)..(276): n is a, c, g, or t
  misc_feature (284)..(284): n is a, c, g, or t
  misc_feature (286)..(286): n is a, c, g, or t
  misc_feature (327)..(327): n is a, c, g, or t
  misc_feature (329)..(329): n is a, c, g, or t
  misc_feature (333)..(334): n is a, c, g, or t
  misc_feature (345)..(345): n is a, c, g, or t
  misc_feature (347)..(348): n is a, c, g, or t
  misc_feature (351)..(351): n is a, c, g, or t
  misc_feature (353)..(353): n is a, c, g, or t
  misc_feature (355)..(355): n is a, c, g, or t
  misc_feature (358)..(358): n is a, c, g, or t
  misc_feature (361)..(361): n is a, c, g, or t
  misc_feature (364)..(366): n is a, c, g, or t
  misc_feature (368)..(368): n is a, c, g, or t
  misc_feature (370)..(370): n is a, c, g, or t
  misc_feature (380)..(380): n is a, c, g, or t
  misc_feature (403)..(403): n is a, c, g, or t
  misc_feature (538)..(538): n is a, c, g, or t
  misc_feature (547)..(547): n is a, c, g, or t
  misc_feature (577)..(577): n is a, c, g, or t
  misc_feature (585)..(585): n is a, c, g, or t
  misc_feature (609)..(609): n is a, c, g, or t
  misc_feature (650)..(650): n is a, c, g, or t
ngttgnnnntngggnngggggggggggnggggggnttgggggggtgnggggtctgttgtgtgtgggggtgcgcggcggngtccagttatgcnactttttctggttctgctcctcatttgtttgntttcttctttttttttnntntttttttgcttttnntgccctnnnngcgntttttnngggggcgggggcggcgnggcactgttatngggnctggtactggcaccagtncnggcactgccactctcttgggcttnggngtgggcgtcggggcnngcctgggncngggcgggggtccagggtccgatatcagcttcgtcccagtgncngggnncggcagctttntnngancngngcncgntgnnnangngggggcgganctcggccctaggccttggcttcncccgcagcctcagctgcaccttcaaatccgcttccatcgcctctcggtactgagctgcccattccttgggatccttcttttgtaccttggcaggcaaacttgaggacttgcgatcttgctggtctcatagtaagngcgcaggcnccagaagaactcatatggggggggattgcnattggggnctctggcatagtccaggtacttcnggttcacaaactcatcagtgatgagcttcttcacgtccccnaagagtgaatgatgtatcccagggggcaccaaacttgcgga

SEQ ID NO: 559986 - DNA, 430 bp, Homo sapiens
agccagatacaaaaaagtatgtattgtttgattcccatttatataaacttaaaatgggcaaaactaatctatggtgttgaaagtcagaattgtggtgtacctcagggagaggtaaacactgagaaggggcaccatggagtctgccagcttctggtagtgtgccagttcctaatctagggactgataacttgagtgtgttcattttgtgttcatcatactcttcacctaatcatttgtacacttttctgtaacctttatgttacattttaaaagaagttaaagagttatgttatagaacttaatgtgcattctttagaaaaattttatcctaaagaaatgtaaatttatagtcagttctagagcttatgatgtgtctttttgaaagtttgacctgcacctgtaccctaaaacttaaagtataataataata

SEQ ID NO: 559987 - DNA, 306 bp, Homo sapiens
cagaccggtaaagaccactgcagagaacaatgtctcacacacactcgttaattccaaccaccctgcaggattcctccatgtgcagatcaagactagactcagtgtttttgtgggttttccttctttctttctttttcagactgggtcttgctctgtcatccaggctgaagtgcagtggcgtgatgttggctcactgcggcagaagcaggaactcctgcttctgcctgcttcctgcttctgccccttctcctgcccctgcagatcctactgctatccttagccttggaaactgcaggagaagaagcc

SEQ ID NO: 559988 - DNA, 217 bp, Homo sapiens
ttttttttttgctgttaatcgtaccacaatatttttaagtacgtacaaagagtctgacatgtgacccagggacccagtttcacccacgtggtctgtttggccgccagtcttttgtctctctcttcagcaatggtgagtcggataccctttcgtctaggaatggaaagtccatggtttgttgcccttgccaataacaaagatgtgggaaagtcgaagg

SEQ ID NO: 559989 - DNA, 477 bp, Homo sapiens
gtgaattacacgagtcacgactgtagtgctactgctaggacccaactgagggtgctatcgtggaggttgcgctggaagggtactacaaggtcaagctctttgaccacgcgggagttccggctctgagattggcgagggggagaaactggatctgccttatggtctggagagggccattcagcgcatggagaaaggggaacattccatcgtgtacctcaagcccagttatgctgtgggcagtgttgggaaggaaaagttccaaatcccaccaaatgctgaggtgaaatatgaattacacctcaagagttttgaaaaggccaaggagtcttgggagatgaattccgaagagaagctggaacagagcaccatagtgaaagagcggggcactgtgtacttcaagggaggtaaataccagcgagcttttactacagtataagaagatcgtgtcttggcgggaatataagtctgtgttaacgg

SEQ ID NO: 559990 - DNA, 423 bp, Homo sapiens
gtggccacaacaccttgtagatgtgggaagatgtccacggtggccacagtaagaagcctttttgtggtctctaccttctgaaatagtacatgacgcaagaaaatgtccatgcttgtcacgacaaaaactactattccctggaagtctgtggtacttttgaactctcttaaaactttaccctccttgaagaaggtttcaggagaaagaggaggccctggaaactcttgataatgccctcagcactgcttccaaggagcgccagtcatatagaccatccctgagagaaacaagagaaaacgggaaattctgacttctctctacttcagaactatgagctattttagttggcatttttgcccccatccaactttttttggcttcgctatttaaaacaaataaataaaacagctgaaaaaaaaaaaa

SEQ ID NO: 559991 - DNA, 848 bp, Homo sapiens
gtcctcacatccaatgggttgcatacccatgaattctaaaacttcatcctctttgtccctttcgagttaacattacagccacagtgacctttcaaaaatgcaaattaagttactcttaaaactctagttaaaatacttgatgtacataaagtgcttagcaaaatgaccaactcatactaagtgcttagtcaaatgttagataagtattctccagaattgatgtcaattattctctaaacagtgcattcttgaacgcagtatggcagtcatcacacaatttaggaaccaaaaccagcatcttgctccaagctaaaaaaaaagtaataaatggtcgtctatgctatgttcgcccagggtggtctcaaactcctgtgctcacagtgacctcaccaactcattctccaagtggctgccattacagagcaaccacgcctgacttaaacaagatatcttcaaaggtaacatgcgtgacattagcaacatcgtcgctattgctctaaccactctataataatacaatccattcaagcacagtccaaagaacggctgttcctcactgaatcaacagcgcagatgtacccacagacagcgatgcccgacaaaatacaattactgcacttggactccaccgaaccctgataccaagaaccggcgaggtgcatacacggccgccaggagaaaaccaccgacaccacacaacagacaccccgacaacacacaagacgcggcgaaacacagcacccgaaacgcccactacccgaaccaggcaaaaccacacaaacagcccacacaccgacagagcgaccgaacaccgggaacagggcaaaacaaacacccgacccacaacc

SEQ ID NO: 559992 - DNA, 409 bp, Homo sapiens
agagcgcagatgatcgcagcggtgatgacatacctcagcacctatgctggatattgaggaacgccgggagtttatgcgcttccaggagccgctgttgaacactcgacgcataatttcagaaatatttgctcacggctgtaacagccgacaggaggcctcactctagtgctgtgtcgagactgaacaatccgttcggaccggctccactactgatcatgaggagtacaacaatgagcattacatccgctgctgctggtgccgccctcgcaatggccgctgattctctgttcgcgggtgtggacacccaggtaccagcggcagacgccaccgttcactgctacggagtgaactcctgcaaaggtatgaacgactgcaaaaacaaggaccacgcgtggcagggacccactcg

SEQ ID NO: 559993 - DNA, 122 bp, Homo sapiens
ctagaggatcccctccgctatcatcggcacctcgctattcatcggcacctacgctattcatcggcacctcgcttattacatacggcacacctcacgtactatcatcagtgcaccattcgact

SEQ ID NO: 559994 - DNA, 249 bp, Homo sapiens
  misc_feature (41)..(41): n is a, c, g, or t
aggacccaaactaccttattgcatttgaagttttacttatnctattataatctaagagcccacccaacaaggcactacacatagatgctcacactctataggctgcctgatcctggaccacctggggccctgattatgatctccacggggctgtcaatgactagggaaagctttttaagacccagcgatcatgcaatggctcaaccatggcgaatcaaagttagcataatgtcccagcaaacaatgtta

SEQ ID NO: 559995 - DNA, 691 bp, Homo sapiens
agcgggggctggttggagagcgcctcccagaccgagaaggtcggaggcagaagccgggaaggagacgtgctgaatgagcagtgaatctattactgaggaaaaccagaggaagcctgttgtagataggtatcaagttagataccgagcgtacatggcaagagctttcatcaggagactgcgttccgtaaagattctcctactagatactggctgcagaaattgcacgatcctcatggagtctaggagaatcctgcagacagaccatgggtcggagctgccacggtctatggcatcctcagaaactcaagcttggaaatcacgacgtggaccctgagatttctcacgtgaacttcaggatgtccagcttgcaccgaaggagtcgtgaccccatccaggctctgaggaaattcactgagctgtgccatactgtggctgaggcccgacctccactgccacagcagcaagatcctggacatgctggctgatggagcagatcatgatctccatgccccacgagctccagcgtcttagtcactgatgaacggtgctgcacgcagctgcacatgaccctggaggaccctgactacgaccaatacaccgacagacccaacgacacactcggcctcgtggctccccattcccacggaccaggacatatcattgttgcagcgactcagatactcgaccatga

SEQ ID NO: 559996 - DNA, 106 bp, Homo sapiens
aggtcccccacctttgcacagtggcacagcttctatccacctccaggatactccatgacagtactatgccatttatgactctcgacacgcgtgcatcagcttctaa

SEQ ID NO: 559997 - DNA, 292 bp, Homo sapiens
gatgcaggagctgagacccgagaaaatcgatgtccgtgctcccagagagttcccaaataacgtgttgctctctaaggaagggacactagccttcccgggtatatttacatgagccctccagatatattgatggtggattatgctccccaccaaatttgtccaatagggcctctatatgttcctgtgtcaacttaatcatttgtttgatattccacaccatctccggaatggcagggtccgcagccgaacgaggccgcggccgcggcgccggctcgggctccatgtccccgtt

SEQ ID NO: 559998 - DNA, 160 bp, Homo sapiens
cagtccatgtgtgagctgctggcccggtatcctgggccatggcatctgccccggggatgtggccggcactgggcagcccaatggcatgtggcggtattagtggttgggggccaaacatggtgcagagagacacagggtctagggttgatgggcatcaagg

SEQ ID NO: 559999 - DNA, 394 bp, Homo sapiens
  misc_feature (97)..(97): n is a, c, g, or t
  misc_feature (285)..(285): n is a, c, g, or t
gcaacccggacgatcatcgtagcgccgccttttcggactggctcaaggccgaatgcgtgcgattcggcgaagaccggttcgcgcgtgctgtcgaagnggaagcggcctgcgtaacgaccgccgccggggggaggctggatcggagtgcgaaaattagggctgaaggcatggccgcaaactacagtttgccatccgttggcctacgaatggcttgcgcgtggacagggcccggcgccttatctgagcgaccagataccccagattcgcgatcaacaggccgaggcnaaatccgcagcccagcaacacataggtttccatttctttgcctcttgaaaacgtgggcagcgcgattgttcggcattcagcgttgcgcgttagttaaaagccagttcac

SEQ ID NO: 560000 - DNA, 974 bp, Homo sapiens
  misc_feature (177)..(177): n is a, c, g, or t
gcatttactctgacctttcagaccggctcggtgtccatgcagctccgatgagtctgctcacttcccacagaagtcactctacgttatgaggagtgcaatactgagcaagatgaagctgggcgtcagcgatagctaagacgtcatcgtgtgcgcgactcatcgactccgtactcatcntagaagactgctggtctattggctcacctcgagtcgagacagcgcgacgggttgcgatcttgatgcttccctcctatattttgcctagtattcagaccttagaccagagaaacataacgctacagatcacccaagattttagctagtcgagtattctcacatcagagcttgtcataactcataagtgtacttatatctgcagcgaattacatcttgtcggaggactaatcgcccgcgatggtgcctgcactccacagatgtactgccgggaacttaaccccgctgagttgttgagttcccaatcgcagcgactgcatacaacgaatgcacgtaattcgactactggttcatgtgtcgtcaagtagcattatgtacttgcatgacatcggaagtcagggtgacatgaatatagttgagactccctattcgacttgcattgtgtggaagaaaaaggcactttcccggcatttcaaatacggccgcatgacagtttgcgtgagaattaagatgccgtaaaggaattgcacacatgccgcgaataagaccatcgcgtcgggttcgatgtagcatgaataggtggtgtaggttgtctccccgcacggacacgcattacaccaggatccattccggcaggaatacaccggtgatggcgatcatggggactgcctaagagaccgatcccttgggcccgtgatttgtacgccccatgctcgctgcgagcacgacttgggtttaccaggggccaaagacctgcatgggaccctcccaatgaagtgtcccagcggaaaggttaccaa

SEQ ID NO: 560001 - DNA, 125 bp, Homo sapiens
tatttgatggtccataagactttgtcaaatgtaaacctacagtttgataagctttaaaataccatgttgacagcattttgaattgtttcatagacgtacttatttaactgatgcgaacattcaca

SEQ ID NO: 560002 - DNA, 324 bp, Homo sapiens
tcctggatgtatgtcattaatatgatccttgggtcttatagaagtaggtcaggcatatatcgtgtgatatccatgctcagctcatctatgaagacatcttcctcattgattgttttgccccttgtcaaagttgctgggtacatatatggcgtcactatacttctgggatatcagaagctgctaaaaacggatcacggttccgactgagtctgggattttggcttgttgaccctcctaggtgcctgggaattgcaaacagctttctggatgaatatctggagctcaatattgccaagaaactgaggcggcagatccccaggtggg

SEQ ID NO: 560003 - DNA, 157 bp, Homo sapiens
  misc_feature (16)..(16): n is a, c, g, or t
gtgctggtgctctcgntggctgccgatgggggcgccctgtctctggccgaggcgagccggcaagtttcccgggaccctcagagttgcactccgacagactccagattccgagagttgcggaaacgctacgagggacctgctaaccagtgcttgcggg

SEQ ID NO: 560004 - DNA, 193 bp, Homo sapiens
atcttgttaggagccgaaggggatgctgagaggtccacagtctcccaatgccagcagagtctctggaggctgctcttgagagcagtctgggtcttcctctgcgcaggattgaaccctatgctagcatgcttcgagtagatgggtgaggatggtagaatgagctagtcggaagaatctagtcctgaaggactac

SEQ ID NO: 560005 - DNA, 1134 bp, Homo sapiens
tcgtggcaaaggatttataagcatcaaggccattcatgaaatatgtctctttatcaacaacaggtgaaggaaggaaaaatattgagtttcagcatgtgttattttataagtgtgtgcaagaggaatgtgacaacttcagcaagcgtgttaaaaaagtggcagaggagaacggggtaataacagaagcaagtgaagactcctggatgtccccaaggcacaccctagcggccagcagtctgggtttctcccagaaatcgagtttacagactttgctcagcctggcgggagggcccaggatcatgcaggaagaaaagggaatacgctggattctgggaatgggtcattttaaagacgctttaagtaagatgggttccatatcttacacccaagtcttggccaaccaaagaagctatcaacgtgaacagttcaaagacattccggcacaggaaagcagggaggaggcagcggaaaggtacctatgagcagcagggcccgggggcgctggccacctccctggtgcaccggataccctcccccgaacccaagggggttcatcttacagtttccccaccttgcagcagcagtgaggctcagagtacacccaaactccatacatccctcgggtcataccctgcctgtagagggggctccgcatacctaacaaaggccccacaaacgggtcgaccaccgctgggcacgaacaaaaccgttgcgtcctcacatgtaataacctctgcacacgcctggaaacacacccacacacggaatggcataacgcaaaccgcgctggcaagaaccagaattggccagaaagcccgtgcaacccctcaaggccccctcaccgaaaatagccgccgcacaagtgaaaccaaatcccagaaaacaccgaagggaccctggtacccgcacacaaggcaccgggcgcacgagtgacaacgcaaacagcaaagagacgaaccaagggacagagaaacagcgaagacaaagaaacagagacccagccaacagcacggatgaaacaccaacagccacacaacgacaacaacgcacaaaagatactcccacaaccagaagaacatgcgacgaacgacaaagcgccatccactggacgacagctaaccccattatgaagca

SEQ ID NO: 560006 - DNA, 104 bp, Homo sapiens
tcaatgaatcacacactttccggcatttctaagccgggatgacattggcatcatcctcatcaaccagtacatcgcacagatgtgcggcatgccctggacgccca

SEQ ID NO: 560007 - DNA, 274 bp, Homo sapiens
gactctgaggatccccacgcgagggccaaaccgtaagctggagactgtgtgaggtagtctcagcagtggcgatcgaagaagtgaagctgggagcactgtgtgaggtggtctctgtggtggtgatcacagaactggagctcagaggaccgtgtgaggtggacttggtggtggtgatgaaagaagtgaagcttggaggactgcgtgagggggtttcggtgatggagattgaagaagtgaagctgggtggactgtgtgtggtgcctcggcgtgtgca

SEQ ID NO: 560008 - DNA, 145 bp, Homo sapiens
tgccacggagcgagacatctcggcccgtggcatcgataaacaccggtggtatcgatgagatctggtggttatcgttgccaccagccgctgcacttcatcatcaaaagttaagtcagcatagccagatagaggaaagtctttccgg

SEQ ID NO: 560009 - DNA, 335 bp, Homo sapiens
agggcttgaccatagaggatcccgtgatgttatcgcccaacactttgggaagccaaggtgcaaggatcacttgaggccaggcatttgagaccagcctgggcaacataggagacctatacctacaaaaatatttttttaattagctaggcatggtggtgcgcacatatggtcccagctactcaggaggctgagatgtaaggattgcttgaacccaagaagttgaggttggactgagccatgattgtgccactgcgctccagcctgggagacacagtgagatcctgtcaaaaaacaataaaaaattttaaaaaaggaacatctactatgtgctaatt

SEQ ID NO: 560010 - DNA, 240 bp, Homo sapiens
ccagatcatgcactcattcaatgcctgggtgacagaagcgagactgtctaaaaacaacgaacaatgcattgtactatgatatggtctctagcatagcaaagttgggtgtagattaaccctgtgaatcattggaaagtttatcaaataccttaaatgctgttgcaacttattcattccctggttatttgggtcaacaagtacagcgaacagttggctgaactttatcgtgaactattatca

SEQ ID NO: 560011 - DNA, 232 bp, Homo sapiens
gatgccaaaaatcagagagacagaggatggatggtgtctgtcagacacacacaggtcgccagtgacattcacacacacctcatgtgagaaccatgccttaaaatagtgtgtcctatttcatacactgtacacacttcctcgataaagtaatgagatttacttacacccacacagatcctgacaaaaaagcttcaagtcatctaccagcatgctcggatatgccattcactga

SEQ ID NO: 560012 - DNA, 237 bp, Homo sapiens
gccccttgtgatattaaagagccataacaaattatctgaatataaattatcaataccaggctgggcacagtggctcatgcccgtaatcccagccagcactactgatgttttaggccacgttgattctttattgtgggggctgtcctgtgccctataggatgttagcaacatccctggtctctctacctactagatggcagtagcaccccctctatgtgtgacaaccaaaaatatctc

SEQ ID NO: 560013 - DNA, 180 bp, Homo sapiens
  misc_feature (40)..(40): n is a, c, g, or t
caacctacgtagcacaaaacttacccatttaaagtttttntttgttggtgtttaatatatgccacagctacttgggaggctgaggcaggagaatggcatgaacccaggaggcagagcttgcagtgagccgagatcgcgccactgcactccagcctgggcaacatagtgagactccgtctc

SEQ ID NO: 560014 - DNA, 1342 bp, Homo sapiens
gggcatctgactgtccatgcaagttaggaacggtcctgggagagaacgggaaagaacactcaagattatcacgcaaaatcgagcaatcactgcagcggggcttcggacgctttgactgacaatcctgcgaggccagctgatggcgactcactggctgcgctcgtggctgatctaggcacttgacgattcctgcagagcaagcgtcttcccttgcctcagaagactgcatgacttggcacgcgtgcaacccgagcctgggcacagcctgctcatctgctgctactcaccactgctggcagcacgcactgatcacagaacgccccgcgccccacactccgggcctgaccaggccacgcgaatgctggcccaacctgcacaatccactggaactgagcacgccgcacctgccactcactgcctagctcatgcgcagcaaacacagccccacaagcggcgacctattccctcctgcgaacgcagacttgctgccggccacatccccccgcaaacccatgcaactttagcccccagcatgaacagcgaccatgaaagacgccatgccacaccatcttaacccaccctattggcacactcacacattctgaacgagcaccacctcccgccacccaccccttggacgccccccacattctaacccacgtcgaacccccccaacaagaacacgacccaacccggcccgagcgggcgctgacccggtggcaagcgccccatccctttcaacagcatgacctgacacaggtagagcggacccacccaactcagactaccgatcaccccaagtctgtggcgaggctcatgacatcacccaagggaatgaaaacagaaatagaccggatccccaacaattctcccccaatcaaattagcctgctgaccctctcaaactcccacactaaccaccttcaatcacacgccccaccttgtatcccattaccaactcatacccctactgcacttataacaacgacacccaactcaaacgaacccaccgtcgccctcacctacgcataaacctccaagctgaacctcataccactcactcgctcgccaagcaccaacgacctcatctagaaccccaaatctcatactcaaccataccgaccctgcaccccacctccccacactacacaaaccaggccaggcggccggccccgaaggcccccgacccacccaacgccgtaaacgcacacgccacacactccgcacacagcatcacatacacaccacaaagaaagaaagcaccagacgaccagccactagcaacacacacagacacaacccgccacccccacagaccccaacaccaccgacccccccaaccc

SEQ ID NO: 560015 - DNA, 455 bp, Homo sapiens
  misc_feature (97)..(97): n is a, c, g, or t
aaaatcggaaaaatatttggggcgggggtccccctgttgcccccgccgtggaaggagttgccccttaaaaagttggtaacctttaagtgcttggcanggggtttaacccccaagaaggggttggttttttggttgaaggggttaaagaaattgccccgcaaaaagtactttttttgggttttccggggggagcccagcaggggccccccccctttttttttgacaagaatattgggggtggcacccaaggatttaaaaaagggggacccttttttttggatgggggggccaagggcccttccggtgggctttttaaaaaaaaccattggccggttgggggggtaaccccccccattttaatttttttttttttttgggggggggggggggcccctgtttttgagcggcccgcgtttccccccccctgaataaattccatgtttccccaaggggga

SEQ ID NO: 560016 - DNA, 391 bp, Homo sapiens
atctgctaacggcctatctgaagaggccatttttttctagctttcgcgcttactaataggactgagagaacataacctttctgctgcagcgctagcccattttcctcaaaattcttctctgcctacaaaaggcatttccgcaatgtccatagcgatgactttgaaaataggattctccttaattgcccctactgtacgctcaatgcagacagaaagactttggaaacacacattaaaatatttcatgctccgaacgccagcgcaccaagtagcagcgtcagcactagaagagctattatcaatgaggagctgcttaaacctaagcagtctgacacgtgagagcaagctgtttattactgtaagaagagcacttaccgagatcctctttatg

SEQ ID NO: 560017 - DNA, 426 bp, Homo sapiens
cgtcctttttttatttttaattttttttgagacagagtttcactcttgttgcccaggctggagtgcaagtggtctgatctcagcttactgcaacctccgcctcccaagttcaagcaattctcctgcctcagcctccggagtagctgggattacaggcatgcaccaccacgcccggctaattttgtatttttagtagagacggggtttctccatgttggtcaggctcgtctcgaactcccgacctcaggtgatgcgcccgcctcggcctcccatagtgccgggattacaggcatgagccactgtgcctggccctttttttttttttttttttcccaaaaaaccggtttttttcccgaaactgggggttctaacacctgttggacaaaaagcttctttttttggtccatgtcgtgacgaattggctat

SEQ ID NO: 560018 - DNA, 315 bp, Homo sapiens
cccttacctgtccacacaaaatcatggttgcctgctccacctaatggcagcccagcgcctgctgcgttgccggaataagccaaatcataggggcagctgcaagccagtcctcctgcggccgtggaggggcttctggtaaaacccaagcctgagccccagctgcaaggcggcccctcccctgcccatataggaaacctcagggacgcagggacttgatggccacctgaggggtggacccgccatcgtggaagatcagataccaccaagcaatttggagacagttcctgttgagaataaccaccgtttccatgaaaa

SEQ ID NO: 560019 - DNA, 194 bp, Homo sapiens
agagcccgatgtgggtgggatcaagcacttagaagttgctactggttcatttcattgcatgttctgatgggatctacttttcttttttctttcttttagaccaggtctcactctgtcacccaggctggacgtgcaatggcacaaacatgattcactgcagccttgacttccgcaacccaagcaaaccctcctac

SEQ ID NO: 560020 - DNA, 376 bp, Homo sapiens
gcagtgacggaatgggatggagtggattggagtggaatagggtggactgtttaggaatggaatggaatggaatggagtggagtggagtgcagtggaatggaatggaatggagtggaatggaatgaaatggaatggaatggaatggaatagtgaaatgaaatgtaagctgagattctgccactacactccagactgtgtgaccgagagacatcctgtcgaatgtgaggaatggaacggaatggagtggaatggaatggaatggaatggagtggagtggagtggaatggaatggaggggaaacgaaaggaatggaatggagtggaatggagtggagaggagtggagtcaaatggaatggaatgcgatggaatcgaatg

SEQ ID NO: 560021 - DNA, 2004 bp, Homo sapiens
  misc_feature (1815)..(1815): n is a, c, g, or t
aggatgacacaacaaagatcaactgccgttaggtactgcgtgtgcttgaagctgattgttgtcggtgtttcgctgcgttaagtaccttcgctcaggttgtgggtagcttcctgctctgtaggtgtgtcgtcgacgctgtgtgttgtggcaggggtgactcttcttttctctattccgtctttgggggaactaagccttgtctacttaccttcgtttgtggcagaggttcgacttgcgcgtgttttcgtggcgtgatttagtttgcttcctccgcctcctcttttgctgagtgtcttggtgcactcgcacatccctcaagtgatgatgtatgtggggggaataaagcccctgttgttctactcatttgtataccatactgaggggagttgtgtaggaccttgtcactaggattgatattacgagcgtaggcatgatcactagattaacaatggtggcgaatacgtacgggcgaagcagggccctacaataggtcgtgtggtaagagtaacctacgtcggctagactaactatgtgcttagttgatatacgaacaatagttgtttgacaaaagtataatataatagtgtgtgtgattgaaaagagtgtgccaaccaaaattgttgtttccgcccaactatattgatttttgttgtcgtgtggtgttcatccgccgctggtggttgcgcctatcttgtttgtgttgcttcatggcaaaggctcgcttcgtgctggtgtctggtgtgggatcagacatgccgctcagttttggttggggcaggtcctgcggtgtatggtcgtcgttgggtagattgttccttccctacctggtgcagacctattttttctgggtgggtgacatcaatgttgtggcgccaaccccacacttcgtggggccttcatcatatttgggagttgggtggccctcccagagtaatgggccttcgctccttgtggtgaatgtgaagtttgcatatactccctcctcgggggacgcaccacgcacccccacttgtgtgtgtggggaagagaatacatgttctttgtcggtggtgcaacagaaagagggctatcggatagggtgctgcatgtactcacacaggaaaatgtataattaaaaggcccaccactgtaatagagggagaacacttggcggttggtgtgctccttcactgtgttgttgttgtgaaaacctcctccccctgtggtgaatgagtttgttttggggctttgtttggtcccccctgcgagggtattttctcccctacggagctcccaacagctctctcacgagactcagcacattgtgtatttgcgcgcaacagggattgtcatcacacttttataggtttttaagtgtgaatgttgaagttgggatatagattagtgagatagtggagcgccagcagcacacagagagggaaaactccacatatgtcgtgcacaagtgtctacctgagatgatgagagtctccccctcgtgcttctgcaaggtgcgcacatgtaagggagaatgcgtcttctgtctctcacttgtgagatagaatatgtctgacatttattgaggtttatagagaggggtatcacagtatggtgtgtgagaataaacctgtgtggccaccttgcgtttatgtggtctcaccacatgggcgttctccaccgtgctaagcgcctctgagggtgcccacgctggtctccacccctggcggtctccccgctgctgtgggtggtgcttatggtggtggttgtgttgtctccgctctgtctcactggtcctgttggtgtgtgtgaatggcccgagttaaactataagggtgngttcagagacacccacattgcgcctgctctgttgatcattctctgtggagacacaccacaggaattgtgatagattggtgtgaattggtggtctctactctttgatgtttgtttcaattttgttttgaaaatttaagtaatgccaaattaaagatatgcccgtttaataaacaaaaaaggaaaaagtaa

SEQ ID NO: 560022 - DNA, 690 bp, Homo sapiens
tggaacaggatcggctattatggtgtaatttatgacacaactgttccatgaatggcaaatgaagggttaaacttcttatacgcgagctaaccaccaaagaatctccagataacactacaggctctccatggtgcacactcttccccacgaaatcactgtctagagtctggtccaaactggcgagctccaaattcctggtccatggcgtctcggccctgctgcattcacaagcactgtctcaaatgctcattctacccaccaacgcagggttcacacacacacaacactggggtatccaaaaaatataccacgaaagtccacttctctcccctcgtaccccctctcgggttatcaccacatgcgtctattcactgaattctctgcgtcaccttcaggcaccctctgggcaccaagcgttactcggggtcccagcctataacaaacagggacacagcacacgtcaaacacccaatgttaccgacccgttttaacatctccaccacgagatcatcaatcaagaggccctttttaccacccgaacctaaataagttgcacccacagggaaggacccattatctatccatacccaccccccacctttatcctcactacacggccaacatccggcgaacccgttcgccccaggtccgctggccaccggcaccgcaccactcaccacacacgctgca

SEQ ID NO: 560023 - DNA, 341 bp, Homo sapiens
  misc_feature (35)..(35): n is a, c, g, or t
cccttcatgtaccgggactcaacattccactctcnggttagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacccggtacatgcaag

SEQ ID NO: 560024 - DNA, 464 bp, Homo sapiens
  misc_feature (14)..(14): n is a, c, g, or t
  misc_feature (29)..(29): n is a, c, g, or t
  misc_feature (42)..(42): n is a, c, g, or t
  misc_feature (61)..(61): n is a, c, g, or t
  misc_feature (90)..(90): n is a, c, g, or t
  misc_feature (384)..(384): n is a, c, g, or t
  misc_feature (449)..(449): n is a, c, g, or t
aaagtcccccaaantagcaaccctaaaantccatctgctcanggccgggaaaatgtgtaancttcccttggatcagctcccaggcctcanagcacgggagcagtgacccagtaaggaaacgtccactgctgtgcctttcctgttggaaattgttccgaaaaatacagtgaaactggcccaggccccagtagctcatgccctgtaatcccagcactttgaaaggctgaggcaggcagatcatttgaggtcaggagttcccagaccagccctggtccaacatggtgaaaccctgtctgtactaaaaatacaaaaattaggcgggcatggtagcacgtgtctgtaatcccagctcctcaggaggctgaggcagaagaatctcttgancctgggaggcagaggttgcagtaagctgagatcacatcattgcactccagcctgggtgacagagncaagactctgtctca

SEQ ID NO: 560025 - DNA, 398 bp, Homo sapiens
actctagaggaccccgcgacactcttggttattttctgtctggaaggtctatccattgctgaaagtggggtattgaagtctccagctattactgtattgaagtctatctctctctctttagctctaataatatttgctttatatatctgggtgttccagtgttgggtgcatatacgtattaggccatttttgcgttgttataaagaaataactgagactgagtaatttatcaagaaaagagttttaattggctcatcgttctgcaggctttacaggaagcatggtgctggcatccgcttggcttctagagaggtctcaggaagcttataagcatgggcagaaggtgaagggggagcaggcacatgacatgctggaagcaggagcaaccaagagtgtcg

SEQ ID NO: 560026 - DNA, 215 bp, Homo sapiens
attttaaacctaaagtaatagtgaattcttcatttttaccagagttcattttaacatgtttgtttaggtttactgcatcacagcaaccaccccatttggcttataaggctcggttacagcttgatgcaggaccccggggaaggcgatgggtctttgatttgtcgtaagtgatcaacaatggactaaaggatttatgggcatgctctcaaatctgg

SEQ ID NO: 560027 - DNA, 380 bp, Homo sapiens
  misc_feature (128)..(128): n is a, c, g, or t
tactaaaaaaaagtgtgcaaaacttctgccactctcacctgaggacacatgcatttgagaacacggactctgtcacataaacggtgctgcctaaaacagtatggaaggcgggaaggaagctagcaggngttggaattcattttgaaaaaagattgttttgttagaaaaagcaaataacaaaaaagcattagaaagtgggagccactgcacagcagtagcctagagactggctgcgatatggtagctctgccttgatatcatcttcgtgtcttcaggcatagagaaatggcagaggagcagtaagaccccacaggagatggccagaggatccaccatcagccttctggggactgaggaggtgatcttagtggaattatttt

SEQ ID NO: 560028 - DNA, 924 bp, Homo sapiens
  misc_feature (924)..(924): n is a, c, g, or t
gtacacttaccagcctggtgtggggcttgtcatcgtataaccataaaactgtgtttccaaaagagctctggtcatcctggctaaatggagcagaggaaatgaagacggcatccctgaagaatgtcatgtaggcgagctgggagttagggtcaccagttgcgaggccgtggctggaacagacccagatacatgtgtagccgtgatggggacatttgtcctgatgccagccttgatgatgcttaaaaagaggtgaccatatgatgtggtggtctaccaggagtaatctgcgcgcacagattttatctgaggtctgctgctgtgagaggagacccctgcaaggagcaggaagaacgagaaggagcctgatagaccgtcgactctgtgctggtcctactgctctgtttggctcactcaacatacgtgtttggaacgtaaggttacaacaaaaccctcttgctagaggactagcaatgattgaatgcaggtcatagacctactctgagaatcgtgtggaaaaaagacgggctgattcttacaagccggatggcctgggaccagcttcgagttatgggcatgcagttgttgagcctgaatggcaggcggtcgagggtccaagtgaaggctcccagtgccgtaaggagtagaagcggggagtgggagactggtagagaagaggaggaggaaccgtcccagtgtcgcctaagcaaacagtgagggtaagtgttagaagcgggcgctaaattgggggaatgggagtgcacacaaggattttgccaaggtgtaaatttaccggtgtgaaaaaggggttgtggcgcaaaaaaaaacagggtgtggggcgaagaaaaagtggggccaaaagtagtgtaagatattgtcacacgcgggctagtcttgcgtactgctttaattgagagagagtaggtn

SEQ ID NO: 560029 - DNA, 367 bp, Homo sapiens
tcgacctagaggatcccccttgcggcctctatatttaggtataagctctacatgactcctgagccaactgttagtgtgactggctcccctaggctggggcttgacactacgtgcagaagccatggtagttcagatctagatagcagagaagttagtctcattctaaaacattgcaactactgttagagtccaccccatgaagctgtcacagattgtgtatctttgactgaattactatcagtatcatctagttcagactaaaacaaatgttgctagctaacggtgggctagtggcctgtctcagtaggaccttgacagattccagctgtcaccctctgctgaccttggaccttagtgccacatgcct

SEQ ID NO: 560030 - DNA, 395 bp, Homo sapiens
  misc_feature (25)..(25): n is a, c, g, or t
tacaaaacagtggccaaatgaggtnaggtgacccaaaagcccaagtgaagaaactgaagaaagtgatgtgaaaggtactaaactagcccaagtgaggataagactaagaaatcacatagagtggctgggcgcagtgctcacgcctgtaatcccagcattgtgggaggctaaggtggctggatggcttgaggtcaggagttcgagaccagcctggcaaacatggtgaaaccccatctctactaaaagtacaaaaattaggggtggcacatgcctgtggtcccagctactcgggaggctgaggcacaagaatcgcctgaaccctggaggcggaggttgcagtgagccgagatcgcgccactgcactccagcctgggcaatggaacgagattgtctcc

SEQ ID NO: 560031 - DNA, 214 bp, Homo sapiens
  misc_feature (178)..(178): n is a, c, g, or t
ggatccctccaagatgaggaactgtgggacacaagagtaaaatcagaggacttcggtgcactgtttagatcctaaatctttgaatattagtggtgccttagaacgacggataggtaggagaacgggtgagacggaagtggagctgacggcgactagaacgggactgttatttcctggnaatacatcattaccatatttctcaatccttgggacg

SEQ ID NO: 560032 - DNA, 272 bp, Homo sapiens
tagctcggtaccctgaggagccgcgccccgcggcgaagcggcaggtgcgacacccgtaatcttcagaaattacccccggcggggctcctgcagttattgcttgccccagggcgccggggcgccgagcaggcggcccatggcgccgtgtacgcccagttcctccagtactttcagttccccttcggtttccaccatctcggcgatcagcggcaggtcgatgctgttggtggcgcggaaaatcgcttcgatgaacagccgcttgtcgctttcct

SEQ ID NO: 560033 - DNA, 138 bp, Homo sapiens
acccagtgaatgttactcacagccgttactcacaaatcaaagtgatgtggcctttgaacctcagagaggggggcttctagacacatctagcttgtgaacactgttctttgggctgttggttttgctgcctactaagct

SEQ ID NO: 560034 - DNA, 166 bp, Homo sapiens
ttcgtaagtgaggcagctccttggtctttggatctagatggtattccaaatcctttccttcctcgaggtgaagcaggaggactttatcgactggcttataatctttgagcactctgttgatgactagacttcctctggaataggtatccaaaccctggcaaacttt

SEQ ID NO: 560035 - DNA, 303 bp, Homo sapiens
cagctgctgctctttttaaggggtgtgcctcctgcattggttatccccacgaagttataaaggcaagggttccgggaaaagggcaccaagtacaagtcttttgtccaaacggcgcgcctggtgttccgggaaaaaggctaccttgccttttataaaggactgtttgcccagcttatccggcagatcccaaaaactgccattgtgttgtttacttatgagttaattggggacctgttaaaagaccgtactcagtaacaggccggaaaattgtgctttaaaaaaataaaactgaaaaactttaga

SEQ ID NO: 560036 - DNA, 207 bp, Homo sapiens
ccagggtggcaggtggtctgagtccgacataagtgatcggccggctggcctctagaagtttattttatttttatgatataggtgtacaaggtcaggatctagacttgttaccccaataagtagttattaagcagtgttgatggaaaattggtccttgcccggctgaattgaagagagggcggctttacagaatatcctgcattctta

SEQ ID NO: 560037 - DNA, 949 bp, Homo sapiens
  misc_feature (28)..(28): n is a, c, g, or t
tactatactctcttattactctctactngaaatgatcatactcaataaaactaataaaaaagtagaccacgaactaaaaaacttttgtttccctataattcttgttgttaataacccacaactgtgtttgattctccttctccacattcacccgggtactaacttcgaagtacacgccaatgtattgaaagaccctctctcttccctttgctcgtatgctaaccaccgtggcactcgccaactgttcttttaacactgcaccaagttttgctttaaacccgggaaaaagatacctctgtaaagcgcagaccaaccttgtttttcttcctgttttagggaaaaacagattgtccacggcgccacaaagtgccaaacaccccgtttaggcttctattccgaccccccagtagagcttccttttatttctcattcgggggaactaccccaaccccgttcagtaactgggccgccttaataattcatggtttagaagcaccgcaaaatgtattgaatgttaacaattaagacccccaatctgctgtaagtgtgtaatcctcccccccgtatcctaatattcaccatacaccctataaaaaacttgttgcacacattttcttaacccgaccagttgcagctacctatctacctcctttttctttatcagcataatacttcccccatagtgtggtctcacactgctccaaagaacacaaaaaagggcgacaacctcgactccccagcaacaaaaccatagtgggcttaaatgataacccactgattaacaaaggccagcatgtccacgtaagaagaatgtcgtaactttactccaccatttttaggtgaaaacaataatactctttcaattgtaccggcagaagatttaaaccacaactggtcacaccccctcgcggggttgtaaaaacaacgttttcaataaacggccacattc

SEQ ID NO: 560038 - DNA, 234 bp, Homo sapiens
aataattaaaccttttttttccccaccaaaggatgggtttaattaaaccatgtattggaaaaaaagtagcccaagtgttagaggtgggggatatattccattttagttaaaggacaaatttcccggattttaagcattcagtgggccgccaattttgattttgtggtgctctttacccaaaatattttttctttgtttttctttttttggggggggggggggaaaaaaaaaaaa

SEQ ID NO: 560039 - DNA, 1017 bp, Homo sapiens
tgaatattatactagcatttaggcatcggtcacttctaggaatactagtatatcgctcagacctcatatcctccctactatgcctagaaggaataatactatcgcatgtacattatagcgtactctcataagcctgcaagcacccagctccctgcttagccaatatagtgcctattgccatactagtcttctgccgcgcgtggcgaacgcgactggtgggcctaggcagcgtgacctagtctcaatctccgaactaccatatgggccgtagactacgtgacatgagaccgtagaaaccctgactcgcaatgctgataagacctcaaatcgtgcccgaagcgagaattatatatacgtaccactgtagcatgtatcatttccataaaaaccacatgaatgttgaagtcaaaacaaccacccacagtctcaagttattagcatcatcacctcttactcatttctttaaccaagatctaactaactaaccttatttgagctagttcgcccacccctatttcctccgaacaccccgtaacaagcctctctcctaaatgactcaactaatcctagactcctgacgccctcacaatcatggtgagctctaacaacctacttatccaagtagaacactaatcatgaatcatagatcttaactctgttatactaatactctctcacagaatctccttcgattatggcgtacacatgttcacgagaatgtactcatcatgtcagtctctggcttgcgaaaaacccagaggttatgcgccagctttggcgtatcagtccacccgatgacggcaaagccagtcctggaaggcctgtaatgcctggcatatcttctaagtttaaccctaaggggggtccctgtcccgatgcaacgggaaaatttcctgcacacccgtagtcgtaaactttggtagtcactctcagtggcggagcaaaatcccggactaactttttgaggccccaattttggaaggccctggggcctaacccaacgaaccacggaaagcg

SEQ ID NO: 560040 - DNA, 210 bp, Homo sapiens
ccgagcgccgctccggctgacaccgcgctcgctccgagttttcagggctcgtgctaagctagcgccgttcgttcgttctcccttcagttcgccatcatgatttattcttaccggggaccttaatcagccacggattgagaatgttctccgacaatctacaagatccggggagatcgcggacggggttgtgccttggaggtggaggggaaa

SEQ ID NO: 560041 - DNA, 238 bp, Homo sapiens
ataagtgagtgctcatgacaatggagcaatattctgtatcacagcaaaaatgtgaaaagctatggatgactaaagatctaacataactgttatatctttatgattaccatgagtactcaagtccaaaacaccctgtacatgcataatacgtggtttccccacaaacatcttgctttgtgcatgtcaagaaataacagaatacttctttcagattatctagcttcaggttgcagaaaag

SEQ ID NO: 560042 - DNA, 91 bp, Homo sapiens
agtgactctggcttctatctctgtgccagcagtgtaagttgggggcctggggatacgcagtattttggcccaggcacccggctgacagtgc

SEQ ID NO: 560043 - DNA, 833 bp, Homo sapiens
  misc_feature (58)..(58): n is a, c, g, or t
  misc_feature (64)..(64): n is a, c, g, or t
  misc_feature (66)..(66): n is a, c, g, or t
  misc_feature (76)..(76): n is a, c, g, or t
  misc_feature (79)..(79): n is a, c, g, or t
  misc_feature (107)..(107): n is a, c, g, or t
  misc_feature (109)..(109): n is a, c, g, or t
  misc_feature (120)..(120): n is a, c, g, or t
  misc_feature (141)..(141): n is a, c, g, or t
  misc_feature (159)..(159): n is a, c, g, or t
  misc_feature (215)..(215): n is a, c, g, or t
  misc_feature (219)..(219): n is a, c, g, or t
  misc_feature (242)..(242): n is a, c, g, or t
  misc_feature (257)..(257): n is a, c, g, or t
  misc_feature (262)..(262): n is a, c, g, or t
  misc_feature (280)..(280): n is a, c, g, or t
  misc_feature (298)..(298): n is a, c, g, or t
  misc_feature (331)..(331): n is a, c, g, or t
  misc_feature (353)..(353): n is a, c, g, or t
  misc_feature (391)..(391): n is a, c, g, or t
  misc_feature (435)..(435): n is a, c, g, or t
  misc_feature (470)..(470): n is a, c, g, or t
  misc_feature (478)..(478): n is a, c, g, or t
  misc_feature (556)..(556): n is a, c, g, or t
  misc_feature (660)..(660): n is a, c, g, or t
  misc_feature (686)..(686): n is a, c, g, or t
  misc_feature (717)..(717): n is a, c, g, or t
  misc_feature (720)..(720): n is a, c, g, or t
  misc_feature (751)..(751): n is a, c, g, or t
  misc_feature (809)..(809): n is a, c, g, or t
aggtgcggaaagggtggatgagcgcgggcggaggaaggagaagggggcggcgaaggtnggaatntngaagcttgtnttnacttgctttttaaaaaaaaaaaaataangntgcaaattgtnatttcaaatgcgaaaggatgnaggcataggcaaaatggntgctgattttagctaaagggggaaatcaaagctcgataaaaaactggattagatgnaaanatcatgggaaaaataaattaaanaaataaaggaaatcnatgtnctgatcgtggggcatcanatcctgtatgggaaaatnataaacctaaaaaaaccttttgcagtcattgtnaaaaaaacttctggggataaanaatgtaataacttggccgaaaaaatggaacccggtacntggtgacagcactcatcaaagacaagatattttcaaaacacgcnccaagcccattatcaccagcgtccccaagaaagtntgacagancctcggattttccctagagagcggccaactccttggactcgtgctccgctgccacctcgaggacggctcgacggttcnctgggaccacaggggggtcctgttctgaacacaggccacccactgggtgtgaactcggatcccttccttatggcggccggttctcttggtggaaatctgacccnatttccaaggacccatctccttttcnagcttcatcaggctcattggcttcaaatccngcncctttcccggctggtgctcgtgacccaagtntggcttcttttccaggagggatgaatccacatggcacaggtgcagtttctttccaaangcctgggtggcatctttggggcaa

SEQ ID NO: 560044 - DNA, 121 bp, Homo sapiens
tagtgattagaggatctgagtacatactcaaccatggattagatctgaaatggtcatcttcaaggatttaaagtcttactgagaaacagtgtgggaaccagaatgtattctagattaggaa

SEQ ID NO: 560045 - DNA, 294 bp, Homo sapiens
gttgttcagcgaaaacacttgcgacaacctcagctaccttgaacgctaccacgcgatggcgctgaacggcgccaaggatgccttggatgggcggattcgcgaggcgttcgtcaacagctccgacccggaactggcgatcgactggttgatgcactcgttgcagggcacttttttctcggtgtcggtttatagcagcctggatgccctggtgctggcgcacccggatgtggtggtggtgctcgatacccataaccaattgctgacccagcgtaatgaccgggtcgaagcacgctt

SEQ ID NO: 560046 - DNA, 251 bp, Homo sapiens
gttcgcagggagctggtctcgttgcaggggtcttacctggagctctccgagcagagtctagtccgagggagatccgtgagctcgcaagtataagacgttagtcccgggtacaggatgcgagccgagaggttctcattctcctcgccaggggcgatcttacgcctccacatcacatgctcatatggtcaggtaggcccagagccacacaatgtaattccggcagatgtagtgccgctcgcacagaactttct

SEQ ID NO: 560047 - DNA, 119 bp, Homo sapiens
acgcgattattatgaaccttcagaggcagagacacagcaagtggatgcacaggaagctttagctagaaggtgtttatgctatcgcctcagaaaatatctgtccgcgaattgtgttcata

SEQ ID NO: 560048 - DNA, 761 bp, Homo sapiens
tttggctttaaaaatatcttcaataataagacatcctattttgggggggtaggggtagagataaatatgaaacctttttttggataaaacccctagtaaggacatgttcccaggttaaaagtccatgaacatataaaacagaaaatggggtctccgtgcccaaccttgaagttgcaggattctgaggctcctaaactcgtggtactgaggatcgtggagtagagatctcgtggggttacagaacagctcaagttagggaggatcctccttagtgttcacaacaactacacgaatgcggaaggattctgtcccccaccaaagggctatatgctcggtggggcccattgtggacttgccgtggagagagagaaggccccagacagaaggccacatgtgggctccaggcatgtggctctcactggaggagggaccccaacttcttcaccacgcaaagagccccaagccaggagcacgtgggccaagccatgatatgacggcgccagaataaaaggggcgctatctggagcccagccacttgcacacttgggaggcccgcccatgtaacctgggagataccagaaataggggccaacggggtgggcaaacccagtgagaacacagaactccccatgggggataagagcagcataccgcgggggggagacccagccggccaaggatgtgccagaaatgcctgcgaaacaaacctgaaggaaccaaatcgccgaaaagagcggaacaggaagagaggagacaagcca

SEQ ID NO: 560049 - DNA, 188 bp, Homo sapiens
aggatcaaagcagcaggtgtagttatatcagataaagtagactttaaagcaacaatagtaaaaaaaaaacaaagaaagtcattacataataattaaaggatcaatccaacaagaggatattacaatcctaaatttacatgccccataactcatggagctcccagaattcatacaaacaattactattg

SEQ ID NO: 560050 - DNA, 134 bp, Homo sapiens
caactggcttgaccagttgaaatgcacaagcagagctgagattgcgaagagactgaacacaatttatagcacagatcatgcctttccgtgtcacaatgagcaccagacagcaggatggcgcatggcatgtgaag

SEQ ID NO: 560051 - DNA, 328 bp, Homo sapiens
  misc_feature (10)..(10): n is a, c, g, or t
attgatcaantgaagacatttaagtatttccttaacaagaagtctttccagaaacagtattaacatctgagtgtggccggagtgcaatggctcacacctgtaatcccagcactttgggaagccgagacaggtggattacctgaggtcaggagtttgagacaagcctgaccaacatggagaaacctcatctctactaaaaatacaaaattagccgagtgtggtggagcatacctgtaatcccagctacttgggaggctgaggcaggagaatcacttgaaccccagaggtggaggctgcagtgagctgatatccagccattgcactccgg

SEQ ID NO: 560052 - DNA, 1001 bp, Homo sapiens
ggagaagggcagtgaggaggatgacgacgatgagtgaagacgatgctgacgagtgaggctcccaatgccctgaccatttatgttacagtgacccatgcatgtgctgatgagagacagtgcagcacgccatgtgctgcgatggccattatctctgaccaatgaacagtgtgtaccaggcaattgacatgactccaacatgcatgttggcctgtgcatgccccactgcaggcacatggtgcatgaggccatgcgcagacaaaccacagtgacactgacagtgacagaatgtgacagccatacaacggctgacaaatgagcctaaccgacacacctggacgaacccatgagccgaaccgcacagacggagcaacaggcattgatcaccagtccgtgacgaccctgagatgcaagggacccagatggagagacggcagacggcaaccaagaaatcaccaaggccgatgcattcccgatcgcctggaggcctccatacaactaaggaggccccaaggtatcaactcaaccacctcaacagcctcagctttgcagaccccatgaggaaggccgccatctcatacataaccagacaggcccatgagccgccttcctgcagaaaccacaacagcggccataatgccaacagaccgaagaatccagtggggaccgagcaagcaggcaacctaccacccaaacatgcgcgtacagcgggacaagagaccggggaatggagtcccaaggcacagcggcccacaaaccatcagagacacaagacaacaattcccctcaaccctggaacaagcaggaaacacccgcaaccaccacaaacaccacagcagacgcagcagaataaacaaaaagaaccgaaacaaaacaccacacacaccaagcccagacagaccaaagacaaaataacaacaccccggcaaaaaaggagcaacgagcacaaccaaacaaaaacaaacaagacaacgagaaaaaaaggacacagaaagacaaacaca

SEQ ID NO: 560053 - DNA, 150 bp, Homo sapiens
gtgatgcttacaatggtgctgagttcccttggttaccatgtggtcaccttttgactacagaggttggggtgactcagttgggaacgccatctgagcggggcatgacctattgacggactccacgtttgtacctggatcaaagcaagaagt

SEQ ID NO: 560054 - DNA, 267 bp, Homo sapiens
tattctgggctttggcggtactggagtatgctcacagagatagggagataggtggccagaagacagtgtcatttaatttaatggagcataaatcatttggaaagaaaaaggcagggaatggtggtatgacagccaggcattatagatccttacatgcgacattttcctaaaggggtggagaaggaccggatcttggtccaccgtctcagtgacaaggcgtggagggacggggctcttcatatgcaggggcatcgaaaagggtaccga

SEQ ID NO: 560055 - DNA, 201 bp, Homo sapiens
caattgcgggagccatcttgatatgctgggagaaggatgtaccctgattccatggggagagggtacggaagctctgaattcccaattccctcccggatcttgccctatgtgcatcctttttttttctttcttttttttttttcttttttttttgatacagggtctcactctgtcatccaggctggagtgcagtggcacaat

SEQ ID NO: 560056 - DNA, 231 bp, Homo sapiens
ggaatcagcctctttattggaagggagggccaaaagggactgtacctcctgtctcaagaatggggatagatgggagggttttgaatccccactcaaaattggctcctttagataaagcctgatttcttaaacctggggcttaaactggattacccccatccgggggcaatttaaagataggactccctccttgaaccccagccctccattgaccaggcccccataaccacc

SEQ ID NO: 560057 - DNA, 287 bp, Homo sapiens
tgtgtgaattcccaggttggcctggtggacatgtcgtggctgtagatgtcgatgctgaggtcgtggggctgcctgtctgggttttggccttggcgtcacgttcggtcttgggtgtgccgccgcgctcgtcgcgttcgacggcggtgagggcgaattcggcggccagcactttggctgtctgcaacggtgagggcaggacgctgttgggtttggctgtcacgcgggattcctcatggtgtgccggggcgtaccccggcagacggcaagtcaggccttggcttttgccg

SEQ ID NO: 560058 - DNA, 470 bp, Homo sapiens
gatccgtcgacagcgggaaacatggcgggcggtgtatggcgagtgtcaagatgtccttgtgaatggctgcatccagcataaggggctggtttttatcttttatttttccaatcctctttccttctcaaggtgtccaagacacacagagccacggaatctcacaagtgtctgagaattcctcctccggggactctcagaggatccagaactgcagccgctcctcgcttggctgtccctgtccctgtccatgcatctggtcatggtgctgaggaacctgctcaacatccgggctgtcaggtctgactcccccctccacacccccacgtacttcttcctctccaagcggggcggggctgacatcggtttcacctcggccacggttcccaatatgatggtggacatgcagtcgcatagcagagtcatctctcatgcagactgcctgacacagatttcccacttgctcagacggg

SEQ ID NO: 560059 - DNA, 129 bp, Homo sapiens
gtcattgtcacccaggctgtagtgcagtggtgcattcctggctcactgaagcctccacctcccaggttcaagtgattttcatgtttgagcccatttatcttaaaaatacaaaattagtcagcgtggtgg

SEQ ID NO: 560060 - DNA, 315 bp, Homo sapiens
  misc_feature (5)..(5): n is a, c, g, or t
  misc_feature (20)..(20): n is a, c, g, or t
  misc_feature (58)..(58): n is a, c, g, or t
  misc_feature (68)..(68): n is a, c, g, or t
  misc_feature (79)..(79): n is a, c, g, or t
  misc_feature (91)..(91): n is a, c, g, or t
  misc_feature (126)..(126): n is a, c, g, or t
  misc_feature (145)..(145): n is a, c, g, or t
  misc_feature (147)..(147): n is a, c, g, or t
  misc_feature (159)..(159): n is a, c, g, or t
  misc_feature (167)..(167): n is a, c, g, or t
  misc_feature (199)..(199): n is a, c, g, or t
  misc_feature (213)..(213): n is a, c, g, or t
  misc_feature (216)..(216): n is a, c, g, or t
  misc_feature (245)..(245): n is a, c, g, or t
  misc_feature (247)..(247): n is a, c, g, or t
  misc_feature (275)..(276): n is a, c, g, or t
  misc_feature (280)..(280): n is a, c, g, or t
  misc_feature (306)..(306): n is a, c, g, or t
ggatntagagggggggatantgaggtatgatgattggggaagaggtttattatggttntaatgaaganagaggataagnagggtaagctgngtttaggatggatagtttgaataattttagtaggntctggggataagggttgtntntggtggtttagnaaattggntctggggtgaataggataagtggatagtggtnagagtataagaggnagntaagtaaaaaatgtggttgaggtatgggntnttattggttgatttgtatttcaaaaagnncaantatggggaagttaattaatgtttggnaattatgat

SEQ ID NO: 560061 - DNA, 286 bp, Homo sapiens
cgtttggtctacagtcagatattgcaaggctggtatcccgatggtccacatgtcaggcttggtcgatatgataaatcattttgattctagaggagctgcttttttcatatgaaacagagatcacactaaccggatttcaggccagtctcatgaaaactggaagatttcacagagccttgggtccacatttctgtgtggcattagagggctagaggttaatgagtcctcctctcctctcctctcctctcctctccccctcctcccctccattccgtactccccgccg

SEQ ID NO: 560062 - DNA, 221 bp, Homo sapiens
attcggcacagtggaacagtacaagacatgatgctactccgagaataccgacagctccaggaacagcagtccctactacccagcctctccccccaaccatcgcccctatccagcaagaagcagccagaggacaacggcgcccctcttctattacctattaaaaggctggaatgttaggaacaagttgcaccagaacccctccccacccgccccggtgttcc

SEQ ID NO: 560063 - DNA, 152 bp, Homo sapiens
gtggacatcacttgtgtgtccctggagtagcacttttaattcttcaagaactttccctttgcactcacaacttggctaactgctcaggacaagaggtctagctttcggtctgtctggctttgctgttctcactaagcataatcagagagatg

SEQ ID NO: 560064 - DNA, 152 bp, Homo sapiens
cgacttcatacccacggtgagagcgtcgaaccaatacttgagggagtatggggccggtgtttgggccctcagttgctaatggctaccgagtgggaagcggttcaagagacggggtgaagggtggttcacgcggttcttcaagtcctcaggct

SEQ ID NO: 560065 - DNA, 419 bp, Homo sapiens
tgccaaataagacacactgaaatgagagggagataagcacaaaaagtggcagagactacgaaatggatcctctctattaattcccttctgcacttccccaaggaagaactcagcaacttgaaagaaccaggtgacaacctgaagagacacatagtccacatctcatgtagagagcaagatctgggagcaagaactctccagaaggctggagttctactattggctctgccacttgttatatggctccagacaagttgcttttaccttcagtgccaatgtttcctcactctcaaagggctgttacataatttttttttctttctgtctctaaggtcatatactgagttcatgcgttcctttatactaattttaagagaaaagaaaagacttttttctaatatatcaaggcccactgaatc

SEQ ID NO: 560066 - DNA, 1132 bp, Homo sapiens
gtcacccatcagcaatgactcacctcctcccatgctaggtcagtaatattaatctaacgaaaggtctctcttaccatcagtgaggtcccattcaagagcgtcagaagttggaaaataagtgtctccctaaaccgcgcaatcggtcccgcacaaggaacatagcaatctattggagcttcatcgtccagtgtgataagtaaagtgtttagtgcattgaacaagagaatagctatgataggcagttggcgtactaaaagtgagtcagtataagtggtagaagtcatgttgcgttaaagaaggtgtaaacccataggggatttggctgcacttggagaacatcaggaatataggctaagataactaacctgaacttaggctacatggctctagcacagagcataagcatgctgaaatctgatgcccagtgaaagtgccagtagtacgagactaaagaagtgtacccctaggcaacacagcacaatgtcgagtaaaccgattgcccatggaccggaaacacatccagcaagatcaaactgacagcaagggagacgcaaaagatccagcgagactagctcaggccacgccgaaacacgtaaacgagccagacatgccccacagacttgcgatgatgactcccaacagctcacacgtccggctgcggccactaagccagtggagacacggaccagacggatacatccacgccagaaagcgggctaataaacaacaacaccccaggcacgggcgaattgagacaggaatcacgactacgagggaagaggaaaccagacggggggactcaacagcacaggacggaccacaacacgaggagaccacgccgagaccatagggcgcaggacactacacacgccgacaactaagacgtcaaagcgtgagccgtcaaccacgccccgcacattcacgaaaagcgtgacgcgtcgaacacccacaagatgcgccacaaagactcacccacacccaacaaacagtagacggccgcagcacactggagcacaacacgcgaggaaccacccgcagaaacgcacgccacataacccgacgccaggaccaaccagcagcacacccgacacagaggaacacaggcactacacagaggcagaacacaagaccc

SEQ ID NO: 560067 - DNA, 400 bp, Homo sapiens
ctcatctccctggagtggcaagcctttgtgatgccccttcgtggcccccattgtctggagcatctggcagctccctacaccgtgcccttgggaggttgcacggctgccctccttcctgtcgcagtaacggatggtgctgggtgggattccagcatgtgcgtgatggctatcccttcagctcagttgacaaagagagctcgccatcctctgagattatccttctaccctccatcctgttgagcggttctggccttcccaaactggttgtgatcttttgattcctctggggctgaagcagagcaagttccccccaggcaccccagttgtgggggagcctgtattttttttaacaacatccccattcctcagcctgggtctccatctcagcctgggtctccat

SEQ ID NO: 560068 - DNA, 137 bp, Homo sapiens
  misc_feature (15)..(15): n is a, c, g, or t
ggtgaagcccaatgngcgagaagcgccacgagttcgagtccggcatctcccaggctcttctgggagctcggagatgaactctggcccaccaaggcctcacctccagggatcttgaataattccggccaccttaaggg

SEQ ID NO: 560069 - DNA, 866 bp, Homo sapiens
cgagaggtcaagatagccactctcggttatcgctcttgctgctgtgcaaccatgcatctacgcgtgtattctgagatgccccggagctcgctctggctgtagccaggatgcgctcccaggccctgagtcttgcgctcattttcatcctactgtgattaccatcacatgccctgtgactatccaacctgtgtcaaaccgtagcgataccgctgcgcaggcctgagagaggaccactcctacacctgcggcgcgacgacccgtacttcactcgttacaggccgcaacagggttatgcgaccttgcgtgctcttgtgatggcacaatgaagctctgagagctatctaacttgctaccatcaatgccaactggcatacggtaagccgcttgggcaggcctttattcacatgcgccgtggactgttggtactatccattacagaccgaacgctcgcgttgaaacgtttcactagtaacccatctgggaccatcgcccggtccgaactacgcgactgcacgtacataattgtgagagacacctagtgggaggatatgccgtacccttattccgcccttcacgcctttgcaggtatcaggagctctcctttgtcgcgacatcgatacaggacacacgtctcatatctacacagacgactggcgctcgtgtaacacatgacccgcatcactctagcgacacacgcccaacacagcggtattccacaatcgccagaatactgccttcccacagaacactcgtgaccagcacgtggggacatcatgacccgtcaatttaacctgtctctatttgctcgcctgcctgctgctataccgagcagcaagcccaacaagaccccagtgaatgcgcgtaaa

SEQ ID NO: 560070 - DNA, 240 bp, Homo sapiens
acatccacactcttttggctccaagaggcgccctgccaagcacaccctcctcctatttgagcaatacaattctaggctgcagcttcgagtgggccagtggcttgtgaagcagcccgctgcagatccctcgaggccccagaggttcagggctttgatgggtatgaggacccagtgtgagtaggtgggggtgacggggttacgttccctttgttgagccttagcaaggtaatggcgtatttt

SEQ ID NO: 560071 - DNA, 1616 bp, Homo sapiens
  misc_feature (1)..(1): n is a, c, g, or t
  misc_feature (1256)..(1256): n is a, c, g, or t
  misc_feature (1297)..(1297): n is a, c, g, or t
ngaagtcgtggatataaagagaagcccctcttctttgttttgtgggaataaaaatagcaaccaaccaccgctttgtggtgaaaaaagtaagtacgcccccccccccccctgttttctcccccaagaggggaggataataggggtcgccccccatttggtttgtgaggagaatatccatcgctgccccctagcgcagcgataaactattagtggggttgtcttctgccaacagcccgcgggcgataattttggtggggtggtccccccccccctcttcgcctctcgcatggtggttatatattgtggtgcgggcgctcccgcccccccccccctctacggtggtggtctacttcgtcgttattatgacctgcctcttctcctccctcccccacggtggatgatgtctgtcggccacacacccaccttcgtggggggccgcccccttccttgtagtgggccgccccacaatggagaaaacgcctttctccgcggggtgttgttctcctacaagggggccgcccccacacaacaaccaacacgggggggccgactacctactatcggccgcggccgcctactaactaatgacttttttctccctcctcgttcgtggagaaaacaaatattagttgttctggaggccgccaccggccgccgcccccccccacatgtgtggccgcgacacaactactacaactccttcttgagaggagagagtttgttctccacaacaggaggagagtcgttgtgatggataatacccgctccgtcctcgtcacaagaggataattatttggtggaggagagaaacctttttttcttcttggtggaggaagtgtccccgaagaagaagaagagaggaggtgccgcatgcgctcgcgcagaatatttgtccccccctggcgccgccacatcaggaggagccccaccgcgggagagaacacatcttctccctctccgccccctcctgtgggagggccccacaccacagaagagctatatattataagagcgaggacatcatcatattatcaccgtctctcgttgggtcttgtgtgcccacccgtggtgcccccccaccgcgggaggagagcccacttcgtgagtatctctcgtgtgtagagagagcacacagcacattttttgtgccccccgcgcgcgcgtgggtgtttttccccccgttttacaaagggggcccacccgagagatttcaccaccacctgtcccctcttgagaatttccccattggtctctcncacagcagagagagagaatcatatagagagagcgctttctntgtgagacatatatacccctcatcaggggcgtacacacacacacagagaatatagtatctcacaccccttttgtccacatgtccacacaccaccccccacgcgcttgagaatattgtgttcacattggcgtccctccggtgtttttcttttcacatcccctgtcccttaacacccgcggagattttgagatatacccacaaaaagagaggggcccacatgtgaaaccctcgggagattctttttctgactccccgcgggctgggcaccattatatttagggcacccccttccatacaccttttcctttacccccaaaaa

SEQ ID NO: 560072 - DNA, 202 bp, Homo sapiens
cgacctgggggctgtacacacaagagctgagggcccgggccctcaatactggcgagggccggggctgaaaacatgggcggagcggccctgcccacccatagagtgcgagcacgaccggaagcagagcagccggccagggctgagaggctcaggcggacgacaggcagctcaggatccggtccacccactgatgggccgaggg

SEQ ID NO: 560073 - DNA, 722 bp, Homo sapiens
  misc_feature (114)..(114): n is a, c, g, or t
ttgcttgctggtgaatcctcctgcccccgccttataattcttttggtgttggtggcgccaccccctttatttgcgcgcagggttgtattccccatctggtccgcgcgtttactnctggtattcaatatattttggtccccgcgggagtattttctcgcggctccctctttttgccgccgcgcggtagaatccacttcgcgcttgcgccccccaattactcttgtccgcctccgctgcgcttttgctatcaccactttctatccactgggtctatctatatttcttgtagcccgccgcccctcctcacgacgaccccccctccgggtgtcactctctgtgggtccactcccccttccgcaccacaagtgtctcgcgcgcgcgccaatgtatttcgcggcgctcacacacacacgttgttgtgtggagaccccccacggcgggctcccccagcggcgttctcagctgctcgctctttattggtgggcgccgaacacttcttccgccgcactagattggtgcttctcatacccgcccccgctctatagatgatttctccctttaccaccaccccacaaaccaccttgtgggtctttgatacccccccctcttatactcgcgccctttttttaaaaatatgtggtttgcactatagcttctttatattatttctccccatctctattttatatatagggtctcccataacaaataacaaaaaacat

SEQ ID NO: 560074 - DNA, 201 bp, Homo sapiens
ctgaaaatacgcgagggctcgggtcgatgatcggcatgtacaccaactctcccgggcgactcgcgctctggtcaagggccgcagtgtcgaccagcaatccttggcgactcgtgctcgcttgagagtcccgcgggttcgaccagctgtcccagtcttctcgggcccttgtccggagggtccgcgaggtcgaccagttctccg

SEQ ID NO: 560075 - DNA, 225 bp, Homo sapiens
agaggatcccagcactgtgacgctccgttgagcacgtgaggccacgtgccagccaaataacttattttaaagaaaaaaatatctaagccttactgaagaaattttctgtaggctgtaggttcgaaagctgtatttcactttatttacattaacgagatttaattacaagaacctcaatgttgagtgttgcaacgccttaaaccaagtgaggctcacacgtgctgt

SEQ ID NO: 560076 - DNA, 372 bp, Homo sapiens
tgccaaactgaggtgaaatgtagaatcttattctacttttcacttgcattttaaaatacaaattgaataaatgtttcctgcatttccatgaaaggcctgcttgtatcttttgcccattttttaaaaatgggttattaaagagtcctttaggaaatactgtaaacgtaacgtgctcctcttttccccagaaatgtttgagcctgccacgtgtgccatgtttgtgtttgtggtagaggagatgctttcatgattgagaagaagacgcattttatactcttttcccctaatgtaaaatttattccattaaaacacaaaaggtttgtaattaaaatattttttccctaaggttgttatataaagttactaatggaa

SEQ ID NO: 560077 - DNA, 136 bp, Homo sapiens
cacgagggctaactgagataggggacgggagattttgagggtttgcgaaagagtttactgatcgatccgaataaacgttaaatctgtggtcgggcgcagtggcccacgcctgtaatcccagcactgtgttaggcgg

SEQ ID NO: 560078 - DNA, 683 bp, Homo sapiens
  misc_feature (24)..(24): n is a, c, g, or t
  misc_feature (135)..(135): n is a, c, g, or t
  misc_feature (151)..(151): n is a, c, g, or t
  misc_feature (258)..(258): n is a, c, g, or t
  misc_feature (278)..(278): n is a, c, g, or t
  misc_feature (283)..(283): n is a, c, g, or t
  misc_feature (300)..(300): n is a, c, g, or t
  misc_feature (312)..(312): n is a, c, g, or t
  misc_feature (323)..(323): n is a, c, g, or t
  misc_feature (367)..(367): n is a, c, g, or t
  misc_feature (403)..(403): n is a, c, g, or t
  misc_feature (448)..(448): n is a, c, g, or t
  misc_feature (464)..(465): n is a, c, g, or t
  misc_feature (504)..(504): n is a, c, g, or t
  misc_feature (518)..(518): n is a, c, g, or t
  misc_feature (579)..(579): n is a, c, g, or t
  misc_feature (603)..(603): n is a, c, g, or t
  misc_feature (605)..(605): n is a, c, g, or t
  misc_feature (608)..(608): n is a, c, g, or t
  misc_feature (625)..(625): n is a, c, g, or t
  misc_feature (650)..(650): n is a, c, g, or t
ggaggggagatcctggattctgtnaaaagacaaattttcggggtgaagaggagccgccctgtgcagtgcgcccaaacttcagctcctcagtccacctccattctccctggacggcgggggaacaacagcctagcnaagggactctcctctnccggttcacatggccccagcaagtggccacactgtggaaggaagagcctctctgtccctccctggtatccagactttatctccaggtacagttgtccctggagaccnagctggagcatccctcccgncaagnagcgagtgctccggccnctcttggtaggnacacagactgncaactggaggatgacagatcttttggaagcatcttgtttcttgngaaatgagttaggacaggcctcatcctacggggganggttctgcatagacagatcagtgcctggctcccacctccagtggnagcagggaggatgggnngtggccaaagccaagtccctcctgcgctagacaaaagtnggggcagaacaggnagggaaagggggatgttctgcggttacaagtagcgggtgccaatcaaatcaagaccaagcnatacatgcacggggcaaatgccancnganactccagcacaaaaganattctggcttgttttattgtcattnaaaaacaacttttaagacacgattatctctgcc

SEQ ID NO: 560079 - DNA, 784 bp, Homo sapiens
gtcttcagttgagctacggtcagtcctgaacttcctgaagatgtccttgatgtgcagttggtgttccttcgacttctctccagccgagatttcaccagaaccgtcacagtagtcttagtggcataataatggcatggcttacatggtatcaggcgctagtgtgaaatgtaatagaaggccctgaagctgatggggtcgaatgaaggtgaattcaaggctgaaggaaatagcgaatgcaccctacacagttctggaggatggttgcactgaaacacatcgtgtgggaattggagccagaatgtgtctttgtaactatacgagaacatgcgaggctgtgagactatctattgtatgatattgtatcctttgatgatcaattggtggtcctgatcaagatattctggtgtggacagttggcacctgtttgcgtgctgtataaatccaaaatctatgcgtgagaatcgcacgtactgaatataagagagtgtgaactccatattgttgtgtcctccattggttctaatcttgtcaaagcagctgcaagtgaccgacacaaattccagttgtttatttccaaggatgttgggtaaacgagatataattatgacagagagaagaaatgatacgtgctctcttattggtgttcaaccatatactattgcaaaatgcttcaaggtttcatttgtatttacctaatgtccaatttgcactagatgtgtcaatggtgctataataaagtaaaacttcaacgactcgtttattgataacggcaactgtgttatat

SEQ ID NO: 560080 - DNA, 96 bp, Homo sapiens
  misc_feature (38)..(38): n is a, c, g, or t
  misc_feature (77)..(77): n is a, c, g, or t
  misc_feature (95)..(95): n is a, c, g, or t
tcaaaaaactacaaagggatccctggctctgggtgtgntatgaagacaactccctccccactcaccccagggaacangctggatgctggacaaant

SEQ ID NO: 560081 - DNA, 150 bp, Homo sapiens
agacaccctctgagaatcgactgagatcaatgggaatgttcaagcgaaaagcctgagcaggacggaccttccaagatgtgccagctttcctgtggatctcactgcagacagagcgtctgaggcccagcaatcacaactcagcagactggt

SEQ ID NO: 560082 - DNA, 131 bp, Homo sapiens
cagggggcctctgggagcatcttcagcaagttcacctccaagtttgtacgcaggaacctgaatgaacctgaaagcaaagaccgacgtggagacgctcagacctcacgtggtgaagcagtggcggcaacgac

SEQ ID NO: 560083 - DNA, 234 bp, Homo sapiens
caggaggatcgcttgagcccaggagtttgagaccagcctgggcaacatagcaagacctcgtctctatttttttttttcccaagacagagtcttgctctgtcaccaggctggagtgtagtggcgccatctcagctcactgcaacctcagcctccccaagtgccacaacgtccgactaatttctgtatttttagcagagaagcccatttagtgtttgagaaagagcctcatgtgta

SEQ ID NO: 560084 - DNA, 310 bp, Homo sapiens
tcgtttagggagtagagtttttttcgtgatagtggttcactggataagtggcgttggcttgcaatgattgtgaggggtagggagtggggatggttaaagggtacaaaaatatagttagacagaataagatctagtatttgatagcacaacaggataactacagtcaatatttattgtacatttaaaaataactgaaagagtataactggaatgtttgcaacacaagaaatgataaatgcttgagttgatggataccctacttaccttgatgtgactgttatgcaaaatacctatgtaactccctaaacga

SEQ ID NO: 560085 - DNA, 1516 bp, Homo sapiens
tgggaatgtggggctataggcagcctctctgatgcactctcttccatctctttccccaaggctccgtgactgtcaaactgggagtaggcagcagtgggacaatttaggcactgggctagcattttcagcaagcaaccatctcacaatatcctcattctatcacaatcttccgtctgggcaacaaggcagtggtttcttggctgcacatcactatctatagtgcatccaatggcagcaaaccaacaatcaaaacattcagctttcccagtgccagcccttgttatttcacacatgcacaattggagcaactacattggcgcagcacagcttgatatttgtctactactcaatgtagctatcccacagccctctggccctgtccttgtatgcacttactatggagtctacactgagagtgcatgaacttatcagtacttgaccatgtctaacagaacagggccaggaccacaggtactatgagatgcacgcatcgacccttgcaatattcggtcattgaccacgatggccacttagccagcccttattcacgttgcccctgtggcccaagtttgcgttcacagccaggctacacattaatcatgggacagtaggaaatgttcccgcgtacatgacgacgcgcgatattcacttgggccccaaatagatctacataattaagcacgtcccaacacgcgttgacacgcgcttgtgccaagctgtaacacaaggaatgcaatgggataacttggttcagcaggccattcggtaggaaccaaccaactttacacaaagaccgatgtgtgggcaccttcagatcgccacaactggctagccttttgggacaagctctactttgcacgcgtacgtcaatattccatttgtcccatgcgcaattgttcgccacttcaaatcaggccccccgctttcaatagatctcccgtcggcggccatattaagaccatgtagtacagacaacatatcggttcatttaaacggaacatttaccagatggacatatgtgcaccagagtttgatagcactattgaagtaaggggtataaggacggaaaccagttgataggagagtcatcccgataccattgtaagaaggattgaaaccgtcagaaatatatgcacgcaatgcacacacaacaacaaccaataaatgacaaacacacccaagaccacaaccgcaacggccaaacgacggcacaacatgagccgaaccagtgacacaaaaacagccccacatgagagcacgaacgaccccagacgcagacaaattcacaaacaccaacggcaccggacatgagaaccacaccaacccttacaacgcaagacggaacaaccgaacgacccgccgaaacaatagagaccgaacgatagacccgcggactggtaagaatcacagaaacaaccacacccgagaaacaaacaagaaccggcacaacacgaccagcaaggtagaacaaaaaagaacagaggcaaacaacgcgcgaaacgaaaagcaacaccac

SEQ ID NO: 560086 - DNA, 206 bp, Homo sapiens
ctaactatgtaatttgcaagtgtatatttagaaaaatttttgggaacaggataatggttaatattaaattaaaatcaaaacaagaagagtttgacctacccattcaatcacaatgaatatacccacaaaattgaagtacattcttaagtaatgtaagtatttttaatggtctaatctatattcaacatataacaggccctaagaga

SEQ ID NO: 560087 - DNA, 882 bp, Homo sapiens
  misc_feature (86)..(86): n is a, c, g, or t
  misc_feature (293)..(293): n is a, c, g, or t
gatagtaaatcccaagtaaggtacctgccgtcagcagatttggctttcttcttgacacctaatacccacagtcctccaggtacctncgtcggcagatttgagctttctccttggacacctaatacccacagtcctccaggctccagtagattgcaaatgacctgcttactttctgttcccgggctgcgttctgacacctgtcggatagtaaatcccaagtaaggtaccagccgtcggcagatttgagctttcttcttggacacctatacccacagtcctccagagttcggacncctgtcggagagtaaatcccaatgttttagacgcccagctgcacaacttgattgccttacaaatgacctgcttccaggatgcggaaattcctaatttcttctgtgacccttctcaactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaagccttctccacctgtgggtctcacctgtcagttgtttgctgattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcggccgcatggcagcacagtctaatctcaacatcttcttatctgttccattccttttgtagggtggtttaaaaaaggcgccaaggtcaaataagctcgtgccgaattcctgcagcc

SEQ ID NO: 560088 - DNA, 454 bp, Homo sapiens
tgtatcctttgtctattaaaaatacaaaaaaaaaaaaattagccaggtatggtgacttacacctgtaatctcagctactcaggaggctgaggtgggaggatcaccttgatcctgaagggtggtgagttgtagtgagctgagatcatgtcactgccggctagccggggtgacagagtgatacccggcttcaaaaaagagaaaagatgcataactttacatagtgtatcaggggatattatacgtttataaaaccatcatttttggggctcacggtgatctggcctgcctggggcctcccaaactttctggggtttacagggcatagacgctactggctcccgggcctcatttccttgatttttacgaacattgatttaccctctcaaatttatagaggagtacatagtctttcctccttggtattagatttacgttacctcagaccaaaggggaa

SEQ ID NO: 560089 - DNA, 929 bp, Homo sapiens
  misc_feature (86)..(86): n is a, c, g, or t
  misc_feature (340)..(340): n is a, c, g, or t
gatagtaaatcccaagtaaggtacctgccgtcagcagatttggctttcttcttgacacctaatacccacagtcctccaggtacctncgtcggcagatttgagctttctccttggacacctaatacccacagtcctccaggctccagtagattgcaaatgacctgcttactttctgttcccgggctgcgttctgacacctgtcggatagtaaatcccaagtaaggtaccagccgtcggcagatttgagctttcttcttggacacctatacccacagtcctccaggctccggtagattgcaaataacctgctttctttctgttcccgggctgagttcggacncctgtcggagagtaaatcccaatgttttagacgcccagctgcacaacttgattgccttacaaatgacctgcttccaggatgcggaaattcctaatttcttctgtgacccttctcaactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaagccttctccacctgtgggtctcacctgtcagttgtttgctgattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcggccgcatggcagcacagtctaatctcaacatcttcttatctgttccattccttttgtagggtggtttaaaaaaggcgccaaggtcaaataagctcgtgccgaattcctgcagcc

SEQ ID NO: 560090 - DNA, 337 bp, Homo sapiens
gaattccggctctctggggcggggacgctttatcacattaacacactttatgctgtctatgctctaggggagaggaccacttttttttgttggttgttgagacagagcctcactgtggcacccacgctacagttcagcggcttaatctgcggtgactagcacctccgccttccgggtgcaagcgatcactgccacctcatcctgcgagtagctgggactacaggagtctggcatcatgcctggctaattgccatattttttgtagagacggggtttcaccatattgctcaggctggtctcgaactcctgggctcaagttatctgtctgcctcatcca

SEQ ID NO: 560091 - DNA, 120 bp, Homo sapiens
caccaccacacccaccaacaccccaccacacacagccacccccaccaccacaccaccccccacaaccacccccacacccccctcaccaccccacccacccgccccagaccctcgacaccg

SEQ ID NO: 560092 - DNA, 642 bp, Homo sapiens
aatttacttgtattctaatcttctgatattccacacattctgtgcgatcatcgtcatacacaagcccttctgcaccatgcatgagtgtttctcaaggtacgtaccaagaagtgaaattcctggttcatatggcgtgactccgacatttttctccattcagccctgttgccctccagagatgggtgctccagctttgcgtacctaagtatgagagtatctgtagtacagtatgctctacgaggctccagtatttgataacttgagttactgctaggttgccatctttgatctatcatgtttgccgtgacctactacgactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcatagcagcaactgtcctgaagagaccaaaattatgcagatttaggtaagtccatggctaatgttattatattatgtgctattgtaatggatggggctgtggagtgttt

SEQ ID NO: 560093 - DNA, 84 bp, Homo sapiens
cctgaaactcctgtatttgatgtttgttttcgatgaggttccatgttttgtttttttgggaataaattaatatattgttttcca

SEQ ID NO: 560094 - DNA, 814 bp, Homo sapiens
  misc_feature (78)..(78): n is a, c, g, or t
  misc_feature (81)..(81): n is a, c, g, or t
agagtacgctgtatgatactataagacgacactaagaccgagagacttaacgactagaacacccttcggaatgcacgncgnttgataacgcccaagaactcgtggatcaacccggtctgaaggaattcggcacgagccttcctcctgttggtgaccatgtgtaggcaggtgcacagcagatggaatatggcggcaggccctatcccgcttaccatcatcgggaacctcttccagaaggaattgaagaatattcccaagtccttcacccggatggcccagcgcttcgggccggtgttcacgctgtacgtgggctcgcagcgcatggtggagatgcacggctacaaggcggtgaaggaagcgctgctggactacaaggacgagttctcgggcagaggcgacctccccgcgttccatgcgcacagggacaggggaatcattgttaataatggacctacctggaaagacattcggcgggtttccctgaccacccttcggaactatgggatggggaaacagggcaatgagagccggatccagagggaggcccacttcctgctggaagcactcaggaagacccagggcagcctttcgaccccaccttcttaatcggtgtgcgccctgcaacgtcatagccgacaatacttttccgcaagcattttgactacaatgatgagaagtttctaagggtgaagcatatggatctatgagaacttacaactaactaagtattccctgggttcaactttacaaaaatttttccaaccttatacaatacttggctggaagccacacaaaaagcataatgggggttgct

SEQ ID NO: 560095 - DNA, 410 bp, Homo sapiens
cacgaggggcattttgaacttgctgtctttggcagtcacatccttgtcggccagggacaggtccccctccagccgtgcaccatccagcttggctcctggggcctcgacatccacctccacgctgggcagagaaacctccacatcaggggctgtcacttccaccttggggtcttttaggtccagcttggggcccttgatgtctatttcagggcccttgaggtccactttgggcaccttgaaactgggcatctgcagcttgggcaggtgccctttgaggccggctccctcgggcacggggccctctgggagtttcacgtccaattggccagcctggagctccaggtcagtggaagggggctgaatgctgaggtcagtggtcttgaggtccccctgcatggaggggaggctca

SEQ ID NO: 560096 - DNA, 380 bp, Homo sapiens
tgcttttttttaatatgtttaaaaattatattaaaaccctttctttctaaactagttggattctgtggctataaattgttttgtctaacaaaagagagaaccctgtattaacccttttgcattaatttatttacagaatattagggctttgcccttggatatagccagtggtgttttaatgttgttcaatttcgaataggaattaaattcctggtctcaagagaaattattaatgccattttgccttagccattccctttaatattgtagagaattaaccaaactaaaaacaaatataaaaaatatggaattaaccccttatttcattgggggtttgcctttaataccccgatggccctttaaagatactttaaccctta

SEQ ID NO: 560097 - DNA, 308 bp, Homo sapiens
cccgtccaagcttccggatctgtcggcgatcgaagacatgcgcgagccgatcgtgcgggccaatattcttgtgccgcaagagcacctgggcaacgtcataaccctgtgtatcgagaagcgcggcgtgcagcacgacatgctgttcctcggcagccaggtccaggtgacctacgacctgccgatgaacgaagtggttctggacttcttcgaccgtctgaaatccaccagtcgcggctatgcttcgctggattaccatttcgaccgttaccagtcgactaatctggtgaaactggatgtgctgatcaacg

SEQ ID NO: 560098 - DNA, 830 bp, Homo sapiens
  misc_feature (770)..(771): n is a, c, g, or t
  misc_feature (778)..(779): n is a, c, g, or t
gatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcttggctgctttcccttaccatttccagtaagaaaaggggtgtttggaagaaatcattggccttgtccctcagggaatctgattaagcccgggcctctggatggtatagagtcatggtggtatattcccagttacctagaatattcccttgagatttggatacaattggagggaggcagaagtctgcagttgaagaaaaaaaataagtctgttggtcatatttaagtagcctggggctattttaatacgggattggatatcaggtcctttcatagtcgtatttggccaccgtaaacttaaaaaaaaaaaaaaggatttctccaaaatggccggtttcaaaacccgggggtttaaataagcaggtatggatttgggaaagctatagatagttggcaggaattggaccccttaggggcnncagtaannttacggggaggtctgataccatggggattctttacattgtttagattccca

SEQ ID NO: 560099 - DNA, 691 bp, Homo sapiens
  misc_feature (384)..(384): n is a, c, g, or t
aagcagtggtatcaacgcagagtggtcattacggccggggggggtaccaaaaaaaaaaaaaaaaaaaaaaaaaattgtgggcggccggggccgaaaattttaaaccattctcggttgggcggcgggggccccaggtaggtgtacggtgaccttgggccatataggtggtacctagggaaaactccggggccaattggacatatggcgttggggtttccttcacaaattaaaaaaacggcgcggggggcacccgggaggttgtctggaaacaaattccagagatggtgcgtcggagaggggcacataagtgggttcttactcacacaggggaggcccaaggagagaggcctcggattttcaaattcgccccccggcggggggganatggacaaagtaagaaaagaccgaagaaccgaagtcagcaagaaaagtgcgcccccacgcgagggcgaagagcccaacacagacaaacaacgaacaatagatcggcctgggatacaaccggaccaacagcgacaagcgaggacagaggtcagaacgaacgaagccaaaaaactgtactggccacacgagagataacgaagggaggagcaagaacaagacggacaccacaacaggcccagaaaacagaaaagcacaaaccgacaggaacaaaccgcaacagaaggcgacaaacacaaaaccaatcgca

SEQ ID NO: 560100 - DNA, 768 bp, Homo sapiens
agaagtcccgcatcagcctcatcccaccagaagaacggtgggcctggcctgaggtggagtgtgccagaagctcctgcattgccctgtggtgcctgaactccctgaggtgcccatggagatgccttatggtgatgaccccagagctctgagctgctctcacttggaagacagtgcacatggagcagtggcactggatgctgcaggctaacatgttgagcccgacttcagcagcctggtgtcacctctcatgcccgccgaatggatggctagccctgggttcttactatctgtctccctggtgctctcagctgcaacagatatcttcacggtgaaaacaaagaaaaaggccataatggtcagacgtccatgatccaatgcctgagggccccaagagtaaccaactgatgaggttaatgaggtcacaataataaaaaaatgcgtaggccaggtaaatccagcgccaactagcgtagataccaaacaacggtcggatggccatcaacagtggaggtccctagaattcaacctcaataccacattggaaatagctgccactcacacagacgcccctaaccgagcggacaccagaggaagctaagtcagggtgccacacgacccagaagcaaagagcgtgcaagtcaagacaacaggggacggcaaaacaagagacagacaacacacgaagcgaaccaaaagaagggcagagaggcacgacaggggcaagcagcgcaggacacgtagcgcacaaacgaagaaccaccggaccag

SEQ ID NO: 560101 - DNA, 922 bp, Homo sapiens
  misc_feature (743)..(743): n is a, c, g, or t
gtgtgatgatctcgtcggattcgtgagtggtgtaatgctggctccagtgatatccgtggtatgccgaagatgggtgcgagtgctctctgcgaccgatatcgattggcatatggaatgggcggttcctatctaatccgatcttgcgatgttggagagcgccttgtagcgccgaactgacagcatgtctgatgctgtgagcgatgttagaaccgatcataagtaataatgctgatgtattgcgaggctactggtaagaagtctagtgcgcattcgtagatatgcatagctacgattcagagagataggagtggggggagctactaagtcgttcttgttgatatgaggctggtaatagtggaatggtgttgatagtccgtaagggacagctggtattagaggagatcaaggggtggtggtccgtaaggttatcgttagatatggacaaagatgtagataattgatacgggaaacgtgttatcttgccctagtattgatatcatacctttaaaacgaagagtagtcacgttatacttatggagactatactgtactggattcgtggatgcacatggatattctcttaggtataagggtgatagaaattgaaggagtgaaagtaagaaagccgaagaagagttattgctcttttcaagatacctataaatgactgagaatgcctttttatgtgtgtcttgtgaatcgttggtcagagatgatagagtgtttgcctgatgacaataccnattcggagagcaactagagggcatggtgcggagccgtattatattagtgaggaattggggtttgcataaaagtgctaatgaggatccagagtcagattcgttgtatatggtggagatgccaggatctaaggaagataaggtaggagaagcgggtggggaagagatttggggggtgttgg

SEQ ID NO: 560102 - DNA, 203 bp, Homo sapiens
  misc_feature (52)..(52): n is a, c, g, or t
ccggtcatgatcaagtccgcatatcacatcatctcgggcccggcgatatttnggagtagatgtggtacaccaacagctgctgcagaatagcgtgccccagttgctgcggcacgaccatggggaacacgaggtcaaatccgttggattcgagcacaatggtggaatcctttcggctaaactctgggagtagactagaaatgaga

SEQ ID NO: 560103 - DNA, 318 bp, Homo sapiens
atgactacagtaaatcaccagagacatttaagagtgtcaacatgatccaggaaaacatgacctcaccaaatgaactaaataaggcaccagggaccaatcctggagaaacagagatgtatgacctttcagacagagaattcaaaacagctattttgaggaaactcaaagaaattcaagataacacaaagaaggaattcagaattctatcagataaatttaacaaacagatcgaaataattaaaaagaatcaagcagaaattctagagctggaaaaatgtaattggatatactgaaaggaatggcatccagttctcttgg

SEQ ID NO: 560104 - DNA, 1087 bp, Homo sapiens
ggttcagagcgctgtgtggagatcgtgagaccgggccaggaggtcctctgcatggtgctggggagtcaggcacctgcttcaccccaacgtctgcgcgacaagtcttctgagtgctgccgtggtagaccttgggtgttgctcctgcattcgcttgagagggatgtgcacagggtgcgcatgttagtgccagcaagccgactctcccatccacgatcctgaggagtatagcctgcgagtgacgtgggcactgatagaaggcagggacgatcgatttgtcgctagacaggatactggtgtgtgaacttcgcgtcgctaggtcctatggtcgcgtgctcctcagacgcaacagtgatgcaacgattcatcgatcgtcgaactcgtacatcgggaacgagactgttgtctcaaccgtcagaccatctttctgtgaatgccgccaggacggtctgtgcgagggaggactgtggcgttcgcttcggtgtcatgacacgctaacggtggacgtggacctatccagggcccaggaccgctgggtccccacgacctggcggtggacggacagcttgcgagagaacggccgcatggcggcagggaacggacgcaggatccattgcgcggacgaacggcacgcgcactgcctgatggcccacggacccttgaaaccccagggtgtcacgtgtgtctggctagcttgagttggcaaggacaaacctgtcctaacctggaacaatcgtctaacttactgagctgagctgggagtgcagcggcggtcactccggaagcccggacgtgcctgcaccatgtctgacttacaggcccctggggccccccatgcgcttgcagcttccgtaatgccctagggcggggccatttaggccgatcgttccggcacacaagcttggctttggcaggcgaataccagggcgcgtaaggaggggtccccaaggagctgatacacatgccccactcactgccctgccaggtacaagggctgccgtggatcatgaggcggacccgaacgccctccatggtaataaccaaaaacccccacccgatatctggcacaccagttgggcaagaaaccaca

SEQ ID NO: 560105 - DNA, 698 bp, Homo sapiens
ccacgcgtcgccgggagctgccgacggacggagcgcccccgtccccgtccgggcgtccgccctgtcggcgccatgcccttctccaacagccacaacgcactgaagctgcgcttcccggccgaggacgcagttccccgaactgagcgcccacaacaaccacatgtggcaaggtgctgacccccgaagctgtacgcggagctgcgcgccaaggagcacgccgagcggcttcacgctggacgacgtcatccagacacggcgtggacaacccgggccacccgtacagtcatgaccgtgggctgctgtggcggcgcgacgaaggagtcctacgaagtgttcacaggatctcttacgaccccatcatccgagggaccggcacggcgggctacaaaagcccaggcgattgagcaccaagcaccagaccatcaaaaccccgacaaccatagcagggccgacgccacgaacctaggaaccccaaacctacgttgctagaagcctacgacggagatgcagacacgggaccagcaagccatccggatggccattccatgcacatcccccccagcaacgtgcacacccgccgaggacaggcgccacaagccaaactcggacgaacagcccaccggagtggaaagccccctgatccagacctagaacaggccacccctgccgaggcccgaaaacaaacgcaagcacaacga

SEQ ID NO: 560106 - DNA, 90 bp, Homo sapiens
gaaaacctgctgtcagcaattgctcctccgtgggctgttcaagggaagtgagatacttttgtactatgcatttcattttttaaggaccta

SEQ ID NO: 560107 - DNA, 102 bp, Homo sapiens
gaaggggtatgggttgaacaacgaagctgcgggcgcaggtcggagacctggaggaggcgctggcccggggtggggcaaacaggcaggcactggactgcgact

SEQ ID NO: 560108 - DNA, 122 bp, Homo sapiens
gagagcgagcagcgagctggctggatcaccgagcgggcgcccgcgcgtgtggcgtgaggggaagccgctgcccgcctagtcttgtccagggcgccgcagatcgcccgggaggaccaagacgg

SEQ ID NO: 560109 - DNA, 377 bp, Homo sapiens
tggaaaatccatccaatactaaaagtagggtgtgaaagtctccagctattattgtattggggtctgtctctctctaataatatttgctttatatatctggatgctccagtgttgggtgtatatacatttaaaattgttatatccttttggtgaattgacccctttatcaccacatagtttcctgttacctcagttgttgtcttgaaatctattctgtctgatataagtatagctattccttctcttttttggtttcctttggcatggaatatctttttctacccctttactttcagtctatgtgtgtctttataggtgaagtatatttccggtaggcaaaagattactgagtattgatttttttttttttttttatt

SEQ ID NO: 560110 - DNA, 175 bp, Homo sapiens
ggaatagcgtcagatagcacctaggaagcaatgcaacaagttaccctacggatgtcagcgcactcctattctagagctccatatcaactagtagcggctgacaacctcgatgtttggatcacgacatcccgatggtgcagccgctattaaaggttcgtctgttcaaacgataaaa

SEQ ID NO: 560111 - DNA, 1445 bp, Homo sapiens
tctgaccaaaccgtttcactgtcttatcgtggtgtcatagatattacaatgtgccagtaagcaccatcatctcccgttattgtttatcatcaaatatactttaacattggagaacactccgggtgctccaagatatatacgcaggtgttttcagaattcacagtgtaaagagatacccgtgtaaacccagcatcgacccacaccctgtagcacagagtgtgccccggtgcacaacagaggatacacactagagctaacagtgggcaatcccccataagtaccacaaagtgccgtacatggagaccctatagtggggccacaacagaagaacgccacggagacaacaacatcacacccattacacacaagagactcacgtctccagaccactacagaacacgccgagaaaaaaagcatgcccggtgcgcggtgcgactcagccacacacacggagccaacacccgtgggcgccacagaacaattagttcacaaccaaccaaccggccccccctggcgaccccccgtcttggtcccaaaaaacatgtggagaccgcgtaacaccacacagatcagcccacacaagtacgcggacacaccgcggctcacaacaccaccacgacccaaccaccacacagcggcgacatacaccacccgtgggaccatccagcaggaggcggacacacaaccacccaagggggctgaccggcccaacaggcgagggggcaacgacgcggctgcaccatctgccctccccagcgctcgatgggcattagtgggcccccgaggcgacaccaaaaaccgccacaaactaaagcatctgtgctacaactcagaacagatccttcccagaaacaacaggaaccccaagcggcacaacacacgcccgccaccgcggtgaacattagtgtcctgcgccaacacagagaccccagagacggacaagcacaaatcgcccagcttaacaacgcataaccacggccgaaccacttatagcagagaccagacacacacaaaccaacaggattaccacgagcaaaccaaccacagcctgtgggaaacaagtcatagcgcactaggatggttgaccaccacagaagtgggcagacaaacaagcacaaaacgcaacgtcaggtcagaccaggcgcgacgccgccacgcgcaacagaagacaatcagagggagccactgctagcaacaccagagtgtggcgggtccacacacacccgcctcagaggatcaatttccacacaggagccactaaaaccacaccccgcgtctccagatggagcacctctgcgggacactcaaggggggaacgcgcagagaacgcgaacaggcaagcagccaccacaatggcagcgcccacaacagccagcgacgctcgtagcagtcgactggccggcaaacacaacagcggaagagaaccacaccacacaccacagacg

SEQ ID NO: 560112 - DNA, 108 bp, Homo sapiens
gctgcggacacggccgtgtattactgtgcgagagatgcgggaatccgagatacagcaatgattattaacgggattaagtactacggtatggacgtctggggccaaggg

SEQ ID NO: 560113 - DNA, 465 bp, Homo sapiens
  misc_feature (2)..(2): n is a, c, g, or t
  misc_feature (74)..(74): n is a, c, g, or t
  misc_feature (90)..(90): n is a, c, g, or t
  misc_feature (96)..(96): n is a, c, g, or t
  misc_feature (99)..(99): n is a, c, g, or t
  misc_feature (105)..(107): n is a, c, g, or t
  misc_feature (113)..(114): n is a, c, g, or t
  misc_feature (123)..(123): n is a, c, g, or t
  misc_feature (161)..(161): n is a, c, g, or t
  misc_feature (181)..(181): n is a, c, g, or t
  misc_feature (191)..(191): n is a, c, g, or t
  misc_feature (221)..(221): n is a, c, g, or t
  misc_feature (240)..(240): n is a, c, g, or t
  misc_feature (242)..(243): n is a, c, g, or t
  misc_feature (248)..(248): n is a, c, g, or t
  misc_feature (276)..(276): n is a, c, g, or t
  misc_feature (396)..(396): n is a, c, g, or t
  misc_feature (427)..(427): n is a, c, g, or t
tntgtctaatctattaacgaagaagcccaatacagtactagaacaatccaccagagtaatgcaaattacatganacatatatgtcactgnaaaacngtncaagcnnngggacnncatggtttnctccagtcatagttccacttcttaacaaaatgtgagtnttccctttggatttgtctgncatgtaagtntgttttttgcactaagacagccttctatantcatgtgataatgatatcntnntggcnaagttcatcttcccacagtttttgctgnccaatctctctaacctcagcctaggtaatttggtggcttgccgctcaacatttccttaactagaataaacatagagaaatagaattagtaataatccttttacataaatcccaaaactcntggcataacaactccccacaaaggaaaggtntaacagaactgaatgaggagaaagcacaatacaagaaa

SEQ ID NO: 560114 - DNA, 209 bp, Homo sapiens
cctggcatcaggaaagggagagagctgtggaccggtactctgcatagtcagccacatccgaggaagagaaactgaagggagaagtagatggcaatggttatgataaaccgggatagaagtaactcttcgcgagacttctttagtgctacgtcaatgtctcactgcacgtctagaaagtcctagatccacgctattctgaacccggtcct

SEQ ID NO: 560115 - DNA, 146 bp, Homo sapiens
aagttagttcataagaatattcccttagaagctgcggccgggtaggtcccaaggttttatccttcaacccgggtggggaatttacccaaataaaatattaaacccccattccctgcctcctaaaataaaaaaaaacccctattcaa

SEQ ID NO: 560116 - DNA, 361 bp, Homo sapiens
  misc_feature (127)..(127): n is a, c, g, or t
  misc_feature (279)..(279): n is a, c, g, or t
aggacgcggcgtaatcagggcgtacaggaacccaacttggataatcaatccccccggcgtattcacccgcgccgacgctcgcgtagcgggcacctcggtcgcggtcgtcagttatgtgattaacaanagcccgcggccctggcagaagccacccgtttgcgggtactggccgcgatcgaacaaacgggttaccggccgaacgacattgcccgcgcactggcctcaggtaataccctgacttacggtttagtagtgcctgacatttccaacccctttttntccacactggcacgggcgctgcaacgcgaggattcagcccacggacgcgtactgttgttaggtgatcgggcgacgaccggca

SEQ ID NO: 560117 - DNA, 113 bp, Homo sapiens
taacatactccgacgggtgctcccaaagtgctgggatatacaggcagtgagccaccgcacccagccaacagaagaaatgtttaacagttcagtacatagtgcacgcgaggtag

SEQ ID NO: 560118 - DNA, 1208 bp, Homo sapiens
  misc_feature (331)..(331): n is a, c, g, or t
  misc_feature (594)..(594): n is a, c, g, or t
  misc_feature (686)..(686): n is a, c, g, or t
agcgggacgcggacagtagttccgaggaggaagagtacgagaacatgatagtgtgtccgcgaatccgtaacattatccggacccgtaaacagcatgaacagctcaaggtcgaatatccgatactacaggcgaaccatacacgctgtgggtctagcctccgtagtgggaatatcactaggtaggtacctcgtcatgaccgttggcattgcttgcatcatggctctgagccttagtaagcgaatagcataccaacatgtctcatacatctacgaagctggccttagtgcgtctcgagcattagtgctatcgcaacagaggctctcgtcgaaangacgctacgactcgactgtcaagcgcgagaagattatcctttggaaagcctcatcattgcttagtcatatacccaatgtgtcctcagggtcctagtgtcattagtaaggagctctctatattggctatcgcattaatatcctcgctatttggcattactatattcgaacgatcaggtacaccgaatcatagtaacagctctgggggatccgaacgatgcctgtgctggtaagagatgggatattgactgcatgagtgcacctngaattcgggagacatggggggcgtaatatgactggcccaaaacagtttcactacgctaccactctgccgtggtatgactcggtacacttatntgacttgactgcagtactttgtcaggtacttgttacgagcggaaagcactaaccgatcactcagataaggacgaagctgtgacatggaggatacctgtcgttactaaggggttagggtccagtagatgggtgggttgaccaacctagtcttgtgtagaaaggaacccatatgacctatacgattttgggcctaggtgtaaagatgatacctattaaccgtatgaagctagctttcatccgccaacattgtgattctgggcgttttaaggttcattgattttaaacccttgaataggtggacctagagtttaaggaaccactaattgtgggcgaacgaggcgagtcggacccttgtcgtggtgtgggcccccacaaaggtggattccaagaggccacccttttgttcaactacagttcttggctcaaacgggataccctgtggtacccttgtgctacacaccacgattcacttgcctcgtcacacatgtcattcatggaggcgaagcgggcagggtccttcag

SEQ ID NO: 560119 - DNA, 1449 bp, Homo sapiens
  misc_feature (465)..(465): n is a, c, g, or t
ctcccttgtgtgggtgtcgcgcgtaggtgtcgctggtcctctgctgatcggcgccgggtttgttttgaggcggccgccttattctgtcttccgcgtgggtatgttgacctgccccccgtagtttttgtcggcgctgctctccttcgttatgtcccggtgtagtactccccgacggttttgtggcgccccaagtttcgcccctggattgttccctccggtccttcctggtggttgttccgcacgccacgcttgttggtgtgggtgcgcccccgggggggactccccgggggggggctctccaccaacgaatggttttaatgcggtttggggatcccaagaaatgccaaatgtacaggggggttttcacccccctggcgtgtccagacattcccggggagggaaaagttctcacatagggggaggaaattccaatggccctctatttttaaccccagggggaaggcncaacaaggatggtgtttgtttgttaatttccacgaaacctgttatagtggggtggttccacgaaggggcccccacgccttggggtagggaacccagccacaccccctttctttgggaaggttgggaattgggcccccaccccgagtttaaggaaaattgtgggaaatctcccaaagggcctccagagacgccgagagcgcgcccttgtggcaccccacgtgttccccccccgaggagatacctcgtgacagtttctttctttggagcgcccctggttgttgaacactgctcgggaccactgtgccccctcgccttgggagcccacagtgtctccacacacagctgtcaccccgtgtcccctcggtacaccctcgcaacagtggccctctctctcccacagagaatctggagggaccccacagagatagagagaaacccgccccacactctcctcgggagtcttgtcacccacttgagaacctccacatggcgcaacacatggtatatgagattggagaccacgccacagagggtttcttgccccacaggaggagaaatatattaatgtctctggctcgcacagcaccacctctgtgagagagaaaggaaacttattccttttcctataccactataagaaaccccaaagaggctgggcgtaagtggctcacacaccccgtgatttcccacgcacctttgggagaggcccacaggagggcgcacagagtcaccttcacggtcacggagtttcgagaccacccctggcccaccactggtaaacccctgtccctagtataaaatacccacaaaattagctgggtgtgggtgtgggtaccccgtatttcccacgttatacttgggagaggcctgaaggtgggaggatcttttgaaccccggagtttacgggtcctagcctgctgtgattgtgcctacgaatagcccctgcatacccacctgggccatatagcccagatcccctctcct

SEQ ID NO: 560120 - DNA, 84 bp, Homo sapiens
ggatttgctggtgcagtacaactaggcttaatagggacatgataaatttatttaaaatgagttatgatattagcaatatgaatc

SEQ ID NO: 560121 - DNA, 148 bp, Homo sapiens
tttcccccccgggggcccccggtttttttttttccccccctttgtttcccccccttttgggggggcccatgttaaattaaaacccttttttaagggggggcctttttttttactttgcccccggggtttccttttttttggtttcccc

SEQ ID NO: 560122 - DNA, 593 bp, Homo sapiens
cactatttcgtgcaataatatgcacagtgcacgtaaaagcaatcgcacagcaaatttctcataggcatctgggtttcgagtgtgatcattaataacatatacctttgctcttttcagggcaacataacaaccacccttcactgatagttgggaaaagaagattgggttatctttgccatatcatttagctggaagtgacatttaaaagcaccctgcatcactagtaatagtgtattacgctattctgcccttgtaatcggtgtccctgtaaaacaatccccacagattactttcagaaatagatgtatttctctacgtaagggccaggtttattttctccttttttgagatttctagaaaacaatgctgcttgcacatgttggttcttgaaaccttcactagaagaatttcaggtcataccaacatgtggataggctatagctgttcagaggtctcctgggggagcttaaaacgggggaaacactggttttcacagatgctccacatggctgtctttaaaagactcaaaacttttttttgtcctctatgttatgcttggaagctcccccccccacaagtgtgtccagtcgagt

SEQ ID NO: 560123 - DNA, 251 bp, Homo sapiens
ttagctgatgttcctatacccctatagcattctggtggctgtttagacttttttaggtaaatattctcaggctacagactatccatacacagagacatattacgctcagctatgcaggcaaaatccatctagagcctgacttggaatgaggaccgtgggaacagaagtcactactgctcattcccaggacatactaacatgagcaatgaagatggccacagaacaaggcaaagttacacacaggctttggt

SEQ ID NO: 560124 - DNA, 879 bp, Homo sapiens
aagccaggctagtaccggtaccggaaaacccgagacatacgacacccaggtcatacaaggacatgaccatggatctactctctgtgtcatctgcgactaccagtataatcgcatagagcggcagagttgttacctgcgatcctctgacctagagagcgaaggggaaaagcggcgagatagactagaccgctaacaccataccataaagccagctaggagcacctgcagtccaagtacatcggcacgggccacgccgacaccaccaagtagggagtaggctaggtagaaccagacaaccgcagactacgtaactagctacctacatagggccactatacgacctatctacaactaactatacgccatatgcggagaatagagagcaaagcgcgagtaccgctatcaactatgataggaacaagatagctatcagcctatgtaggaccgccagccgacaagcccgaggagaactgagactactgccttaccaccgcagtagcggggcacctactacccagcgtattctaccggttaagccaatcctactataagtatatcctagtactccaaaggaccggctactaccatggctacctgcgcctacgtgcttatccgcgtacagaagtgctatgcccggggagtcccgcctgacctgccttcatagtaggacccttagaacagcactgggagaccagcaggactcctgagaactgtgctggtggagaggtcctagagccggcgagcgtatgagaagagggcatggcgctaggagtgagatgggatttggcgtctcgtatttggcttaattggattgttcattgggctatttccagtaaaagtttagaacatcgttaacacaaaaaccaaatacacaccaca

SEQ ID NO: 560125 - DNA, 182 bp, Homo sapiens
cacatcaagttctgagctatgtggacaggaggccgatgaagagggaatctgtgccaaattctctctttttttttgatttttacctgaaacagagtctcgctctgtagcccagcccaggttgaattgcagtggcccaaactcggttcattgaaacctccacctcctgtgtccaagcgattctc

SEQ ID NO: 560126 - DNA, 268 bp, Homo sapiens
taaaggtgcatccttgaaagtattttagagcattgaatacttttcaaaatcagtgacgcataatatgttcgctccccataaaaagaaatgaattgccatgtttagagtccacaggactatattaccaaattgattactgggagactgacttgctcctatcaaaccccggaccggcacgcgagtaccaattcttcacttgcataggattttacatccacatcctctgctttgtaagtctgtaccgcctcctgctataaactgagtgtac

SEQ ID NO: 560127 - DNA, 546 bp, Homo sapiens
cggcgtcgtgtacactaacagcaataaccataaaatgacttgcatgcgccatccaacagttcttatcgatcctgcgacgtacatagaatagccaaacaatacttacacaaaagaacgcaggtagaggactaccttctcaatttcaaaacttactatgaagcctagaaaaattaagacatcgtagtaccagcaaaaggctagatacaaagatcaatggaacctaattaagagcccagaaataaactcttacatttacaggtaaattgatttttgacaagagtgccaaatcagctcaatggagacagaatagtcttttttatcaaatggtgtagggaacaaaagaatagccacaaacaaaaaaatgaaactgaacccttcttcacaccacacacaaaaattaactcaaaatggataactgatccaaatcgaaaaactaaaagtatgaaactcttagaagtaaatactctgggccttcgagggtgaggaattcctggactgaatggtggggaagctctaaggagagagtcaggctgaaactggggggat

SEQ ID NO: 560128 - DNA, 380 bp, Homo sapiens
cagtcgaaactcatgagatctttctatcttatttgtggtggatgataacacagcaggacacttccggtttattcacaatgaggctgcagacatctaccaggctttgagacaaactttaacttttcctatgaactcttctctaaagcaggtcacagggaaaaaaagggtttaaagagaaataacttctccgggcaaaaactgaggttagcgggcctatcagctgtttcttctcactccaccactgctgctgactggaggagcagcctggaaagcagccgccctcccgcaaacaggtaaaccacattacctattcctgtggcggaggcaaatggaaggtctaacctaacggggtagtgctgaagttcggggacaaaagccca

SEQ ID NO: 560129 - DNA, 751 bp, Homo sapiens
  misc_feature (7)..(7): n is a, c, g, or t
  misc_feature (100)..(100): n is a, c, g, or t
  misc_feature (102)..(102): n is a, c, g, or t
  misc_feature (112)..(112): n is a, c, g, or t
  misc_feature (123)..(123): n is a, c, g, or t
  misc_feature (125)..(125): n is a, c, g, or t
  misc_feature (152)..(152): n is a, c, g, or t
  misc_feature (154)..(154): n is a, c, g, or t
  misc_feature (187)..(187): n is a, c, g, or t
  misc_feature (190)..(191): n is a, c, g, or t
  misc_feature (197)..(198): n is a, c, g, or t
  misc_feature (220)..(220): n is a, c, g, or t
  misc_feature (239)..(239): n is a, c, g, or t
  misc_feature (252)..(252): n is a, c, g, or t
  misc_feature (260)..(260): n is a, c, g, or t
  misc_feature (268)..(268): n is a, c, g, or t
  misc_feature (297)..(297): n is a, c, g, or t
  misc_feature (331)..(331): n is a, c, g, or t
  misc_feature (334)..(334): n is a, c, g, or t
  misc_feature (341)..(341): n is a, c, g, or t
  misc_feature (343)..(343): n is a, c, g, or t
  misc_feature (347)..(347): n is a, c, g, or t
  misc_feature (352)..(353): n is a, c, g, or t
  misc_feature (357)..(357): n is a, c, g, or t
  misc_feature (360)..(360): n is a, c, g, or t
  misc_feature (364)..(364): n is a, c, g, or t
  misc_feature (382)..(384): n is a, c, g, or t
  misc_feature (386)..(386): n is a, c, g, or t
  misc_feature (400)..(400): n is a, c, g, or t
  misc_feature (460)..(460): n is a, c, g, or t
  misc_feature (473)..(473): n is a, c, g, or t
  misc_feature (532)..(532): n is a, c, g, or t
  misc_feature (537)..(537): n is a, c, g, or t
  misc_feature (621)..(621): n is a, c, g, or t
  misc_feature (665)..(666): n is a, c, g, or t
  misc_feature (674)..(674): n is a, c, g, or t
  misc_feature (684)..(684): n is a, c, g, or t
  misc_feature (747)..(747): n is a, c, g, or t
catttanctccaaaagattaacagtggtagcatttgggtggtctaacttgattctttctaacattcccatattttccttaataagcagtaattataattncnacgggaaatnatttcttttantncccagtgcagtgtcactgtcaaataancntcagtggctttggccccaattcttgtggtggcnttnnccgctnncccactccccacccatccccantagggcttgcgcacctgtngccctgctgggcncgtctgtnttgccccngccctcagcgtctcttcctctcgcttccngctatttcttttccctttccttcttgattcgggnggnggctttncntccncgggnnccancgntagngtccgtgaggtggcattnnntnttttttttttttgngacggagttttgctgttgttgcccaggccggggtgcggtggcgcggtctcatctcaccgntgcctccgccttntgggttctcgcaattctcctgcctcggcctcccatgtagctgtgattattggcgcttgnaccangcccggctaattttgtatttttagtagagatggggtttctccatgttggtcaggctggtctcaaactcccgacctccggtgatncgcccgcctcggcctcccaaagtgctgggattacaggtgtgagnnaccgcgcncagccttgangtggcatgttttcaaagaacatggtgcctcagttttggacacacagggactcaaatacaatcntttt

SEQ ID NO: 560130 - DNA, 590 bp, Homo sapiens
gtggtagttctagacgatcgctgagacatgattgagcacggccggctgtcccagagtgcccaggccccatgtcatttgtgcacatttgtgatgggtcacggtgtctcctcgtcacactcacttgcgagaagggaccgtatccgaacaaagaactagatgactcactgtagggtacacagtcgtactacacctccaggtagcttgtagcgtcccatgacagggttcagtgaaagtcatccgggcaggatacacagcattggccggggtgcggatgtcacaccttcagaggagaaacagggcattgggaaagaaacacatagacggggcggcgggggtgggggtgcatgctccagggtcatggtgtcatagacacccccaaattgggaaggggcagtggagctggaaaccaagtgatatagtttggatctgtgtccatacccaaatctcatgttgaattgtgatctccagtgttggaggtggggcctggtgggaggtgattggatcatgggggcagtttctaatgaatggtttatcaccatcccctccgtgctgttgagatctggttgtttaagagtgtgtagcacctccct

SEQ ID NO: 560131 - DNA, 911 bp, Homo sapiens
agggcccattacggccggggggggacaagaaaaaaaaaaaaaaaaaaaaaaaaaaaaaatttttgggccgcctgggccccgaaaaatttttaaaacaatccggtggggcggcggccgggggcccaagacagggtaaggttgaacccaggggctcatagctggctccccatagggagactccggggctcatgtgaccttacggggctgtgggtttccctaaaccaaaataaaaaacgcgccgggggggcaacacgcggagcgggtctggaaacaaactccaagatgagaggttccgggagcgccaactacacggggaactctataattaaacaggggagctccacgcggagctccgatactaaaatttacggccccgcccgggggaacaaaccagatacagcagtggagacaagcacacaagacaacagaagacgcggaaggaacaagcatcgccaaaaaagaggggcaataccaaagcacatgagaaaaagcgcgaaccgagcgaagaaaagacgacgacgccgtgcacaattaggagaatcgataacgaagcgcagtaaatggaacgaaggggagcaacaaacaacaagtagacccacaagaggagcaccaatcagaacaaaacaaagcggatgaaaaaacagcacacgagaaccaggagagcaaacaaaaaacatcaacagcaacgacaacaacacagaaggacagaagaagacacggaacacaagcagaaaagcgaccaacaatcggaaaaacaaggaggaaaaaagagccaacacaaacgagaacaacgaacgagccgaacgcacagcacacaagaaaacgagaaacaagaacacaaacaaccacaaaaaggacaaagacaagaaacgaaaaaacaacgaacacgaaaaggcaaagaccagaaagaa

SEQ ID NO: 560132 - DNA, 231 bp, Homo sapiens
cccctccagctgtccaacacttcccgtttattcatgccttggtaggggattcggcccttggtgatgagctcacctgagtccggatcccagtggaccagcacgtctgacttgattgtgaatctgccacagaatgcagcttctggtgctgtccacttgatgcggaacttggaaccttgtcaggggttgtacacttcgtccttgatgagacgcgccacgccccatgtgcggaga

SEQ ID NO: 560133 - DNA, 679 bp, Homo sapiens
taaaggagagagactttttccgcgtctctcgctccctgttaaagccgggtctagcacagttgcagacgccaccagcgagaaagagggagaggaagacagatagggggcggtgggaagaacgaataaagaaaggtacaaagtcttctaggagaacctttcacattgtgcaacaaagagacctaggggctggcagagagattccgtgggacgcagggctggaggtgtctattgtcgagcctcaggcggtcagggcctcgggcgcgagtcgagaccctgctcgactcctctcgcttctgaaaccgagcgttcaggagcggctttttaaaaatcgcaaggcacaaggacggtcacccgggcgactatgttggctgatttttcgccttgcccctctttaaaagcggcctcccattctccaaaagacatttcccctcctccctttgaagtgcattagtggtgatttctgcctcctttacttatgaacttactttaggtatggctttttcccccctttggaacttatgtgctgctgttaaacaacaacaaaaaaacaacaaaacacagcagctgcggacttgtccccggttggagccagtgccccgcctggagtggatgagcctctccatgagagatccggtcattcctgggacaagcatggcctagcatccgttcctacctaacg

SEQ ID NO: 560134 - DNA, 192 bp, Homo sapiens
tctgacggtcagcctctcacgactccccgcctttacacggttcctgccccgggtctggtgtcttctccgaccggtaccacgatgtatgttcggcgtggcgcctctaccgactgggactggcctgcacggatcgctgctctgtgcatgtctttgagtgccctcctccgacctcttctggcgtcactcttctga

SEQ ID NO: 560135 - DNA, 731 bp, Homo sapiens
cttgatacagaatattgttctccacacacaagtctcatcagtacatgcctgtactctctcacagctcatgatactacagcttctacaccaatggggagaagagggtttcctggctcatattgacagaactattgatttctacaagaaccagagggattccatattggcagctgcagacaagtggttacgtggcttggcagagtggcatgttcccaaagctggcatgtttctatggattaaagttaagggaatctccgatacaaaacaactgattgaagaaaaggctattgaaagagaggtcttacttgttcctggaaatggtttcttcattgatggttcagctcctacctccttcttcagagcatccttctctctggctactccagcacagatggatacagccttccagagattggcccaactgataaaagagtctttatgaagaaatcaaactcagcattggactcataatttttaaataaattacttctgtactttgcagaagaaatggttgttgctgtttgactgacaggatggatccaggttgtgaaacatctgtagcaatttccctgaaccactttaaagtccccttaaatccatcacattgccaaatagctttctgatctacttttgccctttgattaatttgcaactgacaaagcattaaattttattgtaaagagctctatagctgctttataatatccaataaatttttctcaaaactaaaa

SEQ ID NO: 560136 - DNA, 394 bp, Homo sapiens
aaggtgcatgcattcactctccaggctcagtgaagcccacagagctcacagagaaggtgcagggttcatggtgatttgagtttcccaaaagacatggctcctctgctggcccccacccaaggaatgaggtataaaagggagaggtctggtgtttgttatatgacttacagatgcccctccccattcatgctatttttttttattggaagaagtttcctccaggactccttggccacaaggcttcctcaagttcaccttccttgtcctgcattcaaggatcttcctcctcttattgcaaggctaaactctctcttctccctccctcagccagaacagatgaggaacccaaccttgaagatgcgtcgacgcggccgcgaatttagtagtagtaggc

SEQ ID NO: 560137 - DNA, 422 bp, Homo sapiens
  misc_feature (1)..(1): n is a, c, g, or t
nacacatataattatgatgcctgtaattgcatactaatccttacaaacaaacccactttgattaatctatatattccccaataagtcataatcaaatcacaattattcaatattgaattgtctatattttgttaagactttgcttccaatattcccaatggcattattaaacatttgtgtttactgtagctcaacaagtattatgaaggaacttttcaaccaaaagaaatagagctctctcctgtgtgatctctttttccccagaaagtttgttgagagaattaaatgcaataatgaacgtagtaaagtgctaagcttcatacctggcatatggtgagctcaataaatgttagctatgatattattatcagttatgtaaatcagttaaaaacaacaacagttcttcactgtttggtgcactg

SEQ ID NO: 560138 - DNA, 906 bp, Homo sapiens
gaatcacaaagaatctataaaatatgggtaaaaccaatccaggtgcagtggaggacgaaattaaggtacagaaatcagttgcctaggtgtacataagcaatcaccagtgtaaaaacgcatacactcaacatatacaaataccctgtatctcacgtaacaactagcggaactaacaacagagaaatgttcccacgctgactcgataagcacatacaacaatatacatgaaggaaacttgataatgtgacaaacaaagaagaaaagggaacgaacattcgactctaagaactagtgtagagccacctttgaacgttcttctaatacggaaaggccgtaagtactcagtaatagatgaatagtcaacgacctccctaaatttacgctataaaaatttagcgctgactcttgtccctccactttataactttgggagctaaacattgggtattcatggatcacaaagactgggaacaataaaacactgtgggacgactagagcgggcatgtcgagagagctgggcaagggttgacgacacgtaaactgtgggtattctgagccactatactgggtgagggggctcatttcggtataccaaatctcagcaatcatgcgaaaatatcccaatgtaacaaggagtgggcatgttgtccgctccttgcacagtctaacccatagatgtcgcaacttactgctaattaagtttaagtgactgagattgaccttaagaacacttgaagaatgatcttcaggtaggagactaccgaccatgattcttgcagaacagtgaccagggggcattccacggtcttcttaacaaactaaacaagtatagaacagccactatgaagcttttttcgccttccactattaacataggtctaagggcgaagtcacgccacgaatag

SEQ ID NO: 560139 - DNA, 505 bp, Homo sapiens
  misc_feature (80)..(80): n is a, c, g, or t
  misc_feature (195)..(195): n is a, c, g, or t
  misc_feature (197)..(197): n is a, c, g, or t
  misc_feature (380)..(380): n is a, c, g, or t
  misc_feature (389)..(389): n is a, c, g, or t
  misc_feature (397)..(397): n is a, c, g, or t
  misc_feature (412)..(412): n is a, c, g, or t
  misc_feature (457)..(457): n is a, c, g, or t
  misc_feature (481)..(481): n is a, c, g, or t
aggcagtgatgggtggggtgggaaaaagcaccatgtgttttcactctggtccatggaactggtagcctggtccccaggtntcaggctgtcccaggcctgatggtagggcttcactagggacctgctcctttctgcccaggagcttatctgcctcctgctgccatcaacctgctgtctatcgatggtgcccacggnancaggctgttcatgccaagcggtgcctgcaggctcttgccgagctgccctcagccccacctcggcatcctttctgtgctggtcagcagccaaagtccagagggggctgagtcagcaggggctgggcatgttcagtgctggccctggagcatgtgcacacccagttgggtttgttgaacagcacngggggtttnggcttcantttttcctctggaantcaaagtggggttgccagggagttgggggagagaccaggggagcngggacaagggcattttcgggagcnttcaaagggcagaggggtttttta

SEQ ID NO: 560140 - DNA, 117 bp, Homo sapiens
tgtagaaatcgcttgcaaagaatgctgttaagattgcaccgacaataccaccccaccgtgtaaaccaaacgtgctttaaaagccgatgactctttaatgcgtttggtttacacggtg

SEQ ID NO: 560141 - DNA, 424 bp, Homo sapiens
tataaggctatgaaagagaagacatctgaattcattggtaagacaagtggaaccaagccagtggctcatattgaccacatttactgctgacacgctgggttctgctgagttcgctgaggaggtcaatttaaatggttctggcaaactgctcaagatttacaggctgtgccagtcctggaaaaacagtttacaattgttgttcgaggttctaacaaactggtgcttgcagaagctgagcgctccattcatgatgccctatgtgtcatccgttgtttagtgaagaaagagggctcttattgcaggaggtgatgctccagaaaatagagttggccctacgcattcactgaatattcacgaacactgagtggtatggaatcgtactgcgttcgtgcctttgcagatctcatggaggtcatccatctac

SEQ ID NO: 560142 - DNA, 339 bp, Homo sapiens
tggccttggaattggactttaaatggggagcagacaagggaggatggggaatgtgggacccggtgtggtgggcattagggcttggaggggtggggattagggctccaaacccgaaagaaaatgtccccggtcccaggtggttaacaaagttttggcaggtaaaaaatggccgcgttgaaggccccctccttttggctgggaggggcagaactgtgggcagattttcaatgcctttttgaagttttgaccccccaaagaccttttgccttccccctcctccccccctgatgtccctctgtgtttgatagtgatgttggtgaaagtttgtagacccccgga

SEQ ID NO: 560143 - DNA, 385 bp, Homo sapiens
atttttccctttttccttccttatccctgcccaaaaagtagattaaaagatgggtttgccaaggttcttcccttttacaaactgcggtctatggggcgggatcttgtttttcccctactgctcccccaactatattatcatgcaaaagcgggattcttctttggtggagataaagatttcttgagttttgttttaaaattaaagctaaaggatctggtatggccttaaatataatatgcccccagggctttccggggccctgcatacaatttgaggccccccctcccagtttttatatagagggcgagaacctaagtttcagttgattttccaattgaaatgactaaaaaacaaagaagccccccttaaaccaatattgtttcta

SEQ ID NO: 560144 - DNA, 210 bp, Homo sapiens
cgaatcgcggcggggcgcatagggcgtgtgaaagatgacttccagatccttgatgtcatagtgaaaaggtggagggtcgagggctttgacctgatcctggatataagtgttaatgtccggaatatcactgccaaagctcttgcccttgtggcggcgctcgaagcccgccatctccagaagcaggtcatggtaaataaagcgattggccat

SEQ ID NO: 560145 - DNA, 322 bp, Homo sapiens
gtgctgttacggtatttttttttgtagctcctgtcagtctttcttatgagatctttgactgcaattgcatacaacaagccctgcacaggagagtcatacggtgattcccacttgatgaccacggaggctttgcccgtatgaaccacatgcagcttacgggtcgtaagcctgctgtccgggatcatcttcactacaacgcacccagaggatggcctctgctagggtaccactacacggaccagaaacaaatactgctcatccttactgacaatgaccgtcttgttgaggagtgaagcttgccaagctcttcggcttgcgatag

SEQ ID NO: 560146 - DNA, 160 bp, Homo sapiens
aataacatgggagcaggcaggctggacatggaaggtttgcactgaatttgggaagggacttacttagtaacgagccatgatcaggaagctaagaaagttacagtctcaggaatggagcttttaacttacatgtgccatattaaaggtaaaggtacttagg

SEQ ID NO: 560147 - DNA, 140 bp, Homo sapiens
agctcggtacgcggatacgagcacagttgctgagtatgaccacaatccaatcctccgaccatgagtcctcaacccctcagacctctcgagtccacctcttcccctcatcacggtagtcaacacaccacttctgacgtacc

SEQ ID NO: 560148 - DNA, 430 bp, Homo sapiens
  misc_feature (3)..(3): n is a, c, g, or t
  misc_feature (35)..(35): n is a, c, g, or t
  misc_feature (84)..(84): n is a, c, g, or t
  misc_feature (104)..(104): n is a, c, g, or t
  misc_feature (119)..(119): n is a, c, g, or t
  misc_feature (140)..(140): n is a, c, g, or t
  misc_feature (182)..(182): n is a, c, g, or t
  misc_feature (238)..(238): n is a, c, g, or t
  misc_feature (255)..(255): n is a, c, g, or t
ggnggcttatgccctataaacccaagcacttgggnaggctgaagtgggagggatcacttgagcccccaggaattcaaagatcanccctgggcaacagagcaaantccgtgtctcctaanaaacattttttaaaaattgantgtggcagcccaggcaccgtggctcatggctgtaatctcaanactttgggaggctggggcacttttggaggcttgtggatcacaaggtcaagagattnagaccatcctggccaanatggtgaaaccttgtctctactaaaaatacagaaaaatagctggatgtggtggcacgtgcctgtagtcccagctactcgggaggctgaggcaggagaatctcttgaacccgggagtcagaggttgcagtgagccgagatcgcgccactgaactccaccctggtggcagagggaga

SEQ ID NO: 560149 - DNA, 295 bp, Homo sapiens
gccccccgggcttgaaatttaggggtttttcccccgaaaaaatgtttagagattgaaaaaaaccacgcggggcctatgttttgaaaaaataaaaacccggctttttaaaaaaaggtttcccccaggttttttttttttttgggcccccaaaaaacccctttaataagtaaaagcagggataatcctttttttaaccccgggaaatttttgtttaaaagggccctttccgttttgcaaaaaaaggcatgggttttgggtacccttggggaaactaataacccccaattgtttttta

SEQ ID NO: 560150 - DNA, 425 bp, Homo sapiens
  misc_feature (24)..(24): n is a, c, g, or t
ctgctcagccactccctgtgagtncaatagttggcagcaaggagccagacgccacaacaagactatgagcagacttaacgctcctctcaagcagatgccttgttgtcctacaaagattggctactgctgccttacgcctaatgacctttggaattggaaaattcttctccccaagaaatgtatgtatcaagctataatgcacccagattcaccttgtgcagctttcatttcaattttgtctcttcctcttattttctttgcaaatggcttctatgtgtaacgactttcatagcttatcccagttcctacccagaagtgatggtaaattgccaagttctctgaaaaactcatggaagactaccatgtacaaaatctggggagacaggagtttaagactagccctggcaacatagtgagacctcata

SEQ ID NO: 560151 - DNA, 452 bp, Homo sapiens
gaactacctggatatgtagtacttctggcactatctggcatcggaactcctgcccaggattacacttgtcgtctttgaaaccggctcctccaacctgtgtgtgccctcagtctactgctccagtctatgcttgcaacaaccacaaccgcttcaaccctgaggattctaccacctaccagtccaccagtgagacagtctccatcacctacggcaccggcagcaatgacaggcatcctcggatacgacactgtccaggtttgaagtgcatctctgaaaccaatcagatcttcggcctgagcgagacggaacctggctccttcctgtataatgctcccttcgatggcatcctggggctggcctaccccagcatttcctcctccggtgcacaccctgtcttttgaaaaacatctggaaaccaggggcctggattactcaggacctctttctctggt

SEQ ID NO: 560152 - DNA, 191 bp, Homo sapiens
  misc_feature (183)..(183): n is a, c, g, or t
  misc_feature (187)..(187): n is a, c, g, or t
tcagcgccctggggcaatttgtttactcctccaacaaaccaagcctatagggatacaatgagaattcccatttaacagatgaagaaaaagaagctcatcaggagtcacttggtttctaaaaatattcattctggggagggggcaagaatagaaagaccagtagtctgacaaggaagaaggaangggntgaa

SEQ ID NO: 560153 - DNA, 1242 bp, Homo sapiens
tcatggcctggcttctcaccgccgcggagcaaagagggtcccgtggaagcgtgcagggtcggcgtccagtgatgcggcttctggggtgcatccgtgctggcgtgcatgatgtgctgtgatgcaaatgctgtgcccctgtgtgtcctgtgtgatgctgtgatgtgccctgtgtgtgtgcccctgctgtgtgcatgtgactgactgcttgacccctgaatggatgctctctgatgcactgcttgatgcatcaatatctgtgagtgatgtgctggtgctgtgctgtgcatgcacctttcgatggtgcctgtccacctgcctttccaccactacttcatgcaatggcctgaccacttcctgcctgtggctctggtgctctgtcatgcttgctccaggcagcccgacctgctgcctagctgcggctgcagctgcctcacggcgctctacctgctctgggagatgtacctgcacctgagcctgctggccgccaaccccttcgcctgccagcttcgcgcacctgctcaacccctgctgccgcccgccctgcggcggccaggaaccctgaccgacctcctgctctcaggatttttacctcctataactccaccagaaaagtttttactttcccagctgatgctggcacccccacgggaaactcttcaaaaaagacgcctcgccagatagcactgatggacgttggaaacatgggccagtctgtggacattagtgggcttcagttagccttggctgaacgccaatctgcattgccaacggcaaagcaaaagcgagcttccccaagtattctcctgtgacccagacccgggaatcttctaattctggatttggacagtcagtggcttctcaaatcacagaagcttagtcacgcgtgaccaaatgccacctatttgcaggccatttcgacccgcagttattctgtcagcggcttcaaatccgacatttggttggtggttgtaactgtggcatgggtctaaaagcccccgggggtgccgttacacagcggacacaggtgggaacaaaacgcaggtgtgtggtacagaaatagtcgtgtggtgtagcaacaatagcaaatgttgaccagaaccgataaagggcctttatatactcgtaaacgaacacatcttggtggttgatgtgtgtagaccccatgtatactcaggtgctgcccgcagagcatgtcagtgtgacatcacttgttcgtagagttgcattagtcacaaagctgtt

SEQ ID NO: 560154 - DNA, 274 bp, Homo sapiens
ctgaattctatgcaagggcaaagaaggggtgaggaagctgtagaagcaaaaggtggggctgggtgcggtggttcacgcctgtaatctcaggcactttgggaggccaaggcaggcggatcacctgaggtcaggagttcgtgaccagcctggtcaacatggtgaatacccatctctactaaaaatacaaaaattagccaggcgtggtgtcaggcgcctgtaatcccagctactcgctaggctagaggcaggagaatcgcttgaatccgggcagtgg

SEQ ID NO: 560155 - DNA, 356 bp, Homo sapiens
tacagagtgaatgttctgaacaagaaaagggcggaggatatcagcgactacatcctcgccaatcgtcacgactacgttttgccgtccctgtaccgcaagcgttgatacggccatggctttcgaacctatggatgggggaaaacagcttgggaccttgcacatccccatgagcgccatgatgctcattaacgatggccagcaccggcgtttcgctatcgagctggcgctcaaatcagacccatctctacaaaacgagacagccccggttcaaatccattttgaccaagggcttcgtcgatctcagcaaatttttgcagacatcaatagcaaagccgtcaagccatcgtcagcgctga

SEQ ID NO: 560156 - DNA, 586 bp, Homo sapiens
  misc_feature (2)..(2): n is a, c, g, or t
  misc_feature (31)..(31): n is a, c, g, or t
  misc_feature (44)..(44): n is a, c, g, or t
cntaaaaaaattctgggggcgataggtgtcntgaaaaaatgaanccgctgggtgagagtgacaagagagagatgtgattctagaaaatgcactcaaggaagcccctttgacatagttgtcatcttcactgttagaccctaatcaatactcttaatcaatagaagaagcagaagcctgaatccccgaggatggagtagagcagatatccagggaaaaaaacatttggtcagagaggagaacaagagggagcttgctgggggatggccagtgatcaagtgatgtaagtacctccttgctcccccaaatcacgccctctaacaacacaaccgcaatcgtatcttttgtcagcttccagttgtaggaattgcttatgagtgaataggatgagcaggagaaggtgcatggtggagaaattaggtcagcaagacagttgcggtaagattgtggaaagccttgaagtctcgtgcaaagggctgtgaattttattcactctgagatggggagcccctggaacatattcagtgatagcttctggctcatggtttttgttttttttttttaagtttaaatgtttttaatatttact

SEQ ID NO: 560157 - DNA, 240 bp, Homo sapiens
accacctgtatgccggcgctgcagagcacgttgagcgacgagatgtccctatgagcgagcgagcgcccgtcagtgatgaccagggcgatgcggttgatcggtctgggcggcagcagttggtcctgcgtgcactgcagagcctcccccgagatggtgccgcacgccatccactgcaggctcttgatggcttccttgagctcatgcacgttacggatgctggctctgcgcaagatcacgtgc

SEQ ID NO: 560158 - DNA, 426 bp, Homo sapiens
taagatcaagcgagcaggggattggtgccagcaggcgtgatacggagcggacagttgcagagagtgtgctgtgggaaaaactacaaggaaagacagggcggaaagacgattgcagatctcagaaagcagcagagggaaacaagcttttactgcgtccagactcaggcttcaacataataggatacaatatgactttcccccatatcataccaatggcgaaactgaggctgagtgagattcaatggcttgtgcaagggtcaggtctgtagagcccagtctcttacccctaaaccacaaatctctgataaagaataaagcagtagaggaggacagggcgtgatcaaaatcagtgggacagttaacggatgtgcataggacaaggagtagccacactacctgatttccaggaaagcaagggccaaggcc

SEQ ID NO: 560159 - DNA, 263 bp, Homo sapiens
accaaggccgctgatcgctggcatgtgccggatccgaacaatgcgcaggatctggagaagaagcgcgaaaaggcactgctgaatgatttcgagcagtaccagcaacacagcggccgtgagctcaatggagttccgactggtaggtgctgttagacagcttcaaggacgcttggagcaggaaggactaccagaccatcatcaaggtcgcccagaagatcccggacgaggcgctgcaggaagacgagaagctgctgctctggtat

SEQ ID NO: 560160 - DNA, 262 bp, Homo sapiens
ctattttccctgcttttcttttttaaaggggtctgttttgcagtggagaaaacattttggtgaccagacttttgcttaccttttcctattttggtgccaatttttgttttccccccattttaaagccataaacctgaagatgagtaaaactggtgggtttttaataaaacaacaacaaaaacagcagtttgtgataaaacaaaggtttaaatggaccctccccttttatgcccttcaaataattaaatttttttaagaatga

SEQ ID NO: 560161 - DNA, 141 bp, Homo sapiens
ttagaggatgcttggcgcatttttttgggtgcactatctcatgcaggtcccatcagtcaaagcttggataaagcaatcaaaaaaaaggccaagaatgagagaacaagagaggcaagcttcagggggtgggagatgatgttt

SEQ ID NO: 560162 - DNA, 311 bp, Homo sapiens
gcttcttgaagcggtgctggggtgagttgtcgttgtccttggtcaggccctgttcctcctggggctcgcggggcagctgcacgttctgccgcctcgagagcgtgatgcggatcgtcttcccgtgcagcttgtgcccgttcaggtgtctcatgtccagctgggcctggttgccgtccgccatctgcactagggcgttctccttcttattgaacaggatcttcacgcgctgcacgtcaccgtagacgccgaaaagaataaagaggctttggggtgtgactctctttgggttgaggttgctgaccagcaataca

SEQ ID NO: 560163 - DNA, 136 bp, Homo sapiens
tgggccggggaataaaataactttatttcatggtggggagcgggccgatgtccagcctcaaaacttcgggaacggcttctgggtgccggcagcctgtggtgcccttgaagcacgttgaacgcgcagagagaaatgg

SEQ ID NO: 560164 - DNA, 376 bp, Homo sapiens
tgtgggagatgggtctcaaggggccagcaggactttgcagagactggacaagcagaggaccagtttccatgtcagggggcagatgctctgatggggcggggctgatgtttctacagggtgaacatagagaggcaccgtgtctccggagggggtgagtggaggcagctagtgaaatgtcttcatagacagtgaagagctatggcaggcaaggtgggggtaggggggtgggcgagggtggacaacaaaaaaacatgatctcagtcttctcaagagaaagagagaaccgtgagaatctgggcttactggcaacaatttgcaattgatttcacatatggctagcagattcgaggggtaaagggcttgggcaccaggtggc

SEQ ID NO: 560165 - DNA, 363 bp, Homo sapiens
ggatcccctcattacatcgtatgcttctagtcctcagctcaaggagttacatcttttcatggaaccaaatacttatcctgcgtccctagtaccctcttggatgaccatttacggttaggtatcctctcctggattctccattaattccttatgcatatctcctatagagtgtaatgcttacactgtatcacaagtttgtgtttgtatttctatcatttgtcctagactaggaagccctctggagggcaagaagaaatcttgttagatttattaaatctagtacctagcacagtgcttggcacataaggtgagtttcctagatatatgctgatttaaagaataatagagagacagtgtgttcgt

SEQ ID NO: 560166 - DNA, 1249 bp, Homo sapiens
  misc_feature (278)..(278): n is a, c, g, or t
  misc_feature (315)..(315): n is a, c, g, or t
  misc_feature (424)..(424): n is a, c, g, or t
  misc_feature (507)..(507): n is a, c, g, or t
  misc_feature (510)..(510): n is a, c, g, or t
  misc_feature (606)..(606): n is a, c, g, or t
  misc_feature (636)..(636): n is a, c, g, or t
aagaacgctacttcccctatcatagaagagcttatcaccttttcatgattcacgccctgtcagtaatctcagtttatcccttagtctgcttgtccctagatccatgctcatgctccattttcctaaccactctacgatagctaagaactagagcttagattaactagacattcgtcacgaacgcgttcagcgacattatgatacccctgttctcgaggctagtctcctgccacaggcactagtcaagtctcttcagtgtcgctcgagtcagacacacntccgccaatccgcctacggctattctcgttttgtacnactatacaacgtagcagtagagttctagacgggattcccatcgcacgtgttacccagtcaaacattcaaagtgttggtcgctagccaaattgggtacttgagaacacgntacgggagctacgacaccggaccgtactgcgctcggacggtaatgcgtttgcgacacatcacttcactcataactttccgcanccnatgtatgtgccctatgagacctcaggctgtatcgtgtgctagcttcgcttgagctgcttgactaattccgaggtcatgtactcccggacttggaangcgctcgctcaatggcggtattaactaganttagcgatccacagagagaccgctctttgcacgtcatttgacgcatggtccctcagatttagggcttaaggacaccaggaatgcaagttcccgtgacgtactgaaagccagagagccactttgcaccgtctacaacgaccgggggtatactacggtcacatgctctgaaagtctgtggacgcaaaaccacagtttcatgcccatcgtcctagaattaattcccctagggaatctttgaaatagggccgtatttacccttatagaaaccgcgtctaacccctctagagcaaaaaagacaagccacatggccagcgacgaaaacaaacaaagggggggggggacactaagaaactagccgagggggggccaaaggaacagcaaaaaccgaggttgctggcaccagagggggccccactaggcgcacggcgcacataataaaagcaccgacgcgcggcccaggacaaacacgcggagacagcgggacacgccccgcagcagccctggggaaagacccatccgcggcggcgagaccagggcaccatcccgagagagcgcacgggagaccaagcacccgacacagaccacacccatgtccgagcatcgcgagattaag

SEQ ID NO: 560167 - DNA, 284 bp, Homo sapiens
cgcttaactcagccaacatttatgaagcgtctgctggtgcaggcctgttctaggcgccggggacaggccttgcgcggaacctgaaggaggggaggagcagctgtgggaaagggcgttccaggcagagggaacagccagtgcagagcgcctgaggccagctcagcttgagagatcaactgtgcccccctgggagccacaggactttggtcccttaaacagcaggagttcaaggccaggcccggggaagtttgcaatatcggtctcacggaatcccggggggccga

SEQ ID NO: 560168 - DNA, 282 bp, Homo sapiens
ccaggcacagttttagcactttgtgatttcttaattcttacaaccattctgtgaggtgggtactattatgagttcattttatagatgaggaacaaaggcaccagaggggacattatttacttcatgtctggaagctcataagtggcagagtcaactttcccatgcaatccaattcaagaattcaccttgtcaaccactagagattctgcctcttgtgcatattatataatttatggataacattataaaatgaataaaatatgaaatgtatgatatcctttt

SEQ ID NO: 560169 - DNA, 833 bp, Homo sapiens
  misc_feature (48)..(48): n is a, c, g, or t
  misc_feature (76)..(77): n is a, c, g, or t
  misc_feature (107)..(107): n is a, c, g, or t
  misc_feature (115)..(115): n is a, c, g, or t
  misc_feature (163)..(163): n is a, c, g, or t
  misc_feature (185)..(185): n is a, c, g, or t
  misc_feature (189)..(189): n is a, c, g, or t
  misc_feature (218)..(218): n is a, c, g, or t
  misc_feature (233)..(233): n is a, c, g, or t
  misc_feature (248)..(248): n is a, c, g, or t
  misc_feature (253)..(253): n is a, c, g, or t
  misc_feature (262)..(262): n is a, c, g, or t
  misc_feature (266)..(266): n is a, c, g, or t
  misc_feature (275)..(275): n is a, c, g, or t
  misc_feature (278)..(278): n is a, c, g, or t
  misc_feature (284)..(284): n is a, c, g, or t
  misc_feature (294)..(294): n is a, c, g, or t
  misc_feature (336)..(336): n is a, c, g, or t
  misc_feature (349)..(349): n is a, c, g, or t
  misc_feature (361)..(361): n is a, c, g, or t
  misc_feature (383)..(383): n is a, c, g, or t
  misc_feature (386)..(386): n is a, c, g, or t
  misc_feature (414)..(414): n is a, c, g, or t
  misc_feature (456)..(456): n is a, c, g, or t
  misc_feature (534)..(534): n is a, c, g, or t
  misc_feature (536)..(536): n is a, c, g, or t
  misc_feature (538)..(538): n is a, c, g, or t
  misc_feature (541)..(541): n is a, c, g, or t
  misc_feature (563)..(563): n is a, c, g, or t
  misc_feature (604)..(604): n is a, c, g, or t
  misc_feature (606)..(606): n is a, c, g, or t
  misc_feature (618)..(618): n is a, c, g, or t
  misc_feature (654)..(654): n is a, c, g, or t
  misc_feature (759)..(759): n is a, c, g, or t
  misc_feature (769)..(769): n is a, c, g, or t
  misc_feature (815)..(815): n is a, c, g, or t
gttgtttcattaaaacgtactgattttaaaaactaataacttaaaacngccacacgcaaaaaagaaaaacaagagnngtgcacaaaaaattctcctttccttctganggttttangatgcattgttatcattaaccagtcttttactactaatcttaaatggncaattgggacaaacagttctgngacngttcttccaccactgattaagagtggggnggcaggtattagggntaatattcatttggnctttnggggtttcngggnggacttggnggncttgcnagctccagcngccttcttgtccactgctttgatgacacccaccgcaactgtntgtctcatatcangaacagcaaagngacccaaaggtggatagtctgngangctctcaacacacatgggcttgccaggnaccatatcaacaatggcagcatcaccagacttcaagaatttnggggcatcttccagctttttaccagaacggcgatcaatcttttccttcagctcagcaaacttgcatgcaatgtgggcngngnggnaatccaatacaggggcatggcnggggcttatttggcctgggtggttcagggtaatcacctggncngtgaagccagcngcttccattggtgggtcatttttgctgtcaccagcnacgttgccacgacgaacatccttgacagacacattcttgacattgaagcccacattgtccccaggaagagcttcactcaaagcttcatggtgcatttcgacagantttacttccnttgtaacgttgactggagcaaaggtgaccaccataccgggtttganaacaccagtctccactcg

SEQ ID NO: 560170 - DNA, 204 bp, Homo sapiens
aatatctcctatgatagagaacatcaagtgtccatgagaaaaaaagatagtcataagaaatatcaggaaatcatgacccactgtgtcattggcattccaacagaatgtgttcttgagaaaatgttttatacaattctatggtaggccagtgcagcactattaaatatttcatgtaacgttctcgcttcctgagttagaactggg

SEQ ID NO: 560171 - DNA, 696 bp, Homo sapiens
  misc_feature (570)..(570): n is a, c, g, or t
  misc_feature (607)..(607): n is a, c, g, or t
  misc_feature (673)..(673): n is a, c, g, or t
  misc_feature (675)..(675): n is a, c, g, or t
  misc_feature (684)..(684): n is a, c, g, or t
aggagtggaattgctgggccatagggaaactatgttaaacttctgacacttctgcagggcgcctggaggccttggacccacagggcctggacctgagggctctgagccgcttccctgtgcatcagtgcacgcatgctcgcagcgccctccacccagggaactttgcttccacagccttccagatccctgctgggcttgtcatgaatcagcccacacgtgagcaatctgagacacacttaaatggcatctagcgtgggtccggctcccaaagggttagctcaggaggagcacggcagcagccctcctgcctgagtggagagacggggcagatgccaggcatgcctttcgtggttatttttattttgcatgggaaaccatgggaacacaacaaggagaaggcatgtcttccacctgctaggggaacagacctgggacagacagggtccttgggagaaggtggagcccgggaagtgacggctaagaatgtgctgggcagaggccaggggtagacccaggacttgggggtgtgcagtcgtccgattcctatgtggggggtgagggggtgctganaggagccagccccgcatggaacagtgtggccttcccngcagttcaacttggacactgtgctcagaggcacctggcaggctcctgtacccccggaagtctccanantaaaaagcnctttgctcccga

SEQ ID NO: 560172 - DNA, 603 bp, Homo sapiens
ctgactgggagcagagctcctatcagtgtcggtccgcacggggccgccctctcccctgcatctggctctgaatctgaatgtgcccttcttatgaggacaccagtcagtatggatccgagcctaccccgagtgacttcatcttaacttgattacatctgcaaagaccctgctgtccaaataaggtcacattctgaagtacggggggattaagattgcaaggtctgatcctgcggggacacactgtcagagtcatagcacccacctgtgagagggtgatgacctcaaggtcacacaaggtctaggtcgaagccaatgtttagtttcatttcctagatgatcctcagtcaagcagaagcacagacttgaatatctggaggaaatttattacatcaaagaatgacagtgccgggctgcttctactgttccttctgcttcagacttctctcccttcctcgacgaaccaatcctgtcctccttgggctctcagctcaagcataccgaccaaggagccctctctgaactcctaagaacaggtcaaaaaacccttaccaggagctctggttaccatctatgtctccctcactggcctttttaacaccctta

SEQ ID NO: 560173 - DNA, 299 bp, Homo sapiens
cttgtacctacagcgcttactgcgttttttatacagttaaccagacaggatctccctccgttgcacaggctggagtgcagtggaagctatctcagctcactgcaacctccgcctcctggactcaagcaatcctcccacctcagcctcccaagtagctgggactgcaggtgcgagccaccacgttcagctaatttttagtattttttgcagacacagggtttcaccatgttgttcaggctggtcttgagttcctgaactcaagccatctgcccgccttggactccagcgtgctgatacaa

SEQ ID NO: 560174 - DNA, 272 bp, Homo sapiens
acatgttcataactaacctgtcacaccctagtcaagacctctccccatgctccaatataactacttccacatctatctaacctcttacacgattcaacaaagctgacaatcttctataaaccatacatcaatcttctggcttctgaaatactacaatgccatttaattcgttttttcatgcatcactggttacagtttcagtatcttttcatggcttctccttctacagacctctaaaaggcaagtgttccttacagtgttatccgtgaggg

SEQ ID NO: 560175 - DNA, 108 bp, Homo sapiens
caggagctgtatgtcatcccccttcgtcacagtgatcttagtctggatagaattatcttcgtgagagcacgcttgttatgtagactgccgctgagagaggaggtcaca

SEQ ID NO: 560176 - DNA, 348 bp, Homo sapiens
tagcgtagacatccgccttcgtgctctctggtcatccctgttcccttgttttaaatttttttcccaaaaatagtcgacctggatgcttgcagtgttgaggactgagcggcggtgtatcacagtggtcacagcgagcaccaaggccaggtggctccagcagctggtcgatgccataggccaggccaccctcaaagggcaagtgtcgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaa

SEQ ID NO: 560177 - DNA, 116 bp, Homo sapiens
agcgcggtaccgtctgagcagctgggaaaaatatgatacccgtgttctgataatttttacaaaacttaaaaactatttttatttatgtatttatgagacagagtcttgctctgttg

SEQ ID NO: 560178 - DNA, 201 bp, Homo sapiens
caccaccaccctatatatagtgatgaacatacgactgtttgtgttcattcctgagttacttcactgagaatcatagtctccaatctcatccaggtttgctgcaaatgctattaattcattcctttttcatggctgagctagtattccatcatatatatcataattgtttcttgccttactcactgatctataggagtggtg

SEQ ID NO: 560179 - DNA, 2401 bp, Homo sapiens
aggggaacaggaaagaaaagctaaacctgcaacaaagtgtcctgtgcccagaacgcggttaggaagtgtgtgcatacgtctgaaccctaaatggttctcagttctgtaaacttctcctcccactgggtggagtagggcctttaagagcagctggaatgcagttcccctgatcagcgtagccagttgttgcctgtctgaacctctgccagtcctggagactggtgccctgagctccaaccagcgggcctcatcctacaccctcaccaccgcaacttctcacccgagcaagaagcagctcccagagagaaagaacgttcccacctgcctagccatgggagaggacgctgcacaggccgaaaagttccagcaccctgggtctgacatgcggcaggaaaagccctcgagccccagcccgatgccttcctccacaccaagccccagcctgaacctagggaacacagaggaggccatccgggacaactcacaggtgaacgcagtcacggtgctcacgctcctggacaagctggtgaacatgctagacgctgtgcaggagaaccagcacaagatggagcagcgacagatcagtttggagggctccgtgaagggcatccagaatgacctcaccaagctctccaagtaccaggcctccaccagcaacacggtgagcaagctgctggagaagtcccgcaaggtcagcgcccacacgcgcgcggtcaaagagcgcatggataggcagtgcgcacaggtgaagcggctggagaacaaccacgcccagctcctccgacgcaaccatttcaaagtgctcatcttccaggaggaaaatgagatccctgccagcgtgtttgtgaaacagcccgtttccggtgccgtggaagggaaggaggagcttccggatgaaaacaaatccctggaggaaaccctgcacaccgtggacctctcctcagatgatgatttgccccacgatgaggaggccctggaagacagtgccgaggaaaaggtggaagaaagtagggcagagaaaataaaaagatccagcctgaagaaagtggatagcctcaagaaagcattttctcgccagaacatcgagaaaaagatgaacaagctggggacaaagatcgtatctgtagagaggagagagaagattaagaaatctctcacgtcaaatcaccagaaaatatcctcaggaaaaagctcccccttcaaggtttctcccctcactttcgggcggaagaaagtccgagagggagaaagccatgcagaaaatgagaccaagtcagaagacctgcctagcagtgagcagatgccaaatgaccaggaagaggagtcctttgcagagggtcattccgaagcgtccctcgccagcgctctggtggaaggggaaattgcagaggaggctgctgagaaggcgacctccagggggagtaactcggggatggacagcaacatcgacttgactattgtggaagatgaagaggaggagtcagtggccctggaacaggcacagaaggtacgctatgagggtagctacgcgctaacatccgaggaggcggagcgctccgatggggaccccgtgcagcccgccgtgctccaggtgcaccagacctcctgagcttagagccaccgtgccatcctgtgctgtgctcaagcgggcagccagggctgaagaacaaactcttgcacatctccagcacgactcacccactcctgcgttcctgtccaggcagtaatcattgaccatatagtcatagtaagacacacgagaccaggctttaccatgaaagcgacctgtcacggactccacttttaatttgctcttaggttctatctctgtagaatgtctccaagattgaagaagaaactgagcagttgaaaaatgctaatctctttgacttagtcagaaaaaaacagaggataattaagatactagtcatgaaaagtgattcattcttttttgtcattccataagcttgctgaatagtgtaccggtaatatattgtatttccaccgtactctgtgaatctaattattattctttaagtgttgatatataatatacataaatatgtaagctaaacatataactatatgttttaagaagaaaacatctacgaaaggtaaaaagagatgatcagttggttgtttacttgctagaaaccattgttttattgcaaacgaaggaaaaatgaagagattataaaagtcagctaatgaagtaagatacgtagtaaagtcaggactattcaaaaagtaagaaagaaaatttggaaaatgagagaaacaggaaacaaagaatgccgaaaagaatgaaaacagagaaaaaatgtatgtgcttgaaagtaaaatacttacaatagtagcttaactatttcactctttaaataaaaatactaaagaagttcgt

SEQ ID NO: 560180 - DNA, 443 bp, Homo sapiens
  misc_feature (18)..(18): n is a, c, g, or t
  misc_feature (27)..(27): n is a, c, g, or t
  misc_feature (62)..(62): n is a, c, g, or t
aaaaaacccaccggggangtcccgggnccctgccttaagtaaaggcaagagaaagttgaacnccttaacaaattaatttggatcccatcccattggcctaatagtttgtaatattgttcccccacccaaatcctcatgttgaactgtaatcccctaatgctggaggtggggccctggtggaaagtgtctggcttattggggcagacctctcatgactttgtgttgtcttcagatggttagttctcatgagatctggtcatttaaaagtgtgtggcgccttctccccgaccttgctcccattctcaccatgtgatgtgcctgccttgccttcgccttccgccatgattggaagcttcctgaggcctccccagaagcagatgccactatgcttcctgtacagcctgcagaaacataagccaattaaacctcttttctttataata

SEQ ID NO: 560181 - DNA, 458 bp, Homo sapiens
tttacagtattaggagatatttatttagtacatacgataggtcatgctctgtctgagccctgggaatacagcatgtaacacagataaggtccttgcctttaaacagcttacatcctctctgaggattgacattttagtcaaatagcgagagccagctatgcaaagatctgttgaaacagtattctgagcaaagaaaacctctggtccaaaggcgcaagactggggattagcctggtgtgctgaaggaactgacagaggtcagtgtgtcaggagcccatgagagttttattggctagtctttgaagtgcattctgctcttccagcagaatatccagttggtcagatatcccatagcaatttcccttgcttcaatcacattggtacttctggaaatatggatatgcaatctccttaactggaatgtaacctcttgaagagcagacttatatttaatttgt

SEQ ID NO: 560182 - DNA, 3570 bp, Homo sapiens
aggggaacaggaaagaaaagctaaacctgcaacaaagtgtcctgtgcccagaacgcggttaggaagtgtgtgcatacgtctgaaccctaaatggttctcagttctgtaaacttctcctcccactgggtggagtagggcctttaagagcagctggaatgcagttcccctgatcagcgtagccagttgttgcctgtctgaacctctgccagtcctggagactggtgccctgagctccaaccagcgggcctcatcctacaccctcaccaccgcaacttctcacccgagcaagaagcagctcccagagagaaagaacgttcccacctgcctagccatgggagaggacgctgcacaggccgaaaagttccagcaccctgggtctgacatgcggcaggaaaagccctcgagccccagcccgatgccttcctccacaccaagccccagcctgaacctagggaacacagaggaggccatccgggacaactcacaggtgaacgcagtcacggtgctcacgctcctggacaagctggtgaacatgctagacgctgtgcaggagaaccagcacaagatggagcagcgacagatcagtttggagggctccgtgaagggcatccagaatgacctcaccaagctctccaagtaccaggcctccaccagcaacacggtgagcaagctgctggagaagtcccgcaaggtcagcgcccacacgcgcgcggtcaaagagcgcatggataggcagtgcgcacaggtgaagcggctggagaacaaccacgcccagctcctccgacgcaaccatttcaaagtgctcatcttccaggaggaaaatgagatccctgccagcgtgtttgtgaaacagcccgtttccggtgccgtggaagggaaggaggagcttccggatgaaaacaaatccctggaggaaaccctgcacaccgtggacctctcctcagatgatgatttgccccacgatgaggaggccctggaagacagtgccgaggaaaaggtggaagaaagtagggcagagaaaataaaaagatccagcctgaagaaagtggatagcctcaagaaagcattttctcgccagaacatcgagaaaaagatgaacaagctggggacaaagatcgtatctgtagagaggagagagaagattaagaaatctctcacgtcaaatcaccagaaaatatcctcaggaaaaagctcccccttcaaggtttctcccctcactttcgggcggaagaaagtccgagagggagaaagccatgcagaaaatgagaccaagtcagaagacctgcctagcagtgagcagatgccaaatgaccaggaagaggagtcctttgcagagggtcattccgaagcgtccctcgccagcgctctggtggaaggggaaattgcagaggaggctgctgagaaggcgacctccagggggagtaactcggggatggacagcaacatcgacttgactattgtggaagatgaagaggaggagtcagtggccctggaacaggcacagaaggtacgctatgagggtagctacgcgctaacatccgaggaggcggagcgctccgatggggaccccgtgcagcccgccgtgctccaggtgcaccagacctcctgagcttagagccaccgtgccatcctgtgctgtgctcaagcgggcagccagggctgaagaacaaactcttgcacatctccagcacgactcacccactcctgcgttcctgtccaggcagtaatcattgaccatatagtcatagtaagacacacgagaccaggctttaccatgaaagcgacctgtcacggactccacttttaatttgctcttaggttctatctctgtagaatgtctccaagattgaagaagaaactgagcagttgaaaaatgctaatctctttgacttagtcagaaaaaaacagaggataattaagatactagtcatgaaaagtgattcattcttttttgtcattccataagcttgctgaatagtgtaccggtaatatattgtatttccaccgtactctgtgaatctaattattattctttaagtgttgatatataatatacataaatatgtaagctaaacatataactatatgttttaagaagaaaacatctacgaaaggtaaaaagagatgatcagttggttgtttacttgctagaaaccattgttttattgcaaacgaaggaaaaatgaagagattataaaagtcagctaatgaagtaagatacgtagtaaagtcaggactattcaaaaagtaagaaagaaaatttggaaaatgagagaaacaggaaacaaagaatgccgaaaagaatgaaaacagagaaaaaatgtatgtgcttgaaagtaaaatacttacaatagtagcttaactatttcactctttaaataaaaatactaaagaagttcgtatatcctggaataacatgtcatcttcaaaatatttttattttctaatatttttaataataaacattttatagtgttaaagctgtatttttcttaataaataaaggacattacaaatatttctttaaggaagttcaaaaggatgttgtcttgttaacattggaacgaatataaatcttcaaaatacaattaatatatactgttttgtggaaacttagcctcatactattctttaatgctcttcaaatttaaactaacccttacattccatgtgatgtgatgtaggcttataagatgctaaaatctataggttttggaagtgaaagattctattttttctttttttgtacataatgggaatttcattccagattatattttatttacatattaatttcacagaatattaatatttcttaacttcttaaagcatgctagcgttttatgtatatgtacacatatattcagacagggtaattttatctgctgcctaacattgtactaaaatattgctttatctgtttttaattacaaaatgctaatgatttcttaaattatagtttaaagacaattggcccaggaagcaaatcccctgcctttagtatgaaccactataagtaaccttacaaatagagttaatccaagacaatattaacaaactgtgctttgtctttaataaaagggataggattaacaaacatattgatggcataacctattcagctatgtccttatttttgcaataatgtaacctcaaatattggattgttgaaccaacaatggctgtgttaaagaagattaaataaaccgaaaaataaaaagcatgaaaaaaaaaaaaaaaaaaataaaaaaaaaaaaaaaaaaaaaaaagaggggggaaaaaaaaaagaagaaaaaaaaaattaaagaggctgagccagcgtgagtcaacaaaaccaaagcgggccgcccgccacaaccaaccacggagcgacaccatacattaactcgaagaccaacacaccaggtgaaaaagagagaccgacaagacagccggcccgcaacacaagcttatcacaccacctacaggagcaggcgagatgacactaccacgagcgaaccagaagcaaaacaccagcccaatcgccaggcgggacagagtaaggaaagaccagcggaagcgcaaaacccc

SEQ ID NO: 560183 - DNA, 3553 bp, Homo sapiens
tttacagtattaggagatatttatttagtacatacgataggtcatgctctgtctgagccctgggaatacagcatgtaacacagataaggtccttgcctttaaacagcttacatcctctctgaggattgacattttagtcaaatagcgagagccagctatgcaaagatctgttgaaacagtattctgagcaaagaaaacctctggtccaaaggcgcaagactggggattagcctggtgtgctgaaggaactgacagaggtcagtgtgtcaggagcccccatccataccccctccagtgaaaagcaggatagggcaactccttcaggatgatggaaaatgcctcagactggctggctgtgtcactgtccttgacttctcctcacaactagtatgacaggttgatgtggccgagcgtcagaaaatcgagagaacagttagcagtgcttccaggtctccagagccacaatgcaggtgaacgcagtcacggtgctcacgctcctggacaagctggtgaacatgctagacgctgtgcaggagaaccagcacaagatggagcagcgacagatcagtttggagggctccgtgaagggcatccagaatgacctcaccaagctctccaagtaccaggcctccaccagcaacacggtgagcaagctgctggagaagtcccgcaaggtcagcgcccacacgcgcgcggtcaaagagcgcatggataggcagtgcgcacaggtgaagcggctggagaacaaccacgcccagctcctccgacgcaaccatttcaaagtgctcatcttccaggaggaaaatgagatccctgccagcgtgtttgtgaaacagcccgtttccggtgccgtggaagggaaggaggagcttccggatgaaaacaaatccctggaggaaaccctgcacaccgtggacctctcctcagatgatgatttgccccacgatgaggaggccctggaagacagtgccgaggaaaaggtggaagaaagtagggcagagaaaataaaaagatccagcctgaagaaagtggatagcctcaagaaagcattttctcgccagaacatcgagaaaaagatgaacaagctggggacaaagatcgtatctgtagagaggagagagaagattaagaaatctctcacgtcaaatcaccagaaaatatcctcaggaaaaagctcccccttcaaggtttctcccctcactttcgggcggaagaaagtccgagagggagaaagccatgcagaaaatgagaccaagtcagaagacctgcctagcagtgagcagatgccaaatgaccaggaagaggagtcctttgcagagggtcattccgaagcgtccctcgccagcgctctggtggaaggggaaattgcagaggaggctgctgagaaggcgacctccagggggagtaactcggggatggacagcaacatcgacttgactattgtggaagatgaagaggaggagtcagtggccctggaacaggcacagaaggtacgctatgagggtagctacgcgctaacatccgaggaggcggagcgctccgatggggaccccgtgcagcccgccgtgctccaggtgcaccagacctcctgagcttagagccaccgtgccatcctgtgctgtgctcaagcgggcagccagggctgaagaacaaactcttgcacatctccagcacgactcacccactcctgcgttcctgtccaggcagtaatcattgaccatatagtcatagtaagacacacgagaccaggctttaccatgaaagcgacctgtcacggactccacttttaatttgctcttaggttctatctctgtagaatgtctccaagattgaagaagaaactgagcagttgaaaaatgctaatctctttgacttagtcagaaaaaaacagaggataattaagatactagtcatgaaaagtgattcattcttttttgtcattccataagcttgctgaatagtgtaccggtaatatattgtatttccaccgtactctgtgaatctaattattattctttaagtgttgatatataatatacataaatatgtaagctaaacatataactatatgttttaagaagaaaacatctacgaaaggtaaaaagagatgatcagttggttgtttacttgctagaaaccattgttttattgcaaacgaaggaaaaatgaagagattataaaagtcagctaatgaagtaagatacgtagtaaagtcaggactattcaaaaagtaagaaagaaaatttggaaaatgagagaaacaggaaacaaagaatgccgaaaagaatgaaaacagagaaaaaatgtatgtgcttgaaagtaaaatacttacaatagtagcttaactatttcactctttaaataaaaatactaaagaagttcgtatatcctggaataacatgtcatcttcaaaatatttttattttctaatatttttaataataaacattttatagtgttaaagctgtatttttcttaataaataaaggacattacaaatatttctttaaggaagttcaaaaggatgttgtcttgttaacattggaacgaatataaatcttcaaaatacaattaatatatactgttttgtggaaacttagcctcatactattctttaatgctcttcaaatttaaactaacccttacattccatgtgatgtgatgtaggcttataagatgctaaaatctataggttttggaagtgaaagattctattttttctttttttgtacataatgggaatttcattccagattatattttatttacatattaatttcacagaatattaatatttcttaacttcttaaagcatgctagcgttttatgtatatgtacacatatattcagacagggtaattttatctgctgcctaacattgtactaaaatattgctttatctgtttttaattacaaaatgctaatgatttcttaaattatagtttaaagacaattggcccaggaagcaaatcccctgcctttagtatgaaccactataagtaaccttacaaatagagttaatccaagacaatattaacaaactgtgctttgtctttaataaaagggataggattaacaaacatattgatggcataacctattcagctatgtccttatttttgcaataatgtaacctcaaatattggattgttgaaccaacaatggctgtgttaaagaagattaaataaaccgaaaaataaaaagcatgaaaaaaaaaaaaaaaaaaataaaaaaaaaaaaaaaaaaaaaaaagaggggggaaaaaaaaaagaagaaaaaaaaaattaaagaggctgagccagcgtgagtcaacaaaaccaaagcgggccgcccgccacaaccaaccacggagcgacaccatacattaactcgaagaccaacacaccaggtgaaaaagagagaccgacaagacagccggcccgcaacacaagcttatcacaccacctacaggagcaggcgagatgacactaccacgagcgaaccagaagcaaaacaccagcccaatcgccaggcgggacagagtaaggaaagaccagcggaagcgcaaaacccc

SEQ ID NO: 560184 - DNA, 325 bp, Homo sapiens
accgattatcatcagcgccagcatcaccggggaccttagaaatgcaagttctcaggccccaccccagaccaaccgaatcagaaacggtgaatgaggcccagcaatctgtgctttaacaaaccttcaggtgactctgatgcatggacagtggttctcagccagtagcaatttggtcacttaggggacatttggaaatgtctgaagacattttgggttataaaggaagtgctaatggtatctagaaggcagaagccagggacgctgttaaataccctacagcgcacaggacagccccctctccacagggtaccgaagctcgacattc

SEQ ID NO: 560185 - DNA, 3385 bp, Homo sapiens
aggggaacaggaaagaaaagctaaacctgcaacaaagtgtcctgtgcccagaacgcggttaggaagtgtgtgcatacgtctgaaccctaaatggttctcagttctgtaaacttctcctcccactgggtggagtagggcctttaagagcagctggaatgcagttcccctgatcagcgtagccagttgttgcctgtctgaacctctgccagtcctggagactggtgccctgagctccaaccagcgggcctcatcctacaccctcaccaccgcaacttctcacccgagcaagaagcagctcccagagagaaagaacgttcccacctgcctagccatgggagaggacgctgcacaggccgaaaagttccagcaccctgggtctgacatgcggcaggaaaagccctcgagccccagcccgatgccttcctccacaccaagccaccaagctctccaagtaccaggcctccaccagcaacacggtgagcaagctgctggagaagtcccgcaaggtcagcgcccacacgcgcgcggtcaaagagcgcatggataggcagtgcgcacaggtgaagcggctggagaacaaccacgcccagctcctccgacgcaaccatttcaaagtgctcatcttccaggaggaaaatgagatccctgccagcgtgtttgtgaaacagcccgtttccggtgccgtggaagggaaggaggagcttccggatgaaaacaaatccctggaggaaaccctgcacaccgtggacctctcctcagatgatgatttgccccacgatgaggaggccctggaagacagtgccgaggaaaaggtggaagaaagtagggcagagaaaataaaaagatccagcctgaagaaagtggatagcctcaagaaagcattttctcgccagaacatcgagaaaaagatgaacaagctggggacaaagatcgtatctgtagagaggagagagaagattaagaaatctctcacgtcaaatcaccagaaaatatcctcaggaaaaagctcccccttcaaggtttctcccctcactttcgggcggaagaaagtccgagagggagaaagccatgcagaaaatgagaccaagtcagaagacctgcctagcagtgagcagatgccaaatgaccaggaagaggagtcctttgcagagggtcattccgaagcgtccctcgccagcgctctggtggaaggggaaattgcagaggaggctgctgagaaggcgacctccagggggagtaactcggggatggacagcaacatcgacttgactattgtggaagatgaagaggaggagtcagtggccctggaacaggcacagaaggtacgctatgagggtagctacgcgctaacatccgaggaggcggagcgctccgatggggaccccgtgcagcccgccgtgctccaggtgcaccagacctcctgagcttagagccaccgtgccatcctgtgctgtgctcaagcgggcagccagggctgaagaacaaactcttgcacatctccagcacgactcacccactcctgcgttcctgtccaggcagtaatcattgaccatatagtcatagtaagacacacgagaccaggctttaccatgaaagcgacctgtcacggactccacttttaatttgctcttaggttctatctctgtagaatgtctccaagattgaagaagaaactgagcagttgaaaaatgctaatctctttgacttagtcagaaaaaaacagaggataattaagatactagtcatgaaaagtgattcattcttttttgtcattccataagcttgctgaatagtgtaccggtaatatattgtatttccaccgtactctgtgaatctaattattattctttaagtgttgatatataatatacataaatatgtaagctaaacatataactatatgttttaagaagaaaacatctacgaaaggtaaaaagagatgatcagttggttgtttacttgctagaaaccattgttttattgcaaacgaaggaaaaatgaagagattataaaagtcagctaatgaagtaagatacgtagtaaagtcaggactattcaaaaagtaagaaagaaaatttggaaaatgagagaaacaggaaacaaagaatgccgaaaagaatgaaaacagagaaaaaatgtatgtgcttgaaagtaaaatacttacaatagtagcttaactatttcactctttaaataaaaatactaaagaagttcgtatatcctggaataacatgtcatcttcaaaatatttttattttctaatatttttaataataaacattttatagtgttaaagctgtatttttcttaataaataaaggacattacaaatatttctttaaggaagttcaaaaggatgttgtcttgttaacattggaacgaatataaatcttcaaaatacaattaatatatactgttttgtggaaacttagcctcatactattctttaatgctcttcaaatttaaactaacccttacattccatgtgatgtgatgtaggcttataagatgctaaaatctataggttttggaagtgaaagattctattttttctttttttgtacataatgggaatttcattccagattatattttatttacatattaatttcacagaatattaatatttcttaacttcttaaagcatgctagcgttttatgtatatgtacacatatattcagacagggtaattttatctgctgcctaacattgtactaaaatattgctttatctgtttttaattacaaaatgctaatgatttcttaaattatagtttaaagacaattggcccaggaagcaaatcccctgcctttagtatgaaccactataagtaaccttacaaatagagttaatccaagacaatattaacaaactgtgctttgtctttaataaaagggataggattaacaaacatattgatggcataacctattcagctatgtccttatttttgcaataatgtaacctcaaatattggattgttgaaccaacaatggctgtgttaaagaagattaaataaaccgaaaaataaaaagcatgaaaaaaaaaaaaaaaaaaataaaaaaaaaaaaaaaaaaaaaaaagaggggggaaaaaaaaaagaagaaaaaaaaaattaaagaggctgagccagcgtgagtcaacaaaaccaaagcgggccgcccgccacaaccaaccacggagcgacaccatacattaactcgaagaccaacacaccaggtgaaaaagagagaccgacaagacagccggcccgcaacacaagcttatcacaccacctacaggagcaggcgagatgacactaccacgagcgaaccagaagcaaaacaccagcccaatcgccaggcgggacagagtaaggaaagaccagcggaagcgcaaaacccc

SEQ ID NO: 560186 - DNA, 322 bp, Homo sapiens
ggtcgaccgacagagagagactccctctctgtcgcccaggctggagtgcagtggcaaatctcagctcactgcaacctctgcctcctgggttcaagcgattctcatgcctcaacctccgagtagctaggagtaaatgtatgtgccaccatgcccagctaatttttgtatccctaacgaagacagggtttcaccatgttggccagggtggtctcgaacttctggcctcaagcgatccgcccgcctcagcctcccaaagtgctgggattacaggcgtaacgactgcgacacgtggtttatcgctttctctgtgctcttccctctg

SEQ ID NO: 560187 - DNA, 1095 bp, Homo sapiens
  misc_feature (1032)..(1032): n is a, c, g, or t
  misc_feature (1051)..(1051): n is a, c, g, or t
  misc_feature (1053)..(1053): n is a, c, g, or t
  misc_feature (1056)..(1056): n is a, c, g, or t
  misc_feature (1062)..(1062): n is a, c, g, or t
aggggaacaggaaagaaaagctaaacctgcaacaaagtgtcctgtgcccagaacgcggttaggaagtgtgtgcatacgtctgaaccctaaatggttctcagttctgtaaacttctcctcccactgggtggagtagggcctttaagagcagctggaatgcagttcccctgatcagcgtagccagttgttgcctgtctgaacctctgccagtcctggagactggtgccctgagctccaaccagcgggcctcatcctacaccctcaccaccgcaacttctcacccgagcaagaagcagctcccagagagaaagaacgttcccacctgcctagccatgggagaggacgctgcacaggccgaaaagttccagcaccctgggtctgacatgcggcaggaaaagccctcgagccccagcccgatgccttcctccacaccaagccccagcctgaacctagggaacacagaggaggccatccgggacaactcacaggtgaacgcagtcacggtgctcacgctcctggacaagctggtgaacatgctagacgctgtgcaggagaaccagcacaagatggagcagcgacagatcagtttggagggctccgtgaagggcatccagaatgacctcaccaagctctccaagtaccaggcctccaccagcaacacggtgagcaagctgctggagaagtcccgcaaggtcagcgcccacacgcgcgcggtcaaagagcgcatggataggcagtgcgcacaggtgaagcggctggagaacaaccacgcccagctcctccgacgcaaccatttcaaagtgctcatcttccaggaggaaaatgagatccctgccagcgtgtttgtgaaacagcccgtttccggtgccgtggaagggaaggaggagcttccggatgaaaacaaatccctggaggaaaccctgcacaccgtggacctctcctcagatgatgatttgccccacgatgaggaggccctggaagacagtgccgaggaaaaggtggaagaaagtagggcagagaaaattaaaaaagntcccagcctttaaggaaantnggntaggcnttcaaggaagcttttttttttggcccagaacct

SEQ ID NO: 560188 - DNA, 917 bp, Homo sapiens
  misc_feature (165)..(165): n is a, c, g, or t
  misc_feature (199)..(199): n is a, c, g, or t
  misc_feature (201)..(201): n is a, c, g, or t
  misc_feature (225)..(225): n is a, c, g, or t
  misc_feature (248)..(248): n is a, c, g, or t
  misc_feature (260)..(260): n is a, c, g, or t
  misc_feature (274)..(275): n is a, c, g, or t
  misc_feature (297)..(297): n is a, c, g, or t
  misc_feature (305)..(305): n is a, c, g, or t
  misc_feature (312)..(312): n is a, c, g, or t
  misc_feature (325)..(325): n is a, c, g, or t
  misc_feature (341)..(341): n is a, c, g, or t
agtcagagcccgcctttaggagttaaatataatagaaaaaccaaaatgatatttttattttaggagggtttaaatagggttcagagatcataggaatattaggagttacctctctgtggaggtatgacttgtaatctcattttcctttcaaaaaaaaaaaaaaangctaagggggctggtggggatgtaaacatgtttncngatgcagaagggttaagggtaggnacagccttcctgacccaggggcntgaaaaccattnacagggattaatannttctcctacttccacaatggtngccaaaangtctggnatcccagcatttnggtttggcaggagaantggatgccatccctaagagctgggactcactggtgtctcttcatcacaagggagaagggagtccaaactttaatcactccattggtatggctcccggagataaaacagtaaaaaatccgcaagccatagttcactttaaacacaatttcaagctcactttggaagtacggggggccgggaatgctaggtgagcatgaagataaaccctgtgctactatgtagcaaccccaatgggaccttttgggagaaataggtctgagtcgggatctggggggacatcaataagagcccttcacataaaatttttgaatccaggagacgtgtcacgaggtgcaaaaaagttctcagattgggagaggtcccctcaacaattctggcggccttacttggaatttggacccctgcacgtgccattcagggatattcattccggaccgcaacaagggaagggatggtcccagacaacttcgggtaaaaaaacgacgaggacctggttgatgagaagggaggaacacaatgagaaacacacagacaaacgaaggacaaaaaaaaccaaagatgagacacacaacaaaa

SEQ ID NO: 560189 - DNA, 690 bp, Homo sapiens
  misc_feature (8)..(8): n is a, c, g, or t
  misc_feature (136)..(136): n is a, c, g, or t
  misc_feature (211)..(211): n is a, c, g, or t
  misc_feature (267)..(267): n is a, c, g, or t
  misc_feature (276)..(276): n is a, c, g, or t
  misc_feature (279)..(279): n is a, c, g, or t
  misc_feature (285)..(285): n is a, c, g, or t
  misc_feature (324)..(324): n is a, c, g, or t
  misc_feature (336)..(336): n is a, c, g, or t
  misc_feature (338)..(339): n is a, c, g, or t
  misc_feature (341)..(342): n is a, c, g, or t
  misc_feature (351)..(351): n is a, c, g, or t
  misc_feature (354)..(354): n is a, c, g, or t
  misc_feature (366)..(366): n is a, c, g, or t
  misc_feature (373)..(373): n is a, c, g, or t
  misc_feature (379)..(379): n is a, c, g, or t
  misc_feature (383)..(383): n is a, c, g, or t
  misc_feature (454)..(454): n is a, c, g, or t
  misc_feature (499)..(500): n is a, c, g, or t
  misc_feature (502)..(502): n is a, c, g, or t
  misc_feature (530)..(530): n is a, c, g, or t
  misc_feature (533)..(533): n is a, c, g, or t
  misc_feature (566)..(566): n is a, c, g, or t
  misc_feature (593)..(593): n is a, c, g, or t
  misc_feature (595)..(595): n is a, c, g, or t
  misc_feature (597)..(597): n is a, c, g, or t
  misc_feature (603)..(603): n is a, c, g, or t
  misc_feature (615)..(615): n is a, c, g, or t
  misc_feature (627)..(627): n is a, c, g, or t
  misc_feature (676)..(676): n is a, c, g, or t
gatttggncacacatgatagcttggttaaatacttaacagggcaatcacagggaagatgactagatttcctaacatccatgagtgaaatttatagaagtatactctctgacttgatataaaggaagattttaaaanacatgactgttcaggagtgttcaagtagggtcagatgaccagtgattggcaatacttcgtaagccggagcaagtnagatctgagccactgttctatcggtagggtgtctgtggtattccttggtcaaagangtactctangcnacttcngtctcacgaattactatcaccctcgtgggcatacatganggttaccctagngnngnngtttcgggnggnggttattttggntcctggngtagtnaganaggggccttcatgcagatacccttttcagttctccatacacccatatcacaagtggtcacaaaaacacccngtaacctttacttggctttacccacattaacaatatgctcaatannancagtttgactcccaagcctaggtcaggnctnagtgtttctcatgagccatagtcttaggctgangagccttgagagttggtggagggaganancncctgcncgcagggggctntgatcacagaantctgtagaaagagtgggatctaaagagtcctggggaggcaggcctaaangtccaggcctggca

SEQ ID NO: 560190 - DNA, 82 bp, Homo sapiens
  misc_feature (73)..(73): n is a, c, g, or t
tattgcttatttagatacaggaaagtgcagcacagagtacttacctgactttttcaagacccgtaagtaccanaatagtata

SEQ ID NO: 560191 - DNA, 1077 bp, Homo sapiens
gaagggcccgtcccgccttccccggtgcgccatgtgagccccagtgtgcggtttgcagaagcctgtgtgcagacgggtgcaggacggatgtgattatggaagctctgcggtcatacaaccaggagcactcccagagcttcacgtttgatgatgcccatagcgaggaggacctggaagagacatggcggatgctgctggatctccgtcctggaacagggcttgcctagcctctcctagcgtgatcatctggctgcgagatgttgtaccagaaatacctgtactcgcggggaccctgatagaatgacgctggcatcgccagttgcatccaagctcgcgctaagatgcctaggcaggggcgactaggctctggcttatgacttggagcgaatcttctgttctacctcgaaagtgcgtgccagatccccgaggatggtcctgccaagcaacgaatggggagtgtctcgtaacgtggggaaggtcgccgtacgacacgatgggcccttgtagactagagccctccgtgtcggtcaagcaaggccccattgtgttgcgttaccaagacttgcgtggggaccaggcaaggatgcgaccacgccccgtagtagggctgcacagcgctccaccaggatgcccgatgttgcgggggacatggctacccggtatgaagggacggagggccttcgccctcaacggagtgttcccatgctatggtgtcggacctttgccggggctcccatgcattccatggcttacaccgggtgacttcgcggacaacctacagtgttgccggccaaggcagcgcctgatattgaaggggacgccctgggaaatggggaggtgggcgggccactttgcatagaacgttgaccctctgacaatggggagcctgtgatcgcctggctaggagtgaacttccgtgagacgggggaaacccccccgagcccacgtgcatacctgttttgcttacccccaaggaagacaccggacggcggtgtccctgatggtgtgggaattccctcgagaagctgcgccccgtttaacaccaattccacccccgtgtgatttctccatcaccag

SEQ ID NO: 560192 - DNA, 315 bp, Homo sapiens
gtgaagcgggacaagagagtaaggagggaggtgcgacacactcgtaaacaacccgatcttgcaagaactcactcactattgcaaggacaggaccaaaaggatgatgcaaaatcattcatgagaaattcaccccccatgattcaatctctttccaccagggcccacctctaacacttggggacagcttttatcttggctttttcacttgcaggcccttccttaaggacttaacttgtgtaagctgactcttaggagatctaagagtgcaattaactctataagatactttgggggggagcaatattcacagattcc

SEQ ID NO: 560193 - DNA, 294 bp, Homo sapiens
aacttcagcctgggacaggcagagattccgtctcaacaaaagacaaaatacagtggaaccagcatgggcaacatagtgagaccctgtctccacaaaaaaaaaatagctgggtgtggtggccctgcttgtagtccagctacttttgaggctgaggtgaaggatcacttagccaggagttgagcttagtgagcttgatattcatatctcagctggcaaatgacccgtctcagtcacgatgttacagcgtagccatgagaaaacaaaacggttctttacatattttgcccaattttt

SEQ ID NO: 560194 - DNA, 669 bp, Homo sapiens
  misc_feature (567)..(567): n is a, c, g, or t
  misc_feature (647)..(647): n is a, c, g, or t
aaagatttggagacgtgatccccatgagtttggcccgcagagtcaggacaccaagtttcgggatttcttcctccctaaggtgctatccgcccccaccccccagactacggggacttccagcccctctctgtgtccccagcatcccacccacattagaagcggtctggacgctgtcccgctccctcaatcagtcaaagtcctgcatctctgcagactctttgggtcaggagaatcaaacgcatgtgccggaacttcctatcttaggaaacgtgagcccgcttggcattcgggcgtggggcggtggggcagaaatctgaggtcccccctcctgcctagaaggacatggaccccatgtctcccagacttgcgtggtcagagatgtgaaccttctatcccccgaagctgctgcatcagacgaccccaactcctgcatgcctgccacttgcccttacctggggcacactaggtgcggctgcagcgcctggggctttcaccaatcccccgaccctgctgatggcacacaacttcctgctcgctaccagggcgaccgaagtgtaccctatgctnggctctgggctgaggagaccgcagttctgctgcaagccccaggactgggagtcgcggaagtgggtgaatgaagagggccngtggagggtggtgcgtgttgcg

SEQ ID NO: 560195 - DNA, 1306 bp, Homo sapiens
gcgtccgtcgcgtgcccccccgctcttggtggtgtctcctctgtgtggtggctggccgggcgtctgctttgtgtttgcctccccgctcgtctggctatgtttgtgtgctctccttctgtgtcgcgggtgtgtgtgttctcctctttcttggtggggcgtcgctctggttgtttgtgtgccccctccgtgtttggtgtctccggcgggtgtcgttttgggttctcttgttttcttccgtcttgcggtttttgtgggctgccccctccccctcttcttgcgtggggcggcgcccctgtttgtgtgcgtgtgtcccaccatttgttttgttctccctcccggctggcgaggtactggttcctgggttgcggactaagtttgttttgtttttttgtctggtgcgttttgtttgctgctcttcgtgtgtctgccctcgctcccgtttagggggggttccgcgcccctctttgtggggtcctccccgccccttttgttcagatgcggttcgtcctccttctctgtctcctgtgggaggtcgctcctcgccgttcgagattgtggtgtggtcgcgccccccccgcgcacccaccgtttgcttctcgtgctccttgtcgtccggttccagccccccctctcactcctttgctcgtctcttttgtggtgggtgtcggtaacgtcttctcttctttttccttccgccgccgccgttatctcctctgtgttctctcttctctcttcttcactgaatcgcgcgcgctgtgtgtgctcagattgatgaagccgaaggtctctcccttctagtgtctcctctctccccggcgaggtgagtgtgttttttctcttggacgtccccgctctggctcgccccccctcttctcttctttctcccgtcacggccaggcacactcccttcctccccgccccgccgctctcctcccgtggttgcgtgtttttccccttcccgcgccactctctctctctctctgttgttgttctcgcgcgcctcctctctctcttattctcgcggtttttctcccccgctccgccgcccccccccctcccgcccccctcgcccccccctccctccttcataagagaggagcgcgcccctcctccctggcggcgccactccgccggtgtgttcgtcccccgtctctctttttttctctctctctctctctccgcgcgcgcgtggctgtgtggttgtgtttttcttgatgagagacaaacacgtctctccccccctcctctctcctcctcccccgcccccctcccccctccgttttgcaggcgaggagagagagaaata

SEQ ID NO: 560196 - DNA, 199 bp, Homo sapiens
aaagtcgcagttactctgtattgcccaggttggtctcgaactgctgagcttaagtgatcctcctgccttggcctcccagaatgctgggattacaggtgtgggctactgctcctggctgtgtcttcaatttccgccttcagtgttttgtaattttcgatgtacccttcttggttaaatttatttctgagtattttttttt

SEQ ID NO: 560197 - DNA, 506 bp, Homo sapiens
ccccctggctgcaggaattcggcacgatgagagagagagagagagagagagagagagagtgagagagagagactgggactgtcacaaggcagagggtggctaggccatatcccaggacccacttgtaattaataatgcttatgaagtatcatgttccactgtacactcattgtcattgataacatcttatcatgagatacgctttgagagcttacaaccagtctcaccaccatatattatctgtgaatttcctcgtcctaattagcctctcattgcttccaccgactggaccttatatcatcctttatctccaaccttaaatgacttacattccctgcctgtccatttcagagaccttccactatgaacgcattctctgtctcattgttcatccttgcttataatatgaattcagctactctttcttctattcgtcttttttacgatgtcccttgtttctctcaacatcatttattatcctgttccttttctctcggtgcccatct

SEQ ID NO: 560198 - DNA, 575 bp, Homo sapiens
  misc_feature (89)..(89): n is a, c, g, or t
tggctttcccagtatggtcctaaggccaaagcccagtcaaagcaatggctatccagaggtggaagtggtccagtcaaaccgaaacccgnctggtggagagcaaaggtaacgcccacaggttttgggaatgctcaagcccttttgcttgttgcccttttagagggccaaggagtgataacctctgcttattatgagaatgttttgagaaagttagcccaagttttagcagaaaacccctgggggggcttcccctggagagtttttttcccccgggccattttttttattacccaagggcaattttgcaagggttttgatgagaaatccttaggcatcccccttccagtcccgatttggccccttttgacttttttttgtttcctaattttaaaaatctgtagagggcccccctttttttttgtttaataatgtaaaaagactgccttgccatggttaaatttcccggccccccagttttttaaaaatgtattaaagggggggggtcatagcttccaaaagggttttgcctttggtaaagtttttgtggagaaataaagggttttttttgtttccca

SEQ ID NO: 560199 - DNA, 490 bp, Homo sapiens
atatgtaaaaaattaaaaaattaaagagcactatccgggccgggtgcggtggctcacacctgtaatcccagcactttgggaggacgaggcaggcagatcacccaaagtcaggagttcgagaccagcctgaccaacatggagaaacaccatctgtactaaaaatacaaaaaaattagcccaggcatggtggcgcatgcctgtaattccagctacttgggaggctgaggcaggagaatcgcttgaacctgggaggcggaggttgcagtgagccaagattgcaccattgtactccagcctggactagagtgaaactcggtctcaaaaaaatcactatccgctgggcacagtggctcacgcttgtaatcacagtactttgggaggactacttgaggccaggagttcaagaccagcctgggcgacacagggagactcccatctccacaaaaattcaaaagtttagccaggtgtggcggcatgcaccgccggtccc

SEQ ID NO: 560200 - DNA, 339 bp, Homo sapiens
  misc_feature (45)..(45): n is a, c, g, or t
  misc_feature (54)..(54): n is a, c, g, or t
  misc_feature (228)..(228): n is a, c, g, or t
  misc_feature (238)..(238): n is a, c, g, or t
  misc_feature (273)..(273): n is a, c, g, or t
  misc_feature (289)..(289): n is a, c, g, or t
  misc_feature (301)..(301): n is a, c, g, or t
  misc_feature (319)..(319): n is a, c, g, or t
tgagatggagtttcactctctcacccaggttggagtgcagtggtncgatctcgnctcactgcaacctccacctccagggttcaagcgattctgtctcaaaataaaataaacaaataaataaagttaaatatatgcacctaccctatgatccagcaagtccactcttagatatttacccagaagtaatgaaaccttaggtgaccaacaaagaccttgttcaaggaatgnctgaggagcngctttatgtcataatagttccaaaccaggggtgcncagggatgtcccttcnataggaggaacnggggcctggggcacagtngggttcacatttgttggtcc

SEQ ID NO: 560201 - DNA, 244 bp, Homo sapiens
gcgaggttcgtacattagtggtattccttcagtttttcggcacgaggttcaccactgctgaaacgtgtattttccgtttcattacagaggaagctgtgctaatgtcgccctggatttttcagaatgagatggccacagctgcctctttctcctccctggagaagagctatgaactgcctgatggccaagtcatcactattggcaatgagcgcttccgctgtcctgagacactctttcagccctc

SEQ ID NO: 560202 - DNA, 394 bp, Homo sapiens
  misc_feature (154)..(154): n is a, c, g, or t
tgaactacacagattccaacttcctaagccaaacagaaaatcattagtaggtctttaattctagattgaatttcccttatcatgaatgagatggtctgaaataaaatcaagttcatttttgccattgcactgaacgatgccaatgcctatcagnagacaggttctgtcttgcatttgcttgcactttagagtgctgcatgaaagcagtgtgcagagattttgaggcggtccaccatcagggcaggcagccattgggagccatcttcttcaatcatcttctccacagatcttcaagagcacggttctgtagtctccagaagtatctggattggatggccgagtatagagagtagccatagtgcttcttgaactcatgtctgatggtccaaaagat

SEQ ID NO: 560203 - DNA, 262 bp, Homo sapiens
cgcacgatgcgcgcctgctagcattcgtttgtccggtgtctatttgctacattgagattcgcccgggggaatagcgttatgtcgattcagagatgatatgtggtttgcgatgagtgggatgaagaacgagaggacgtccatgtttaattatgcctttttgtgttgaggtgatgatggacgtgtagatttcctgttgtgaaattgttttaggtcatagcttttctagtctggttaggttctcccgcggagtcccgcgcgccgg

SEQ ID NO: 560204 - DNA, 724 bp, Homo sapiens
aaaccctgcgtggcatccctgacgcaccgccgtgatgcccatggaagacaggtcgacctggaacgtccaactacttccttaagatcatccaaactatctggatgattatccgaatatgtttgcatggtgtggagcagacaagtgtgggctccaagcagagtgcagcagactccgcagtgtcccttcgcgggaagtgctgtggtgctgatgggcaagaacaccatgatgcgcaaggcgcagtccgagggcagcctggaatagacaaacccagtctctggagaaactgctgcctcatatccgggggaatgtgggcttagtggttcaccgaaggaggacctcactgagatacatgggacatgtttgctggccaataaggtgccagcatgctagccggcgtgctggtgccattgccccatgtgaagtcactgtgccagcaccaagaacactggtctcgggcccgagaagacctccttttctccaggcttgaggtatcaccactaaaactcgtccagggtcgaccattgaaatcctgagtgatgtgcagctgatcgagactggagacaaagtgggagccagcgaagccaggctgctgaacatgctcaaatctcccccttctccttgggctgtcatccagcaggtgttcgaacaatggcagcttctacaccctggaagtggtcgatatcacggaggcaactctggttctcgcctacgggggggtccgaag

SEQ ID NO: 560205 - DNA, 434 bp, Homo sapiens
aggtgttccagagtcagcgccaagctacgcggagaacgttcatccagaagtatcatactccaccgtggagccgggcgcagcgagacaggaaggccacgcataggtggatgagacagagggacgtgccgggtgtctatcatagaaggaaggccgatcacagcgtcgatcagactcgtcattcgaatgccagcacaaacgggagatcggggctcagctaggttatcgggacagtaatggaagatcctacatccagtccctgcatgtaatccgtgcaatcattcagaaatatttcgaatagccattgggtgggcatacatgctgacaagcgcagttcagcaacccaggggggcccccaatggaagatttgggaagtcggattcaatatggctaagtggaggtcctgctccgaagcaataactgtttactttccaatc

SEQ ID NO: 560206 - DNA, 678 bp, Homo sapiens
cccaggctggagcgcagtggcacagtcttgtgctcactgcaatctccgcctcccggtgttcatgcctgttctcctgcctcgtgcctacctcgagtgtgctggtgatttgctgtggtgccctgccaccactgccctggctgattttttttgtattttttatgtggatgacatgtggtttcacctgtgtttgtgccaggatggtctctgatctcctgaccctgtgatctgcctgcctctggcctcccaaagtgctgggattacaggcgtgagtcaccactgcctggccaattatttgtatcttatttggtagatgatgtggtgtttcactatgttggcctgtggctggtcttgaactcctgacctggtgatccacctgcctcggcctcccaacgtgctgggattacagcgtgtgagccactgctgcctggcgtacgacaacccaatcttcaacaaaaagcaacagatctcttaacaggcacatatcctgaagagggcatgctgacagttagccaggcaccttgggaacatgtggtcacaccttgactagtgcatcaggaaactcaacgacgtcctactacactaagatggacgaaacctagccagacgtgccactggcactgtacgttcctggctggtcttgaacaccgacgcatattgcgtagttcatgttatgatatg

SEQ ID NO: 560207 - DNA, 667 bp, Homo sapiens
  misc_feature (138)..(138): n is a, c, g, or t
catggtggctcacgcctgtaatcccagcactttgggaagctgaggcaggcggatcacctgaggtcaggagttagagaccagtgtgaccagtatggcaaaacccgtctctactatacgaaattagccaggcttagcggngcatgcctgtaatcccaactacttggcaggctgaggcaggacaatcgcttgaacccaggaggcagaggttgcagcagtgagccatgattgcaccattgcactctagtctgagcaataatagagcaagactctgtcttaaacaaagatgaagataggatactcagagttttttttttaaagggacatataatgaatgatagagcagtcacacagattgagatacatagtagaactgtgactgcaagaagctggatgaaaggcgcataggtaggtaagcctagtgatgcccgagctcttatgatcgagctctaagagtatagcttttggttctcagagtaacatacgccctagcccaattgttaccacacggttcacctggactccttgtccccttctagctataacggtaccatcagcttagtaattaaccactatcgctggccgccgattaaacggtacattaccggtcggcatctacttctgcacctcatcgggggcactctagcaacttcaacctccgtggcttctt

SEQ ID NO: 560208 - DNA, 160 bp, Homo sapiens
agctggcgttaaggccggtcgaaaactcccgtgtcgtggcggtattccctttaagattaccgtccagctgtacgtgccctcgccattgagctgtgggtagcggtcggcatcggtcagacgatatttcgccctgcctcctgcactttagcgtgccatggca

SEQ ID NO: 560209 - DNA, 262 bp, Homo sapiens
  misc_feature (179)..(179): n is a, c, g, or t
ttttttaaattgcaacacgaagtctgaggtgaatatcataagagggcttctggatagaaagtttcttccaagagttgcccaagttttaaagattaaaccaatattgcagctttaaagatgaacctaacttttgggaattcttcttcaaagaaaggaaaagtattgctccatctggcttnttcttaagactaaaaagcatacctgggcagaaaactctttattttaaaaatcaaccactgcagggtacaagtaaccatagtaa

SEQ ID NO: 560210 - DNA, 2545 bp, Homo sapiens
gtgtatggccacggcggtgggggcaccccagcaggatgccttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccactccaacccaggccaccctttgtctctgccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggctaggctggggctcatcgagggtctcaggccgaggccactgcagtgccagtgcccccctgaggactagggcaggcagctgggggcacttggttccatggagcctggataaacagtgctttggaggctctgga

SEQ ID NO: 560211 - DNA, 2850 bp, Homo sapiens
  misc_feature (2676)..(2676): n is a, c, g, or t
gtgtatggccacggcggtgggggcaccccagcaggatgccttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccactccaacccaggccaccctttgtctctgccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggctaggctggggctcatcgagggtctcaggccgaggccactgcagtgccagtgcccccctgaggactagggcaggcagctgggggcacttggttccatggagcctggataaacagtgctttggaggctctggacagctgtgtggtgtttgtgtcttaactatgcactgggcccttgtctgcgtcggcttgcatacagagggcccctggggttggccctccggcctggcctcagccagtgggatggacagggccaggcaggcctntgaacttccacctcctggggcctcccagacctcctgtgcccccacctgtgtgggcaggtgggccagtcttcgggtgatgggaccaaaccccttcagttcagtagagaaaggctaggtcctctacaaagagctgcaagacaaaaattaaaataaatgctccccaccctagaaaaa

SEQ ID NO: 560212 - DNA, 125 bp, Homo sapiens
ctaaatgcgttacctaaaatggctgttacctaaatcgctgttacctaaatggctgttacctaaatgggctgttacctaaatgggctgttacctaaatggtctgttacctaaatagtgtgttacct

SEQ ID NO: 560213 - DNA, 438 bp, Homo sapiens
atataccagcagatataagccacattacataaaaacatcaatgggcctgagaaataagaacagtaaacatcacaattgatgaggaaatatcaacttggagcactcaaggacatttacattatgatgaccatggagttatatgaacatttataactttatataatttccatattacatttctcatagtatggacaacttatagccactaactgaattctccaaatacacgtgaagtttcaaaaaagaggccacaaatatgtagttactgaagatgttgaataatcattttacaaagcagttatctgaatggggattagttggtgattgtatgtaacaaatatgctaaatgctttaaaactgtcagaattttagtaatatatttctacctccaaatatatatatattgtctattcactggataatgtgtgtagattttaa

SEQ ID NO: 560214 - DNA, 3039 bp, Homo sapiens
gtgtatggccacggcggtgggggcaccccagcaggatgccttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccactccaacccaggccaccctttgtctctgccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggctaggctggggctcatcgagggtctcaggccgaggccactgcagtgccagtgcccccctgaggactagggcaggcagctgggggcacttggttccatggagcctggataaacagtgctttggaggctctggaaaaaaaaaaaaaaaaaaaaaaaaaaaaaaaaaaaaaaaaaaaaaaaaaaaaaaaaaaaaaagaaaaaaaaagagaaaaaaaaaaagaaaaagcaaaaaaaacaaaacaaaaaagaaaaaaacaaaagagaggggggggggggggagaaccgcccgggggggggaagcggcgacggcagcgcaggcgagggagagcaagggggagcaacaggcaccacagtagtatagagggcgcacctgagagggaacaagcaggcgaggggagggacaaccggggagaggccgagagagagaggaaagcaacggaggggcgcaagaaagagcggggggcgcaagacggcgaggaggaaggagagggcggccgcaacagccacgacggacgggagcgcgacggcacacgccgcgagccacacgacgggcggctgagcgaccaggacgggcagaggggggagagaagaagaaaaccacagcacgaggagcagcgacgccgggggg

SEQ ID NO: 560215 - DNA, 904 bp, Homo sapiens
acatgagaagtatgacaacagcctcaagatcatcagctaatgactcctgtcaccaccaactgtttaggacccctggtgcacaggtcaatccatgacatacttaggtaatcgtggaagagactgcatgaccacagtccatggcatcacatgtcacccataagactgtggatggtccctccgggaaattgtgacgtgatggctcgtggtgttcctcctagaacatcattctgcctggcctcttacttggcgcataggctaaaggcatgtggagccacgggtcatctccctgatacgtagtctcggtgatagttccacctgtccaatggccgttgcgctgtgcccactgtctgaccgtggttcaggtcggtggaccggggaccctgctcgtcatagatgggatagctgcactgatatagtgatgacctatctcagaaaggtggtgagaaacaaggcagtccagagatgggcccccatcgaagggggcaatctccatgggcattacaacttgagcaccaaggggggtctccgtctgactttccacgagccgaccatccactcgctctcggcttgggaccgcatggaggcctgtgtcactagctccatcaaacgacgcgagctgtgtgatctatgctccatgttgcgctgggttgatgaacgaccgaattttgtgctacgagctaggagggtggtgtcgcctcatggacccaacattggtacgtccatgtagttacagaaccctggtaccaagcaggttgctcacgcattgaggcatcaatgagtggaggagcagagacccttgcactgttgggggaagtgctcagtgcaatttggcacgaaccccctgcaattatgggagttgaccctcctacggaatttggctgttgactccttgaaaaaggggatg

SEQ ID NO: 560216 - DNA, 2646 bp, Homo sapiens
gtgtatggccacggcggtgggggcaccccagcaggatgccttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccactccaacccaggccaccctttgtctctgccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggctaggctggggctcatcgagggtctcaggccgaggccactgcagtgccagtgcccccctgaggactagggcaggcagctgggggcacttggttccatggagcctggataaacagtgctttggaggctctggaaaaaaaaacaataaaacaaaaacacaacacaacaagaaacatacaaaaaaaaataacataaacgacaaatcccaaaaatcgaacaaacacaaaaacaaggg

SEQ ID NO: 560217 - DNA, 82 bp, Homo sapiens
ttgggaggctaaggcggaaggatggctttaggccaaaagcttaagactccccggggtaatacagtgagcccttatctctcca

SEQ ID NO: 560218 - DNA, 2680 bp, Homo sapiens
  misc_feature (2506)..(2506): n is a, c, g, or t
gtgtatggccacggcggtgggggcaccccagcaggatgccttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggctaggctggggctcatcgagggtctcaggccgaggccactgcagtgccagtgcccccctgaggactagggcaggcagctgggggcacttggttccatggagcctggataaacagtgctttggaggctctggacagctgtgtggtgtttgtgtcttaactatgcactgggcccttgtctgcgtcggcttgcatacagagggcccctggggttggccctccggcctggcctcagccagtgggatggacagggccaggcaggcctntgaacttccacctcctggggcctcccagacctcctgtgcccccacctgtgtgggcaggtgggccagtcttcgggtgatgggaccaaaccccttcagttcagtagagaaaggctaggtcctctacaaagagctgcaagacaaaaattaaaataaatgctccccaccctagaaaaa

SEQ ID NO: 560219 - DNA, 399 bp, Homo sapiens
agaggatccccctacgtgctcgattcgtatactcatagtgggcttctaactactggtacgcaagatgacttctgattggtaatcttaggtaaattatagataaatgaacacggccagtaatcatacactaagattaataaacagcacttcaaaattaaccgcataagggctgtgcttgcagcaaggtttcacaagacaaggcacccagattttttcttcccacgtctagctggcagagcagctctcgtagccatttcaaaaacctctctcactccatcttgggtcttggctgaacactccatgtacccaaaagcgccaatcctgtaagccatatctctgccttcttcaggtttcaccggctcctgcttcatcttggctagctcccgcctagtgtgctca

SEQ ID NO: 560220 - DNA, 2375 bp, Homo sapiens
gtgtatggccacggcggtgggggcaccccagcaggatgccttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggctaggctggggctcatcgagggtctcaggccgaggccactgcagtgccagtgcccccctgaggactagggcaggcagctgggggcacttggttccatggagcctggataaacagtgctttggaggctctgga

SEQ ID NO: 560221 - DNA, 711 bp, Homo sapiens
tcctcccggtcgccaccgaggtcgcacgcgtgaaacttctccgccgcctccgccgaaaacgccgccagaatgcgctaagtcgcctcctaccggtctggctgccctagggggcaactcctcccccaggcgccaaggacatcaagaagatctttggacagcgtgggtatacgaggcggacgacgaccggctcaacaaggttatcagtgagctagaatttggaaaaaactttgaagacgtacatgtgcccagggtatgggcaagcttgccaagtgatacctgcagggagtggggctgtagccggtctcatgcttgccccaggcttcttgaaagcccctgtgcatgctagggttcatgcccccatgcatgcacgcagaaggaaggaaagaaaggactgagaaagaaggaggagtcgtgaaagaagttcagagtagatgcacatgtggggaattgtgggccatttgagggacataaaaatctccgtggcatcccccgtgccacaaagttaaaacggccttatgtaataaacaagcagttccaaaaaaaagaaaaaaagaaaaagagacgacgagcacacgtgactagcaaaaaagaataatccccagagagagggggccacccagagataacacgagccgaatcaccccgagacttacgactggaaaaacaaagcggtggccccccatagagagaaggaggcagaaaataaaaacg

SEQ ID NO: 560222 - DNA, 815 bp, Homo sapiens
  misc_feature (8)..(8): n is a, c, g, or t
  misc_feature (15)..(16): n is a, c, g, or t
  misc_feature (815)..(815): n is a, c, g, or t
cctaggtngtctcgnngcggcggagattcccgtgaagcgacgaggagagagagccagcagccaacccctacgacttacaggaggctgcgtgcgcaaaacctcccagcgccggcgcctcgtacagcagtgctaaccgttcaacgaggcattcaccgccgtcagaaggcgctggagtctgcggggcagaatgggccaagcacgcactctggggctggcaccggcaggcactgaagctgcggacctgatctccgcagaggctgcctgctgcgctcggccctcaagtgcccgggccggccttcgtgctccgaaacaagagacctgggagccctcgggaaacctcccccgacgctctctctcggaactcccgcaccctcctttctcaccagcccgccagttgtggcaaccctgtgcttgttcccctaatctatcactttgttctttttttttgtgactcctgtggactccactgcgcctgggatctcgccaacccctccctcattttggggtgactgaattcaaaaatttttttttattggaaaccggttttcttgggcaacaaaacacttgctagcggctgaattttaaagaaaaaaaccccggcaggggtggtgaagaatttgcaatgataatttcatatcgacgctcgcttttcctttggcctttggctagtaccgtccactattcaacgccttcgctttgaaactaccaaaacacacaaatcaaacggccattattacttctccaagttaaatactttagtcttttattacactacttgagctatagtctcttattacctctcactcacccacccn

SEQ ID NO: 560223 - DNA, 363 bp, Homo sapiens
ttggccggacactagtgctggcaggacactagtgcttggcaggacactagtgcttggcaggtcaggttcctcattttagggagattttaactttaagtgggctcgagcaagtgttaattacctggacagttcatgcctgtggaggccgaccctccctgtggtgctgggtccatgagatacagactctcctgcctccctgctccccagatccccggggtctcctgctcaaatcttgggctggggccagggtcactaagaaatctgctttctttgaacactaaccagttcaggcgtacacaggagttgcagtctcggggtgggggcatgggttgggttcaaccccagagtgtttcctctgtcctg

SEQ ID NO: 560224 - DNA, 1476 bp, Homo sapiens
acttaggctcaagttgtcaaaaaagccgggtttataacgacggcatatatacgctagacagctgtgatcgaagtctgactgtgcacagcgtcgctgctgtgctctgatgcatgactaatgtgccgctaagcgtgctgctcatgtccgagcgccgagaacagtgaacaaagcaacccacaggcgacagcccatgctcaccctgaccgtgtggcaggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccactccaacccaggccaccctttgtctctgccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggctaggctggggctcatcgagggtctcaggccgaggccactgcagtgccagtgcccccctgaggactagggcaggcagctgggggcacttggttccatggagcctggataaacagtgctttggaggctctgga

SEQ ID NO: 560225 - DNA, 2022 bp, Homo sapiens
gtgtatggccacggcggtgggggcaccccagcaggatgccttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgtctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggctaggctggggctcatcgagggtctcaggccgaggccactgcagtgccagtgcccccctgaggactagggcaggcagctgggggcacttggttccatggagcctggataaacagtgctttggaggctctgga

SEQ ID NO: 560226 - DNA, 184 bp, Homo sapiens
  misc_feature (23)..(23): n is a, c, g, or t
  misc_feature (64)..(64): n is a, c, g, or t
  misc_feature (124)..(124): n is a, c, g, or t
  misc_feature (130)..(130): n is a, c, g, or t
  misc_feature (159)..(159): n is a, c, g, or t
  misc_feature (179)..(179): n is a, c, g, or t
gaacctgaggagcccggaagcantgacatcaccgttcctcctcccagctaccgaagcgccgcgngagcgctcacaaacacggcttctcctggtacgggctggttacgccctccagctgcgcccnctacangacgacagacgcgtcccccagcccttctnctgtcctaccacttgtgtcngccat

SEQ ID NO: 560227 - DNA, 213 bp, Homo sapiens
tgttggtcacagctactaggaatgaggtgatttctgagggctgagaaaaaacacaggatcttggccagacagaccagacagactgcattggttgaaaagattgccataccacattctcatttgagagttggggttgagggcaaacatagaacccaggtttgggctttacaaaccagtgtcccggaagccctcctttcgggagatcttgttaga

SEQ ID NO: 560228 - DNA, 398 bp, Homo sapiens
tgtgcgttgggaggcagaggtgtgtggatcgtttgagctcaggagttcaaggccagctttggaaacatagggagacccgtctctataaaaaaaaaattagccattatggtggcacacgcctgaagcccaagctatcccagctgaggtgggagggttgcttgagcctgggaggctgcagcgaaccgtgatcacgccactgcactccagcctgggtgacagagcaagaccctgtctcaaaaaaaagaacagccttgtgttaacaaccaaatgcaatatatgtacttttagatcctgatttgaaccaaataattgtaaaaagacatttttgggacaatccaggaaatttaaatatgtgtaagacatttaattaggtaagtttcctacctgcgaacctatga

SEQ ID NO: 560229 - DNA, 276 bp, Homo sapiens
agtgaggcagggagagtgcttgaacctgggaggcggaggttgcgctaagacatggatcgcgccatatgaactcctagactgggtgacaggagtgaaaatctgtatcaaaaagaaataaaaaaacgaggtcaagtagtaagagaagcggtaagagtgacgggaacaggagtcatcgacctcatgggagaggagacaatggaggtggtgatgcatcgctgaagcagccacacacgctttattctcgcgaggacagcagcttgtcagcgcacgggcatg

SEQ ID NO: 560230 - DNA, 1219 bp, Homo sapiens
tggctcccagtcaatgaaagggaccctttattgaggctccagggccacggggcctggcgcaggcaggctgcccttcaaggaaagaacaacctttaatttgcaccttcttctggggaccgcaggttgtcggtgtgcaccacacttctctcttgcggcagttgacagccacgagggtgaaggcgagctatagccacttgcggcagatcatctgtgtcgcacgttgatattcctgggcaagctggcgcgacaagaaggcctcaatattgccacctcgacaggcgcaacaccaggtgccagggttggactcttatctggcatgttgtagtctgaacacagttgcggccatcctccagctgtttgccaggcaatattatcagaacgcctgcctggtccacggctgggatataacccctcctcttgatcccttgaaacatcttcgcggcctctcgcactattttctccacagtggtgctccactggagctctccgacacctccacaggcgctgcatggctactgagaccccgttgagagggagtccttccaccacaaaaacatcgtgcttgtgtttgtgcagctccggcagcgaccgcgcgcccaccaaagccgagccccgtgggtttgcgcgttagccattgggcgttactcgggtgttccatttacaggcgcttagtgttcaggccgcacttgcccgggagcccttttcgcgccgcttttcccccaggggatcccggattgtcgtgcgcccgatgtgacccaggcacttcatcagagcaagcagcgaggatcttcgtgaatccacgagaggggacccccaagaaacaaagcggctcgagaaacttatgtggcaagaccggctccttacgatggaacttccgcaccaagcgttttcccgtggataggatgattaccaacaaaagttgttgccccctccaagtaatatagcgcaagatcttgcccttcccattatgaagcgtttacagaaggtgggcactcccgagggaacagcgtagttttcttcttaaaccgtgtatgttggtaaaacctcccttatgtacacacgactgtgaccccgcgaaagaaacgcttttctcagtgctaaaacattccctcacatttctttgtgacaacagcaacccttgcggttatagaacacgttgttgggatcccatgtgttgagagacaataattcctcagggaccatggtgaaacgaacctca

SEQ ID NO: 560231 - DNA, 194 bp, Homo sapiens
agaaccccagtttcatcagcttttttagacaccacaggtttagcagtttgaacaaactgaaactttatacttctgtgtgagctgtactcaagtttcagataatcatcgccatgtggaggctttttgttaatgcagaagacatttcaaaatattgtatttgtatctgccttcactgctgccaatttagtagcatc

SEQ ID NO: 560232 - DNA, 196 bp, Homo sapiens
aacattccagctgtttaattctggcagatctgatgctgatatgatgctgtatgatctataaaaaaaaaataaaagtacaaatccatatagtgaaatagtccaataataaaatacataacacattaagtactcagctaagaaaagggcactataaggatacaaaacacttcccagacagcagacagtcctgagaatg

SEQ ID NO: 560233 - DNA, 737 bp, Homo sapiens
  misc_feature (17)..(17): n is a, c, g, or t
  misc_feature (25)..(25): n is a, c, g, or t
tccatttggtccccccntgagttantggatatctgtcgacccacgccctcgcgtgacgcgtgggaggcattcaggactaaaggaccaagggggcggtggacccagtcattgtaccatgctgagcacagtgcacacatggtgctgcagcatgcttcttccagtgaaactgacacagggagctcagcagggctcagatcctgggacccctgtggccagtgcctgccctccaccttgagtgccatactcccaacagactccaggtacccacctggtggcattgtgcctgctcagtgaaacctctttgctccacgacagcatgggtgctatcagctgctggcccaatggccacggagcgctgggttctgcaagcagggctcagcctcagctggcgtataaagacccctggaatgacatccatacatggtgaccctgacacgggccactgtttgccacacttgaggcaacgcttgggtgctcccaatggttcaaaatagctttattcattatgacactgggccaggctctacgaacgacccatggcggcagcgttcccaccgcagggtgtcccccccacctttttacaacgtgcgctgaccggttagaatgacaatccatggtattacaaagggcccacaaaagtgtgcccgacgtgcagcaggtcttgggggccatccgcgcttgggactcctaggcgattgtcccaccaaaacctggctgcgtgctgtacccgaagctcc

SEQ ID NO: 560234 - DNA, 154 bp, Homo sapiens
cggtcgcctctcgacgactcccccccccctcctatactgccggtagacggcttcctacgaccgtgtgacccaccgtcggcttggacttaacggcgacccgcgactttctacggactacgtccgtacgaccttacgacacttgtgacacgactga

SEQ ID NO: 560235 - DNA, 86 bp, Homo sapiens
gaagagcagaagggcttgccattcaagctaagaaggaacgggaaatccaggaaagagaaatgaaagtgaaactggaacgccaagcc

SEQ ID NO: 560236 - DNA, 397 bp, Homo sapiens
ctcccctcccccgacctctgctgtggcttttcctgacgggaaatccatgggacaagccgtgctcggtgcaggctcccgctctgctgagccctggggccaggggagggggccaggtcgccagcggcgcaaacgcggtgggggcgcaagtgcgtgtttgctggagcccagagctcccgtctggggtgaaagggtcgtggcacccagaggtgaggtttgttcacagccctcgggtaccaccaggcgccctcgggtaccaccaggcgccctcgtgggcgctgggagcagctccgggcgcctggcgcggctcgtgggcgtccctctcgcgagctgagcgtgggcgtcggcctctgggtgctgtcccgacccccacgaggctggtgccgggagatgctgtggc

SEQ ID NO: 560237 - DNA, 83 bp, Homo sapiens
agggtaggaggtgctggtggggaggaatggcgagtgactgctaatgggtatggggtttctttaagtgcagaaagatacttgtt

SEQ ID NO: 560238 - DNA, 188 bp, Homo sapiens
gcttgagcctaggaggtcaaggctgcagtgagccatattcattcccttgccctctggcttgggtgacacaatgagatcctgtcttaacaaagatacacagatgaatagataatcctcatcttcagagcagcctcacaacttaggtggtggatgacttgtgcataggtacattcatgctaccaaggcag

SEQ ID NO: 560239 - DNA, 156 bp, Homo sapiens
attccttaacgcctgcttcactagtattggtattttccacatccactaagactatcatattgtctgaattgcttggggaaactgtagggggaacctgtagacttgcactgttggcattcgcccttggtactgaacgtcgtgactgaaaaaaccgtg

SEQ ID NO: 560240 - DNA, 782 bp, Homo sapiens
tacgggtgaaatccggccctgagcatgtcgaaggtcaagtctacagggcccggaagcgcgttcacggttgcgggaggacccccgggtgtcccaatggggagggctaagacgcctgcggcgttacgctgccatgccaggcctcgcgggagccaattccacccgcgcgctggttgcgagccaacgtggccatagcgcaagacacggtcgtgcctgggccacacacacaggccgtcgttaaacacccggaggtaggcaggcaagggcaaggccaagacgctagagctcgccccgcatgcccattgccggggggaaccccgagatcgtgcccccgagccccgggtcccaggtaaggtcccacatccagccagccccagtgagcacctacgtgcgtaggtccaagacacacgaggcaagagccacgctgagtcctcctacccagtcgcccacataaacgggggggtcaccgaaggagacgagcgttagctgatgcctgggaggagcaagggtcgagggctgggcgaacccaggagttccccctccccttcccatataagcatgagggtactataaggtgttttgggtttttatagtgttattattattgttatttttttttccagtagtacgtaggcttgtgcttttaagaaaggggatatttaaaaaaagaaaagacaaaagtgtttgttaacaacaaagccaacacccacacctgtgtctgtatatagtcagcttatgctcgtgttcaatcgtctgatctcattacgacaatgggaaatgcgatt

SEQ ID NO: 560241 - DNA, 108 bp, Homo sapiens
gcccctaaagcaattctctgttccaggggagggagttacctggcattgaatgctgcaggctttacgacttattccaaggaagttcttgattatgctaaagataatata

SEQ ID NO: 560242 - DNA, 576 bp, Homo sapiens
agcatgcaacacttggggttgtgactgaggggacaggcggaagggaaagacgaaagattagggatgggttgcactgggcacagagactaggaagggactgatgtgtaaaggaatgcctggacttcaagtacctcagaccatttgcccattttacgacaagaattatttagatcttgtaggaatggaaaaattgaaagtgccgttttccggctatttggaactactgtcgagcttgtattggagtcaagcggcattgcagaagaaagtaaggcatttaggttttaggtcaggtgtgagttgaagaggttttaagtttttgagaacacaggctaagggagaagaaggaagaatggaaggtggaagcttacccatagtgaaggaggcaagcccagagaaaagagtagaaacacagagaaggggtggggggttcttgccctccagaaaagcagagaaggggtaggggcatggaaataagaggtcagggtgcggaaattagggattgggcacagagatagaggtggcgtgtggaaatagtgatggggggtcttgccctaagaagcggactgctgctagata

SEQ ID NO: 560243 - DNA, 532 bp, Homo sapiens
actagttctagtaagcctctacctgcacgacaacacataaaaaaaaaaaaaaaaaaaaaaaaaaaaaaaaaaaaaaaaaaaaaaaaaaaaaaaagggggggggcgtttaaaatttttcctgggggggcctttatttgcgttccccgttttttttttaaaagggggcccctttgggggggttttttaaaaattttggggggggggtgttattaacaaatgtttgtgttgtgggaaaaactgtgtagacgtcttggaggattcttgtcggaagagaggagacaccttttatttttgtggggggggggtcgacaatatattggggaaaaaaccattttctcctacaaaagtagatttttaaaggctctcgtagtgggagaaatattataaaaattttaaagaggtgttataatgtgggtgtatacacaagcgcggaaatatgtgtggcggattagaaagagttgtggcgtacacaggagtatttgatttatagaaaaatttttttcaccgagggctttgttagataaaaggggtg

SEQ ID NO: 560244 - DNA, 209 bp, Homo sapiens
tgtagagactaccaggctccatataaacgatatttggtgtgcagctcggtgctcacgtggggacggaacttgtacagggaggcatgcaccgcagtgttgaatacacgtcgaccaggctccatctaaacgatctttggaggtcagcacggttctcacgtgacgacggatcttgtacacggagtcatgcaccgcagtggtgaatacacgtg

SEQ ID NO: 560245 - DNA, 434 bp, Homo sapiens
  misc_feature (101)..(101): n is a, c, g, or t
agtcagagcacagaatccttcacagcgctaggcacctatgtaatgcatgtaatcctgtagaattgacttctctcacatctcctgtcttcccacctctgccncctcgggtctacatccattatgttaatgagctgtacctcagatatctgtgaaaagaccgatcaacgcagctggttgcacttcaagagctctagagtgtgtcaatcgagattagttcagaggtccttgaaaatacacttgttataaagattaaagattaagaactgttacaacctgtcctggtttaacagtggtatagagtgtaggctctggaacaccatatgctaactacgggagcctggaggcgctatcgatagaagacctagtgctagtcattcaacgtcctcagtgcctgccattcctcatatgtgtcgagtgtctgtaagagctcgtgc

SEQ ID NO: 560246 - DNA, 149 bp, Homo sapiens
tacgaggattacctgggaagctttaccaatttcaggcccttccttaggccaggtacttcagatcctcagagctccccagggggctccactccacagccaagggtaggaggtcctggtctaggtttgtgaggtcacctccttttacacct

SEQ ID NO: 560247 - DNA, 262 bp, Homo sapiens
gatctggagtatgttatgactacgagtcagttggggtgataaaaatttggaatacatatttgatgatgcacaacatctgaatgtaattatgcctctgaatttatgttaaacatgttaacatggcaagcttattacatatgcttttaccacaataaaacattgtaacattaatcatagaaccaaaaccataaaaccatttttttaatctgtatatatttcacagagtacaaaggtgcaacattttcggttcacatgggatata

SEQ ID NO: 560248 - DNA, 141 bp, Homo sapiens
tacgctcagccaactgttctagacttcaatgctccagtgctatgcataaattttagattcgccgtttgcggaactctccctcgtgcatcgatggtaccttcatctttataatcatgtttcgacactttataatcatgtttg

SEQ ID NO: 560249 - DNA, 534 bp, Homo sapiens
  misc_feature (507)..(507): n is a, c, g, or t
acaaccaaagtgatgatcacacggaccgaggtcaatgacaacccaccaaagtttccgcagagcggtataccagaggtctgtgtcagaagcagccgtcccgggggaggaagtaggaagagtgaaagctaaagatccagacatgggagaaaagggcttagtcacatacaatatggtggagggagatggtatggaatcattggaaatcacaagggactatgaaacacgggagggggtgataaagctgaaaaagcctgtagatttggaaaccaaaagagcctatagctggtggggagagtgcatgccaaagaccttgatgctgccaacagccggataaggtattccatcgatggtcacacggacctcgagagatttttcactataaatccagaggatggttttattaaaactacaaaagctcgggatagagaggaaacagccgggctcaacatcagtgtctttgcagcagaaatccagaatcggcatcagggaagccaaagtcccagtgcncattagggtccttgatgtcaacgataa

SEQ ID NO: 560250 - DNA, 1168 bp, Homo sapiens
gaagaagcccacgcagattttaattcccactctagattctggcttcatcgttatgaagcatatgactgatcccgctggcatacgtatctagaactcacgcatggacgaactgcgacacgaagcttcgatgagcagctgttagagctttttgaatttggtggaccagaagtcctgaaattgcgatcagatattgcagtaccgattccaaaagaccatcaggttctaatcaaggtccatgcatgtggtgtcaaccccgtggagacatacattcgcatctggtacttatagtagaaaaccactcttaccctatactcctggactcagatgtggctggggtgatagaagctgtaggacgataaatgcaatctgcttacaagacaaggtgacagagactaaactagcagcacgatctctgcgcgggattatgcagagtatgctctatgcagcaagaacacactgtatacaaactagctgaaaaactggacattctacacacggagctagacaatcggcataccatatacatcctgcataatcgaagcatctgatacaacagtgccagatgtgaaagctggagcgagtgaccgggacaaagggagaagcgcacagacacacggaaacacaacaatgacacaacagcacacacatacgggcaccacaagacttaaggcaacacaagacagcagcacacctgacgagaacggaacacaacaaagaccggacaggccaaccacgagaacacaagaacgaagaaaaacacgaagcaagcgaaaaacaatagaatacacaaaacaacgacaagaaggagaagaaagaaaacagagcgaacgtaatggaaaaggaacagcaaagaggaagcacacgacgagaggaaccggaagacaacaggcaaaagaagaagaccaggaaaacgggagagcggcagccaagcgaccgggaagaaagaaagaaaaagagacagcgcggcacaggaagagagcgcaacaagggagacagcaacacaagcgcacagaagagaggaacagaaaccgagacgaaagacaggagaaacgagacacaaggaagaaaagcggcaacacaccaaccaaagaaatgcgcggcaaggagacagacggagagcagaaaaccgccgcagaaggacgaaacgagaaggagagagaagaagaga

SEQ ID NO: 560251 - DNA, 765 bp, Homo sapiens
gtatagtatagcactaagtttggaccccaatgaccagaagtctctagaggggatgcatgaagatggagaaggaggagagtcccacggagtgccactcaggaggaggatgtggactgactactggaatgggagtggggaagaaggggacctgtgtagaggcagcgcacagctgaggctggcccgacgttggtggctgaccagtgaggcgagttgcgtctcgcgcatgcgacgtgtatgtgggtggcgtggtagctcctatggcctgccagtggcctgcccggctctgagctacttccgtggactgactggtaaccgtaggagcctgctctcaagcaagggacgatcgattctagcatggttgatatgctaggcaaggggtcttctgcaccaccgtgcagcatccacaaattccttcagctaggtcgagttctgtatctcgtaacacatgacgagcctttgaccgaaccttcgctatgtatcgtaccctatcacatcccgctgcgtccgagccagggtaggactgagggagtgccccgagtacccacgcatcatgtcggggcgtatctgggccaatgagtagcttttatatatacactaattgctgagatccaaaagctcaaggaatagacagtgttctgtgacatggattggtttgaaggagttacccaccatcccagcacgataatgtcatctcccaagtggatggcagcacgatctgggcctagggagcttcctggttccagaagtcaattggccctgggctat

SEQ ID NO: 560252 - DNA, 253 bp, Homo sapiens
gggttcaagcgattctcctgcctcagcctcccgagtagctgggatgacaggcgcccactacttccggctaatttttgtatttttagtacacatggggtttcaccatgttggccaggctggtctcaaactccaggcctcatgtgatccgcccgcctcccaaagtgctaggattacaggtgtgagccactgcactctgccagaacttcatactacttctctgtccactggtttacttacattataaagattctag

SEQ ID NO: 560253 - DNA, 174 bp, Homo sapiens
cctggaggcgtgaatggccaggcctattggttgaattagataggctgactcgtttcgattataactagtatggtggatatcgcgtgtatgatatgccttgctggtaagaagtgggtctagggcatttataatctatagagcgaaagccttttttcactgcgcccgctcataagg

SEQ ID NO: 560254 - DNA, 118 bp, Homo sapiens
tcgagtagggtatcgtagcagaggcgagctatggggagagctcctgagtgggagcctcctcctgccatggtctgcttgcatgtcttagaggaagcatccgcctcaaagtaggtgctaa

SEQ ID NO: 560255 - DNA, 143 bp, Homo sapiens
agtctggagtagaatgaaggaaactgcaaccagcatgataatagtgtgttcatattagataaaagtagaaggcacaggagaggtagcaaagagacaggcatttcttcaggtttacttcaacacatacggtgaaacaaaacaca

SEQ ID NO: 560256 - DNA, 687 bp, Homo sapiens
ttccccccggcgtccaagtatttactgactcgccccactccccggagccatatgaatgatctgcctcagtgctctgagccctaggattcatctgtcttttcaccgtaggtggcctgactggcattgtattagccaactccgtcactagagcatcgtgctacacgacacgtactacgttgtagctcacttcccctatgtcctatccataggggctgtatttgccctcataaggaggcttcattcactgatttcccctattctcaaggctacaccctatgacccaacctacgcccaaatccctttcactatcatattcatcggcgtataatctaactttcgttcccacaacactttttcggcctatccggaatgccccgacgttactcggactaccccgatgcatacaccaccatgtgacatcctatcctatctgtaggcgtcattctatttctctaacagccagtaatattaataattttcgatgatttgagaagccttccgcttcgaagcgaaaagtcctaatagtagaagaaccctcccataaacctggggtgacttatatggatgccccccaccctaccacacattcgaagaacccgtatacattaaatttagaccaaaaaggaaggaatcgaacccccccaagctggtttcaagccaaccccctggcctccatgactttttcca

SEQ ID NO: 560257 - DNA, 151 bp, Homo sapiens
gagatttagcaacatagggtcattctctaatccaggcaattgtcttctcaacacataggttccgttaatccaggcacctttggctctgactgggtctccatggttacgtgagtgcatttatctagtagagactagataccagtcataggat

SEQ ID NO: 560258 - DNA, 107 bp, Homo sapiens
gggtcgacacggccgtgtattactgtgcaaaagaagggggatacagctatggttcctttggtgcttttgatatctggggccaagggacaatggtcaccgtctcttca

SEQ ID NO: 560259 - DNA, 130 bp, Homo sapiens
  misc_feature (3)..(3): n is a, c, g, or t
tgngaaaatggggaggtcatcaaggcttgggacattgcatagcaccatgaaggtgtgggaggtgtgcacatcacctgcaaaccagaatattgcctacggtcagcaggcagtcctccaaagatttccccca

SEQ ID NO: 560260 - DNA, 422 bp, Homo sapiens
aacactgcgatgctgctagacattacgatgaggtatatgtccagataagcccatccatctatatgaaaataccctaagtgaaaagtgcatatcaatatagcctaacccaccaaacatcatagctcagcctggcctaccttaaacatgctcggcaacactgcaccttagcctaaagcttgggcaaactcatctaacacaaagcctatagaacaagaacagagtagaatatctcatgtaacttacttaatactgtactaaaaagtagaaagaatgattgcataaggtacccaaagtaatagatttctactagaatgcatatagctaacacaccatcataaagtagagccatcataagtagggaaccatactgtacggcgtacaaaataatacataatataaattgctactcccagcctaggctg

SEQ ID NO: 560261 - DNA, 444 bp, Homo sapiens
ggatcagccagttagaaccatatcagcttttaaatccaagaacagttagaattccacatctcgaatttctacaccaagagggaattagtagagtttctacataattggaaaaacatttttctgaaagaacgagtctttagaaggataactctctgcttaagaacatgattagctttctaataatgccattaactatagagatatataatcaagatgtttccacatttacttacgtgagttaaggtagtcaataggcttgtgattaccctcccgagcaagtacgaaaaaagacaaggttattgcaactgctgtgttcactgttcgcagttacttcttctggtgtcttccccagggatgggttcacttccattatatctaatcctgagagtagccctgtttagtagatttcttctgtgatgtagagaccttctctgtatgtcagac

SEQ ID NO: 560262 - DNA, 815 bp, Homo sapiens
  misc_feature (246)..(246): n is a, c, g, or t
gtgccgcaatcccaacgccgggggcagccccgctccggtgcgccgctcggccggaggctctcggcacggtgcatgtaaaattggagaagaaggacaaggagcgggatacacgagaaggagacgagtgccctagcccgggagcgcaagcctcaaagaagcgccattgtcgctgcgccgcgctccgccctagcgttgccgcgctcgtctcgccgccatgcaacctgtcttcgtggagcgtctagcccncagagtcctttggagccatggcgcattcctcgtccgctccatcatccctggtctactacggctcgtgctctcccccgtgctcccagcctcagtgggccttggctctccatgtctgtcctcctcatgccagcgtccccccgagggcatcaccttgcatcccccaaggcggcggcgcttcgcgcaggacagggaggagcgcagcttcgagtggcctctctggttgcctgctcggcccgtgcgactgggagaccataggctctcgctgtgcccggttctcgcacagagaggtcgcccaagcgcccatccgttcgccggcatcttcgtgcggcgcgctcgtccatcgctccgcggtgcggctcgagggctactggtgggactccagcatcggcaggccccacagctgtcccttggcacggtgacaacgccccgtgcggctctgtgcatgtttgggccctcatgcctgcgacccagggcgcacgtggcatcgcctccgcctccttgtgcctaggaccctgcctctgacgcgcggtatcgatgactgctctcctcagccggggctgcctgcacct

SEQ ID NO: 560263 - DNA, 572 bp, Homo sapiens
aggaagaggtggtggagagttcggggcggggggcaaccagaatcgtcgtcgattatctacaaaatatactggaccctgatgaatgtccactggctctccaggcggcattagcttatgcccttctgtctagagccaccataattcctactctcgaagaaccagcatattctttatggggggggtctacagatgcatttcccaataagagggggcgactacagacatcccatccatacctggaaccagtttcactcaaatctctctggaccagtcatgggataagtaacccagctcttctttggacatcagtattaagtgacttacactagctgtcaccagtaaaccaggctctaccatatcatacgacctccttggtcccatggtctacctttccgcctcaataactctactcggtctgctcgctatctccaatcttttttaaacatgggacggttataaattctgggaaacaatctactgacttgcaccaaacaccaatagcgggcgcatataacttcatagcctgccttataccaccttccccctggcttaaataaaggagccttatcatt

SEQ ID NO: 560264 - DNA, 430 bp, Homo sapiens
gaacgttaacacaacccgacaggttgcccccttcagcttctatacaacctactatcccctttccccaggggtcctgtcctccactccagatcattcctttagtcatagagctgggcagtgaagtggatatcactgaaagagataaggaagccagactacactgcttacgttgccatgatccctcagtgcataaaggagagaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagccaaagtacagggtgagaaactggataagaagctgaaaaaaatggagcaa

SEQ ID NO: 560265 - DNA, 117 bp, Homo sapiens
cccccgagctagcccagcaggccacaggtccctctttccctcctcaccctcttccccctgtcgggctggttggggaggatggtgaccttgggagtcgccctgtcgggctagtcgggg

SEQ ID NO: 560266 - DNA, 1824 bp, Homo sapiens
  misc_feature (66)..(66): n is a, c, g, or t
  misc_feature (70)..(71): n is a, c, g, or t
tcatggtatggaatttgactgtgaaagttgattagagaccttgagggaaagcctccctggagatcnagannatcagatttgctatgctggcttagaactgtgtcctatcctactacagatgtgtctgtcagccatgaagagatgttttaggtgtctcttccagaagttgatttccgctaataacccacagtggatctatgaataccagagttgtacgtgattttccaagtgaataggcgccattgttttggttttaaataccctttccagtaatgactggtattttttaaaaacctaccctagcatgttgatcaggctaaattaagttcctctctcaagccttattgatggctcagtgcccattatattttaactacaggtaacagcagtttgtcctaaatgcattagtttgcacttgtccaggttgtagctcttttatgcctctgctttttcccacatggtcttatgagaacatattgcatatattcccttcagctgagcatttcaatacccagacaagtgtttgtcattttaggcctcatcacatacttgaaattccaagtcctttttaaaagaaatgttaagtagctggtgttgctactagatccctggattattccacttgtccatccataaaagttcctgtttattctctaccttctgtttctatttctaagccaatgctttaagacataacatctgctccagcctgttcactatccatgtggttttaaactcttaactttacttcttagcttcatccctgtaagtaagtgctctctacctcacaggggtcttatgagggggaaaaaataagatgtttaagggttgttttaagagagagatccttcttttaaagtgattttatcaaagccccttgggttagaaatgaaaaactctatagctatttttttcctattctcgttttgctatttttatttctgaaaagtgatctgtctgaaaagagccttatatctggttttaacttctcctcattgacccttttcacagtgaaatctctactttatccatgctctgaactttttatttatggagcccaaactaattttcccacaacaaatctcacatacttttactcctatcattaaacaaattaatgtcctccacaaagaaacatctggctcttcctacaagaagtcagaagctaatgaggtctcactctggccctggcaagatctcacagtgtgccttggttctccctgtgtaaactgaggtagtccggctattccccagcgcccaggtgttgtgagtcctaataaatggtgaaaagcattttgcaaatgttctgtactatataaatgcatagtgcctaatatggagagtcttcaagcaaaaatgtgctctagctcaattcagaatactaattcacccattgttttcaaaagaaatgttttactaacctgtttttttttcttttgtaaaattagtttctagtcatttgaactgtttttattttgtgtatagaagtgatcaatagtatatattcttgcttgtcagagaatacccaagttgtattgttaaatgttaaaacaatggggttacataacagtatagttggatagggaggaagattctagctcaaaagttgcaaaatacagaaatacaaagattagctttgaattggagattgtactataaatagtagatgttaatgtggtggtttctagatatatactttatttttaagttacaagaaattgtcttttatttttgcagttttgaactatatgattctttacatgttttaaataaagtttttatcaactaaaaacaccacaaacggaaaaaaaaagaaaaaagaga

SEQ ID NO: 560267 - DNA, 115 bp, Homo sapiens
cgttaagtgctagcttgttagtcttgaatcctcaggcaagtcactttattgcctggctgcctcagatctcttactgttaaggtgggcatagatgaagtataaatgcgttgagtgt

SEQ ID NO: 560268 - DNA, 1214 bp, Homo sapiens
  misc_feature (898)..(898): n is a, c, g, or t
  misc_feature (930)..(930): n is a, c, g, or t
  misc_feature (965)..(965): n is a, c, g, or t
  misc_feature (1033)..(1033): n is a, c, g, or t
  misc_feature (1036)..(1036): n is a, c, g, or t
  misc_feature (1064)..(1064): n is a, c, g, or t
  misc_feature (1084)..(1084): n is a, c, g, or t
  misc_feature (1122)..(1122): n is a, c, g, or t
  misc_feature (1143)..(1143): n is a, c, g, or t
  misc_feature (1146)..(1146): n is a, c, g, or t
  misc_feature (1149)..(1149): n is a, c, g, or t
  misc_feature (1151)..(1152): n is a, c, g, or t
  misc_feature (1155)..(1155): n is a, c, g, or t
  misc_feature (1214)..(1214): n is a, c, g, or t
tggtgtgttgttgttcggtgtggggcgttgtctctggtctctgttggtttggtggtgtgttgtgtgggtggggggggtggtgcgggtgtgccggggcggtgtgttggcgcgctgggtgttgccttgcgtgggtctgtggggtgagcgtggggtgttggttgagtggtgtttggtctggggggactgcgtgattttgtgccctgtggttgtgagggggtactgggtgttgtttgcttgggggtgtgggttgggggcgggtgcgtagttgggacgtttggttggcgtctgcggctgtatctgtgttgttgtgttgtgtccgttgatataatcgggtttacttttaattaactttacccttgatgtatttctgtaccatagtagcgattgttaggttgacaactataggtaactgcggaagtgattccacatagtgttgtttcttctgattgcatggcttggtatttgcgtttcgtgcccgcggtaaacttttcatcgggtgctctataggtcacgctagggccctgtgggttggctgtaatgtcgtgcctcgtagtgttctcagtattttcgcctgccggtctgccgccatagattgatgtgtcgtggtcgtcccgtcctgccacgcatgtcctggccaccgtctcgagtacctcatgcactatcgtctctgatccagtgtgatggtccctagtcttgatagagtaaagtagaagcaagaagttcccgtgtgtttaaggccgtgtcattcaagagccaggtggtcgcggggacaaacgacgttcatcaaggtgcactgtcggcgatcgaggactgtgcgtacaccttgcgagtgttgccaatgctgctgccctgcatgaataacaagccctgtgagcctgtatgctaatctaccagaccnacaaagccaagcatgatgagctgacctatgtnctgatcctgactttggacaaggcccttcagccagnagactgacaaagtcatcctccgtctaccagagcgtgcacttgtgatcctaaaataagcttcatctccnggntgtgcccttggggtggaaggggcaggantctgcagctgcttttgcatntctcttcctaaatttcattgtgttgatttcttcctccnataggtgatctaatacttcanatngtncnntangcagctgtgcgtgtgctcgactcgttcgcgcgagtgtggttggtgttgtgtggtttggn

SEQ ID NO: 560269 - DNA, 842 bp, Homo sapiens
  misc_feature (54)..(54): n is a, c, g, or t
  misc_feature (87)..(88): n is a, c, g, or t
  misc_feature (105)..(105): n is a, c, g, or t
  misc_feature (115)..(115): n is a, c, g, or t
  misc_feature (132)..(132): n is a, c, g, or t
  misc_feature (139)..(139): n is a, c, g, or t
  misc_feature (148)..(148): n is a, c, g, or t
  misc_feature (153)..(153): n is a, c, g, or t
  misc_feature (162)..(162): n is a, c, g, or t
  misc_feature (164)..(165): n is a, c, g, or t
  misc_feature (169)..(169): n is a, c, g, or t
  misc_feature (178)..(178): n is a, c, g, or t
  misc_feature (185)..(185): n is a, c, g, or t
  misc_feature (188)..(189): n is a, c, g, or t
  misc_feature (260)..(260): n is a, c, g, or t
  misc_feature (264)..(264): n is a, c, g, or t
  misc_feature (270)..(270): n is a, c, g, or t
  misc_feature (305)..(305): n is a, c, g, or t
  misc_feature (370)..(370): n is a, c, g, or t
  misc_feature (375)..(375): n is a, c, g, or t
  misc_feature (430)..(430): n is a, c, g, or t
  misc_feature (480)..(480): n is a, c, g, or t
  misc_feature (553)..(554): n is a, c, g, or t
  misc_feature (663)..(663): n is a, c, g, or t
  misc_feature (676)..(676): n is a, c, g, or t
caggagtaggcctggacccaagtgaagcgcaggtggggtgtgaatcctagcgcngctggcttctcaggcataggtggtgacatactnncgccccacgttcccgangtaggaaccntcccactcactcatganctcaaancctacaggncggcnacacacatngnngggngcgaaaganacatccnggnngggcagccccaccgcagtccaagccagcagcagcttctccacaaaatcttccatcatctgatggctgtggntttnggttgntgccaagcgcaggagctcttcatcccgggggacanttgggtagttgatggcctgcacatagatgccatgcttggagagcaggagatcacagagcttgctnttgantgctgcattgcccacccggatggggatgatgtggctggggcaggggatgacaggnaggcccctgtccatgagtagctggcgcatgttcttgatattgcgctggtnggctcgcctcagggcttggccctcctctcccttgagcagccgcacagattctagagctccagagagcaccatnnggggcagagaagtggtaaagatgaagcctgcagcataggagcgcaccatgtccaccaagtcacgggtgctggcaatgtagccgcccacacagccaaaggccttgccaanagttccagagatnatgtcaatcttatgcataattccatcacgctccccaatcccagcgccccggggacccatacagtcctacagcatggacctcatccacgaaggtcagggccccatactggtgggacacatcacacaactcctcgaggggacagatggcaccatccatggagtggaca

SEQ ID NO: 560270 - DNA, 470 bp, Homo sapiens
  misc_feature (172)..(173): n is a, c, g, or t
ccatagaaagaaaatctaaattaatctagtaagtgtatgacctctcaccattttaagaggtatcagattcatttgcactattaggaatgctagttttgtgcaaaaataatgccttacctgttttttcccgcatttaggttgaaaagctttcaaatgttccaagttatgctgnncccaaaaaaacccaaccaaaacccaaaccaaaaatattaaaaaaaaccccccccaaaaacaaaacccccaaaaataaaaagccccccctttttattcctgcttcgaaatgcaaatggatagagcccggtttttctgacagtataatgatagctttgtgagttagtttcatgtcatgctgggaactctttatgaggtggccataaccagcccaaacacccccttgcgttttattagtatggaaccatttgcatttgttttttttaagctttatctttccttgtgcatcctggccaaga

SEQ ID NO: 560271 - DNA, 377 bp, Homo sapiens
ggatgaatagtggagtaggaatatcagtagtgcatcggagcagagaatagctgggcccatgttcacttccaaatctgaatagaaaccatcatagtgcctcgtagtcctggaaacattcagacaacagaattcagggaaaagtggtccagcctagccatgtcaacatattataaagctatcacagttcaccctgtatcagcctggcacctatatacagccctatttaaatgtgacttaatatccaagataaggacaaccttatgcttgcatctacagtgataaaactaatctgtgtacagactgaaaacattctctccccgttctccaaaagtgtctctttttggtcttgagtgatattctttctgctccaactcata

SEQ ID NO: 560272 - DNA, 207 bp, Homo sapiens
gcgtctctagaggttccccgcacgctctctctgtggtgggaactgggttctgggttcacctctgctgctcatggaacgtctctcagttgattatggccaccaagtccaagctggagttctctatttaccctcgcgccccaggtttccacagcatgtatttcatgcccctacaacgtccatccctcaccacccactaccacagagtcg

SEQ ID NO: 560273 - DNA, 128 bp, Homo sapiens
tgtactaccccctataccttctgcataatgaattaactagaaataacttatgcaatggagagccaaagctaatgacccccgaaaaccagacgagctacctaagaacagctaaaagagcacacgtggta

SEQ ID NO: 560274 - DNA, 1451 bp, Homo sapiens
  misc_feature (41)..(41): n is a, c, g, or t
agaaaccacgccgtgcccccttcagcttttcccccctccgncgcatttttccatctccccttgagtgagtggatgtcccgttgccttttctcagctttgcgcgacgtggtcccacaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatgttgtctgcaggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtca

SEQ ID NO: 560275 - DNA, 1402 bp, Homo sapiens
  misc_feature (41)..(41): n is a, c, g, or t
agaaaccacgccgtgcccccttcagcttttcccccctccgncgcatttttccatctccccttgagtgagtggatgtcccgttgccttttctcagctttgcgcgacgtggtcccacaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatgctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtca

SEQ ID NO: 560276 - DNA, 426 bp, Homo sapiens
  misc_feature (68)..(68): n is a, c, g, or t
  misc_feature (241)..(241): n is a, c, g, or t
  misc_feature (276)..(276): n is a, c, g, or t
  misc_feature (278)..(278): n is a, c, g, or t
  misc_feature (329)..(329): n is a, c, g, or t
  misc_feature (351)..(351): n is a, c, g, or t
  misc_feature (354)..(354): n is a, c, g, or t
  misc_feature (404)..(404): n is a, c, g, or t
  misc_feature (426)..(426): n is a, c, g, or t
atcgcttgaacctgggaggcagaggttgcagtgagctgagatcccaccactgcactccagcctgggcnacagagtgagactcgtctcaagttaggctgggcacggtggcttacagctgtaatcccggcactttgggaggcccaggcaggcggatcacctgaggtcaggagttcaaaaccagcccggccaacatggtgaaaccctggctctactaaaaatgcaataattagccaggcgtggnggtgggcacctgtaatccagctactcgagaggctnangcataataaattgctcgaacctgggaggtggaaggttgcaagtgaagcccnagatagcacccattggacttcnaancctggggttgaccagaaccgaggacttgcatctttaaaattaaattaaanttaaaaaaattttaaaggtttn

SEQ ID NO: 560277 - DNA, 1109 bp, Homo sapiens
taacaataattagtgatagttaccaattatggcagtagttaccatatattttcaaatgttttgctgacgttacttcatttcatccggctaaatggataaccccattttttgggtgagggtcatgactaaagttgcatagcttgcaggtggtgcctgatgtccacaaaaacttcgtttaggaaggtgcggggaagatgggctggggcccactattccagggggcggggctgggctggggtggcctggaccccaactccagcccaccctcagttgtctgcaggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtca

SEQ ID NO: 560278 - DNA, 434 bp, Homo sapiens
  misc_feature (29)..(29): n is a, c, g, or t
tcatgcaagcaactggcatttccttttgnttcaaagcagagagctacaggttaaaaggttaggatatctcccacaggtagctactgtatgttccaccttatcttatgtaaagtgcccagcttactgagcataagccaatgcatacttgactattcccctacctgctcattttgtcttggaacatctgaatgacaagttcctctttcccctccagcccacttttcccctttagatactgaagccctcaaagtcatcttgggagaaaggcacagacaatagactgtttctgtgattctgtgttttttttttttcctcccaggcattctccttagcctggcaaaataaatttctaagttgattaaaacctgtcatagatactttttggtttccaaaatattataaatggtggttctattttcaggccaaaagcctag

SEQ ID NO: 560279 - DNA, 603 bp, Homo sapiens
aaaccacagtggccaggcatttctccaggcctgcctcccccaggagctggctgcaagtgccagaaacctagccactgggtcaaggaatgcccacagcccaggattcctcctaaaccgtgtcccatctgtgcaggaccccactgaaaatcggactgttcaactcacctggcagccacttccagagcccctggaactctggcccaaggctgtctgactccttcccagatcttcttggcttagcagctgaagactgacactgctcgatcgcctcggaagcctacaagaccatcacagatgctctgggtaactctcagagtggaaagtaagtctgtcaccttcttaatcaatatggaggctacccactccacattaccttcttttcaagggcctgtttcccttgcctccataactgttgtaggtattgacagccaggcttctaaacctcttctccccagctctggtgccaacttagacactactcttttaagcactccttttagttatccccacctgcccagttcccttattaggctgagatattttaactaaattatctgcttccctgactattcctgggctacagccacacctcattgccacctt

SEQ ID NO: 560280 - DNA, 213 bp, Homo sapiens
tcgctccagacattgtggaaatattcgtttaagacctccacgaaattgtgaatggactccaggtagccaggttgttgtcattgacatccacacagattcagaagtagcaggccagcatagcggcggtaaatgatcttaaagtcccggaactccacaaagttggtgtgtatggcgtctcggacggtgaccacggcatgcacctcctcgatcagc

SEQ ID NO: 560281 - DNA, 1654 bp, Homo sapiens
  misc_feature (41)..(41): n is a, c, g, or t
agaaaccacgccgtgcccccttcagcttttcccccctccgncgcatttttccatctccccttgagtgagtggatgtcccgttgccttttctcagctttgcgcgacgtggtcccacaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatgttgtctgcaggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtcaaaaaaaaaaccaaaaaaaaactccggggcacctatccgggggccggaaaaaggggtccgcaatgggccctgctcaaagctgtccctggaccccactttcttgttccacgcggtgaaatccccgggtccccttatgtcgggtcgttttaattcgataaccagtaactgagaattctccatcacaaaaccaaacaccacaacgga

SEQ ID NO: 560282 - DNA, 1368 bp, Homo sapiens
  misc_feature (41)..(41): n is a, c, g, or t
agaaaccacgccgtgcccccttcagcttttcccccctccgncgcatttttccatctccccttgagtgagtggatgtcccgttgccttttctcagctttgcgcgacgtggtcccacaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatgttgtctgcaggtggggctgcggcagttggacatgtccttgttgtgccagctgtggggcctgtacgagtcaatccaggactacaaacacctgtgccaagacctgagcttctgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtca

SEQ ID NO: 560283 - DNA, 453 bp, Homo sapiens
ggctatttaccagtgcgggaaaggacaatgcggtgattactgtctggtcggaacagatttgcacaatgaccagaagtgggaaaagcaggctggacacgtgggacatgagggctggggactacgtgttgtgaatgcgagcggttaagtcctggtcatcgcctcaagagcccgtggagttgtatgcttggccccaaaacctaccacaaattcatgggcttcaagtcctttgccgaactcccccaaccccctctgctggtcgaactgacagtagaggaggggcagcggctcaaggtcatctattgctccagtgctggcttccatgctgtggatatcgactcggggaacagctataacatctacatccctgtgcacatccagagccagatcacgccccatgccatcatcttcctccccaaaaacgacggcatggagatgcttgctgtctcacgagga

SEQ ID NO: 560284 - DNA, 160 bp, Homo sapiens
agcgtccacatccttcttcagagtcacaaattcattctctgctgctgtgcgctgtggatttcatcctcatatgtgttcttgaagtcctccgagcaggtcctgcatgcctctgagctctgagtccaggcggacccggttccccgcgctgcgaaccgtatgc

SEQ ID NO: 560285 - DNA, 287 bp, Homo sapiens
  misc_feature (208)..(208): n is a, c, g, or t
  misc_feature (287)..(287): n is a, c, g, or t
tagaggtctccattcatgctaccagtcgtatacagtcattagctacccccaagtgtatgggccggacagagagtagcatctgtgcggatatgattcaggaggaggtggtcagggaccctatctgaggggggtcatccatgggggcgagaagggtttgactgtaatgtgctatgtacggtaaatggttttatgtactatgtactgttangggtggataggttggtgggtatcctagtgggtgaggggtggctttggagttgcagttgatgtgtggatatatgtgcttn

SEQ ID NO: 560286 - DNA, 1482 bp, Homo sapiens
  misc_feature (41)..(41): n is a, c, g, or t
  misc_feature (1210)..(1210): n is a, c, g, or t
agaaaccacgccgtgcccccttcagcttttcccccctccgncgcatttttccatctccccttgagtgagtggatgtcccgttgccttttctcagctttgcgcgacgtggtcccacaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatgttgtctgcaggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccccggggaaaaaaaaaggggncatttcttttcgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtca

SEQ ID NO: 560287 - DNA, 256 bp, Homo sapiens
cttactttgatgtgtgcaactgttggcgctctggacacatgctggccagatgtagtttgcagacatgctctcaagatgggacaactaacaggcttctccatgatagggaatcctgttcgaacattgcaatccttgtatgcacagagtcctagacttgcacaggagcaccaagacacgcgtgctagacaggattctgagacatcacggatctgcactctcaagggtggccccatgtgctcgagggcgtcttggtggg

SEQ ID NO: 560288 - DNA, 268 bp, Homo sapiens
tactcgatccagtgtattggcaacagctaacactgagtgttcccgctgtactgagaatcatgctaggtgttttgcttatctcagtgaatccttgcagaacccctgtgagcaagatcccaatgttctcattttacagatgaggaaactgggactcagagaggttgaatgacttgcataaggtcacacagctagtaggagtcagaacaaggatgcaaacctggtattcttaagcactgtgatataccttttttgcggttttacttgtgaa

SEQ ID NO: 560289 - DNA, 328 bp, Homo sapiens
  misc_feature (61)..(61): n is a, c, g, or t
tgcagatgggccaccttccgccatcaattacaaaagtaagggcctgggcccctgcccaaancattcactgtctggcccacccagcccccacccccgaagtttgaaagatgcctttcctgaaatggacaggtgctgggtactccactggcccacccctgggctgtccgtctggtgcgggataccccaacaagggcccccgaggaggagaatccctgtcccccaatccccccccatcatgccattccgtctggtcttgtgccagtcagaacacagctcccaaggccagcacccctttgggtaaataaaagacagacatctgcagactttt

SEQ ID NO: 560290 - DNA, 694 bp, Homo sapiens
  misc_feature (93)..(93): n is a, c, g, or t
  misc_feature (118)..(118): n is a, c, g, or t
  misc_feature (140)..(140): n is a, c, g, or t
  misc_feature (149)..(149): n is a, c, g, or t
  misc_feature (239)..(239): n is a, c, g, or t
  misc_feature (249)..(249): n is a, c, g, or t
  misc_feature (251)..(251): n is a, c, g, or t
  misc_feature (305)..(305): n is a, c, g, or t
gcctcgagcctgtgccgccgccgacgccgcttgtgggcccgactccgctctgtctgcttcgccaccttctccccgagcactgcccggccggcngcatggctaacgtggctgacacgangctgtacgacatcctgggcgtnccgcccggngccagcgagaacgagctgaagaaggcatacagaacgttagccaaggaatatcatcctgataagaatccaaatgcaggagacaaatttacngaaataagtntngcatatgaagtactatcaaatcctgagaagcgtgagttatatgacagatacggngagcaaggtcttcgggaagcgcagcggcggccgtggctggcatggatgatattctactctcacatttctccgcgctggcggactcgctccggcttcatgggccaatcagagtagaagtcgacctggccgcacgaaccagcgacaggacctgactgcatccactcaaagtatctctagcaagatctgtataatggcaagacaaccaaactacaacttagcacagactgtgctctgtagtgcactgcagtggccaaggcggacagtctggagctgtccaacacgtgtacgtgctagtcgaggttcgaagtgtgcgcatcctgcctcagaccagcatgggcctcccaggcactggcacaacacgactgcccgtctggcgtgccccggctagc

SEQ ID NO: 560291 - DNA, 143 bp, Homo sapiens
tccgggtaagcctatactgggggcggggcgcttcgtgtggagcttccacctgcatgtacctggctccccaacgtgcacggcaggagctacggcccagcgccgggcgctggccacgtgcacgttggggacccggtacatgcaag

SEQ ID NO: 560292 - DNA, 422 bp, Homo sapiens
aaattcttgctaactcaattttatcatcagtagtttaatatttaaattgcttgcaactttaaaaacagcaccaaagttacctatgtagccatgtggtaactatcacaactgagatgttataaaatgcttctccatatggcattttaactcacttctgcctagtgtttcatcctcagtatctcattagggtccgttagacccaatctcagtttctgagtttctgttttaagtagtactatttataaaaattgatatctcatgacttttttcctctttccaacgagccaacaaacacaccacaacaccacatatttaacacaacagcataacattctatactccacttcccatctggatctactcgacctctttacgaatataacacaacttctgctctttcatcacacatacgacattaactc

SEQ ID NO: 560293 - DNA, 202 bp, Homo sapiens
attttgcggaaactaaacacaagtattcaggttgtgttgctttctgccacaatgccaactgatgtgtttggcaggtgacccgaaaattcatgagagatccaattcgaattctggtgacaaaaggaagaattgacccttgaaggaatcagacagttttatattaatgttgagagagaggattggaagttggatacacttgtga

SEQ ID NO: 560294 - DNA, 110 bp, Homo sapiens
  misc_feature (19)..(19): n is a, c, g, or t
aggtgatctccggattagncgacttaaacagcctcataagatgaggatctgcaaatacagcatcaggtatctatgtttttcttagcaataactcaaaaaaaggggggcgt

SEQ ID NO: 560295 - DNA, 322 bp, Homo sapiens
  misc_feature (210)..(210): n is a, c, g, or t
  misc_feature (217)..(217): n is a, c, g, or t
  misc_feature (276)..(276): n is a, c, g, or t
  misc_feature (283)..(283): n is a, c, g, or t
agagctagcaccatgagcttcaataccctgtcttgtctgccgccatgtaagacatgcctttggcttccgccatgattgtgaggcctccccagccacatggaacagtgaatctattcaacctccttttctttataaattacccagtctcgggtatgtctttatcagcagcgtgagaacaatagggtttcctgggatgcaggattttcagtnctcacancaggggagtcccagacaaggtggggcaaattggttgaccctagtcattagtaaggttanaagggantttcacgtgaagagatcagggaatgcttcgtggcccgcg

SEQ ID NO: 560296 - DNA, 549 bp, Homo sapiens
cagctttgctgggcccgcagaggtgcccaggcggctctgcccggaaggggttcaccccaataaccggagaatctccggtcgccacagccaagcacagcgcacgcccgggaaccccaaggaacacaagagaactctgaaatggggaaggaccctgagttgtggagaaagagcgggaggaagggtcacggagggtccggagccacactcggatcaggcgcgtccacgctgacaagcccgggaccaggtgccggcgataggcagcgccgtcctggacagtcccttccctttcccctacccgtcccctccccggcgagcaccgaagccaactcgggtcccgcgccagaattgccccccggcgccccctcacctaaaggcgggtccttccttaggagccctgccctgggcagacgccgccgcggagctgccgctgctgccccttttgttgaagagcttctggagcagggtcggggccatgatgccgccgccgcagctccggccgtggcgctcggggggccggcggctcagcgcgcagccgggggcggcggccgc

SEQ ID NO: 560297 - DNA, 1184 bp, Homo sapiens
ggatagagacgagagagaactagttgtgaggatgagtatctaactaagacgctacagagatgtgaggaacgaattgtgtcctcattcaagaaggatgtggatgaacgcttacaatgataagcatagggtagacgctggcatgtctgccgccctggaaacgggcttggaacccgagcagagatcagacctctcgctcatggcacatgtctactaatggagaggacggacgatcccgggattacttgacagctcgccatgatcgtcgtgcagcacgatccttgctggtggcatgctcctcactaggatcgaaacgaaggcgcagacgtactgcatggaatcgaattgggaccgaaggcactccaagtgtggaccttgaatgtgcttcagaggggacctagcaaaggctaaccgaagggcaagtaattttggcccaataggccaggcaaggcccgggggccttgaaagggcttgagaagcaattgttacacgcgaagacaattcaaaatggtcatgaaagggacaggtcatggctcagtgaagcacaatgggctttgtggagagacaggctgacagagggagtcgatgagacgccattgacagggtcagcaacaaatagaggaacgtggagaaaatccttcttgaaaaagatgaacacccgagaaaactaatcctagccagagtcactccacaggggtcgtacgaacggatttcagaagggtgcccttcaaaaaggggcccaaggaagggggcttcccccttggggaaggagccctggcccaatttggccaaggaattcgcctggatgacaaagcggttagggaagaatgcctatgggccctattcaaaacgggaattggccaaaaccggccccaaaaggttttgttccgagaaagcttggggaggggcctggccccttagcaagctgtgtggcccatatgccagaggaccaattgggctgcagtggcaagcgttgcagttgaagttacccaaaggaacgcttgcatagaaaccggttcaaggccttgggcccttgggaccaattccggaggaattcgcccaaccgttaccaagggaaaggcttgcttgtgaagggggccgaggggaaggaagcccgtggctgggaaagtcctgggggaattgcaaaaaaccattggaggttatttcaataccggaaaaggacccaa

SEQ ID NO: 560298 - DNA, 331 bp, Homo sapiens
ggtggccaggctcctcctccaggcaggactgacgtggttcctcgcaactatatggctgagcggcgaatccattgacaagtccatgcatgaagcagcataaagaggcaacttgagctggttgagagagtgtttggacaacagagatgagtgttagtggcttagaaaaagctggaagcactgccttatactgggcttgacacgggggacacaaagatatagaggaaatgctatttactcaaccaaatatagaactgaaccagcagaacaagttgggagatacagcttagcatgctgctgcctggaagggtaatgcagatatcgcgtcagttag

SEQ ID NO: 560299 - DNA, 127 bp, Homo sapiens
  misc_feature (24)..(24): n is a, c, g, or t
tgctgatgccacatccgcttgagnttggcaggcgagtgaagatgttgcccaaatcctggaccataacagtgtccttctcatacctaaaatggctgggcacccctccagcacacggtgcgttggccca

SEQ ID NO: 560300 - DNA, 535 bp, Homo sapiens
gggcttatttgttaggaacctgccgtccctgtataagtggggacggattcatcttttcttgggacaggcgggggcactctggatatgacctgatcggtgccgccttcaggaagagggtgttacttcccccagttcccccaggagtttgcccagaatgtgggccgcatgttcaagcaattcaacaagttaactgaggcaagggcagaggtgcagtccataatgggcctgcagggtttttttaaaaggggcatgaaagaggccttcggtgacaccaagttttttgttgtggtggtggagccccccccaatgagcctgcctggtgttggcctgagttcccaggagctgtttgggggccctggtgatggcccctgagggtggagcccccatggccagcccagcctggttttgttttttgtccggtcaccccatccccactcccctgggggcctgattcccactccctgggggccccatcccccagttcctcccaaaatggtttttatttttggggatttaataaaaacttccccagtta

SEQ ID NO: 560301 - DNA, 638 bp, Homo sapiens
  misc_feature (437)..(437): n is a, c, g, or t
  misc_feature (625)..(625): n is a, c, g, or t
  misc_feature (628)..(628): n is a, c, g, or t
tggggaggagaggagggttccaagcctctttcccaattaaaaggcccccttttgggaagaggtatagttttgggcccacggggcatggaaagtataaaaggtgtttgtggaagggggccgggctccttaggggtcctattttgcttcttgggtttgagtgtccagccggttggcaccttccatgtacccaggggagattccagccaaacacccgcccccgggccgtggttaagaagttgtttcttgttgccagcatgacctaccctcgcttttttgatgccatccggtgccacctccttttgtttttggaccctttagcctttttgcccttccattttttgaccccggcccccgccctccccacccagttccgttttttgttatttgggggaggaaaaaaattcttgatcattggccaaagggatttacccctgganaggccaagtgccttttaggaagttaggaggttgaggcccagcctgtgcaaaaagggtgggtcccccccccagatccaaggggaaattgcaggtcaagggttgataacggccatgcaggatgtttgatgttgggtcccccgttgtttgccgcccccccccccgccattttgtataataaagctccctgngtntttttatgta

SEQ ID NO: 560302 - DNA, 623 bp, Homo sapiens
cgcggactatttgtttgcagcttccacacacgcacctacctactacctctcctccatgcttactgggtatagaaaggtgagctatgcgtagaagaagctacttgggactattcagagtgctgatactttgaacgactaagcactatacgataaccagtctgaagactgcaaggagagactttgtctcctacacatactataagacaggtaaactaccgggtctgtacttgacgtctagtgcatatgaaatgacggtatttaatacaaaactacagaacatgcaaaattgtgggctgagatgttaagtattacttcaggggagaacaaacttacttaacctttcgctaatgcatgtagtaccagaaagcaaacatggttttagcttcctttactcaaaatatgaacattaagtgtagtgactttgtctgccacgtggttcagaaatacattataaataacctagttaaaaaaagaaactgtgaaccatcttggtcagtctatcctattctatgtatatatgtaattccctcaagcaatcgcttcataattatagggtataacaaaaggtcgagaaagaaacgcgcaggcgaaatagcctctactgcatcaccagcaacatcagg

SEQ ID NO: 560303 - DNA, 186 bp, Homo sapiens
tcacgtaggacgacaggccatgcctttcaagtgcatgcagctcacctgattgcatcctcaagtttccgcacagtgcccaccagaagttgtgcgacaggcctggcagaaggcagacatcaatactcatatactgacagggaatacagagctacacttcgtactactggtactagctatatacctgag

SEQ ID NO: 560304 - DNA, 235 bp, Homo sapiens
cattcacgcaactgccacgctggcagctgatcggcgggtttctggggccgatgtacgtggtggtattgaccctggccacaccgcacatcggcatcgcgatgaccatgatcgcgatcctctcgggccaagtgggcaagagtgtgttgatcgaccacttcggctggttcggcacggagcgcaaatgggtcaatggagaagcgctaggatcgcgtaggcgtagattgtggcggatctg

SEQ ID NO: 560305 - DNA, 199 bp, Homo sapiens
  misc_feature (2)..(2): n is a, c, g, or t
  misc_feature (4)..(4): n is a, c, g, or t
  misc_feature (22)..(22): n is a, c, g, or t
  misc_feature (35)..(35): n is a, c, g, or t
  misc_feature (39)..(39): n is a, c, g, or t
  misc_feature (42)..(42): n is a, c, g, or t
  misc_feature (58)..(59): n is a, c, g, or t
  misc_feature (61)..(61): n is a, c, g, or t
  misc_feature (84)..(84): n is a, c, g, or t
  misc_feature (86)..(86): n is a, c, g, or t
  misc_feature (142)..(142): n is a, c, g, or t
  misc_feature (170)..(170): n is a, c, g, or t
  misc_feature (186)..(186): n is a, c, g, or t
  misc_feature (193)..(194): n is a, c, g, or t
  misc_feature (196)..(196): n is a, c, g, or t
gnantcctgctactaattttgncggagagtgtttncccnggnttcaatgtgggctgcnncnttttgtgctccttctctggtttncngtgtaatgagttcataagctaaattttcagaaagaattttgtttaagattatgccncttatctacttgagagcaacatgtcttntcaatcatgggattgncacatgnnanata

SEQ ID NO: 560306 - DNA, 536 bp, Homo sapiens
tgaggatcccctatgtctcgatcgttatcatcatacagcatatccaggcttctgggtcaaagcactccactcatcagttcctcaaccaccccagaatttcaattttgatcaaccgacgtgatgaagaacttttccggttaattggaaccaatctggcaggtccaggatctcagacatatctccacgggctacaaaatgaagctgtacttccagactaacccctacttcacaaacatggtgattgtcaaggagttccagcgcaaccgctcagataatcaagaatgatctgtgggttaaccctctacgctactacctgagagaaaggggctccaggataaagagaaagaagcaagaaatgaggaaacgtaaaaccaggggcagatgtgaggtggtgatcatggaagacgcccctgactataatgcagtggaagacattttcagcgagatctcagacattgatgagacaattcatgacatcaagatctctgacttcatggagaccaccgactacttcgagagcactgacaatgagataa

SEQ ID NO: 560307 - DNA, 969 bp, Homo sapiens
  misc_feature (1)..(1): n is a, c, g, or t
  misc_feature (408)..(408): n is a, c, g, or t
  misc_feature (421)..(421): n is a, c, g, or t
  misc_feature (486)..(486): n is a, c, g, or t
  misc_feature (726)..(726): n is a, c, g, or t
  misc_feature (752)..(752): n is a, c, g, or t
  misc_feature (764)..(764): n is a, c, g, or t
  misc_feature (774)..(774): n is a, c, g, or t
  misc_feature (780)..(780): n is a, c, g, or t
  misc_feature (783)..(783): n is a, c, g, or t
  misc_feature (787)..(787): n is a, c, g, or t
  misc_feature (796)..(797): n is a, c, g, or t
  misc_feature (802)..(805): n is a, c, g, or t
  misc_feature (812)..(812): n is a, c, g, or t
  misc_feature (816)..(816): n is a, c, g, or t
  misc_feature (832)..(832): n is a, c, g, or t
  misc_feature (835)..(835): n is a, c, g, or t
  misc_feature (837)..(837): n is a, c, g, or t
  misc_feature (839)..(839): n is a, c, g, or t
  misc_feature (869)..(869): n is a, c, g, or t
  misc_feature (893)..(893): n is a, c, g, or t
  misc_feature (902)..(902): n is a, c, g, or t
  misc_feature (946)..(946): n is a, c, g, or t
natcagtagtgaagattcacttctacttaataacagcaaacttaatttctgaggggaaaaaaatggcgaagtcttatcccaaacaaatagcaagagaggtatcatcaaagagctaaaattttctttggcatggtaaagggggaaattgagtttaccaacttatttacatgacatttctctatattggtgagttatgcaatgccattttgttacataaagttgtttgatgttttttaatatgccttcatataaatattttattcaatatgttgtatttgtgaatttaacaaatgatattaaacacaaactacaatgcagacagacaaactctttgtatgccaattagcaatacataccaacagttcttgatacacaggtacctactacatgcagctcatcattgctgtnctcttcccatgcnacaggtgagaccagacacaaagtaaatgacctaactcaattacaaataacaaggacccctctgcnatatgtctaaacatatattagaagaaagtatttgacatccttcatagggataaatgcccttatagacaccccatatataaaacacaacagagatacacatttacataaatctcagtcatttacaaaaataaatcttgtcttaatttaaaccaataaacagacttgcaggggaaaaagaaaccagcaagtagggctaattatcagtaacaaatagatgggggtgtttgctctgtgtgtgtntatatatatatatatatatatatatntatatatttgtntaaagttttnttttgntgntgtnagttgtgtnnataannnnatttgantgtnttaaaagtaagtaaantantnanatagttggcacatattatgggatctatgtnttctgaaaataattggttaatggnagtaatctnatatattttaactgttcctgtaaaaaacaataggcttaagatgnaatacaacaaataaaaatgacaa

SEQ ID NO: 560308 - DNA, 122 bp, Homo sapiens
ggtgatttagaggatccccggctggtgtattcgtcctggtgctctggtgctagggattcgtgctggtgctgccgctgcgccctgagtcactgcctgcgcagtcctgccgctcctgctccatc

SEQ ID NO: 560309 - DNA, 241 bp, Homo sapiens
actagcgccttcaactggtaatccagtcagtaggcaactacaggggtacgccactgactgaaggcacaggaaggttggcagaaggaggaccacaaggctgttctctagccttcacctatggccaaaaatcattttgaggcacctcatagagattccagtgcgttaccaggagagcttgaagctcgaggtctcagagactgcaggctggatcaaggcctcatatgcaactgcctggccacca

SEQ ID NO: 560310 - DNA, 164 bp, Homo sapiens
ccggcccatgtcggcgctgtggtcgaggctcatcattgccttatctagcaattccgttcgctaatctataggaaggcatgaatgcgtacagtgactcctttacccttgagctcgttcttttcaatgacgtcttcttctattgagaagtatatttcagtgtcacc

SEQ ID NO: 560311 - DNA, 163 bp, Homo sapiens
atcgaactctactcccgctaatagctttgggatgagtgactgatcaagcctgcgcgacctcgccttaccccccactattaagctactgggagaactctctgtgctaataaccacgtactccagatcaaatatcactctcctacttacaggactcaacatacta

SEQ ID NO: 560312 - DNA, 431 bp, Homo sapiens
  misc_feature (19)..(19): n is a, c, g, or t
aaaaggtccatttaaaacncaacatagacagattgattttaatatgataaaatataaaagctcactgataggttttcagatttcatgttgcatctaaccagtacaaaaactaccacttgttgagttttggtatagtatcacaaaggaatagccacagttatctgaagagggtattaaaatcgtcctttcgtttccaactgtgtgaagctgaatttttaaatacattttaaccaaaacaacgcatcccaatagattgaatgaagaacatatatgggaatctggctgtcttcaattaagacagaagctgaggccaggcatggtgactcaagcctgtaatcccaacaccaccttgggagactgaggtgggaggattacttgagcccaggagttcaagaacagcctgggcaacatagtgagtccttgtctctgct

SEQ ID NO: 560313 - DNA, 276 bp, Homo sapiens
  misc_feature (104)..(104): n is a, c, g, or t
  misc_feature (157)..(157): n is a, c, g, or t
  misc_feature (170)..(170): n is a, c, g, or t
  misc_feature (193)..(194): n is a, c, g, or t
  misc_feature (219)..(219): n is a, c, g, or t
  misc_feature (244)..(244): n is a, c, g, or t
acgcgtccatttaaacaaaattaggtgtagggcccttttcccaaatgtatgtgtgacttgtccccgtacttaggccaattgcgcacgcatcccccacgtatatncaattatatttttcaaaacagtaccccgcaatattatgccttaatatgccctnacccatagttccnatttgtcatggctccggaatatnnttcggttgtttggtgttggtaccgnaagccatacgggttttcaaattttntttgtaggaccggtttggtttccatcggttaa

SEQ ID NO: 560314 - DNA, 1348 bp, Homo sapiens
ccggtaaaagagctgttccccatccccaggagctcctgtcctgtcagcctttgctgtgcgcctgtacctcatacaggagtactcgtgtcaccccgtgtgactcccctctgccatcgtgtgcttcacgtggccgcatgcatgcgcgcctctctgcatggtctctctggagaaaagagagatgtgtcgcctccggccagatccgactgtgggacaccccatacacacaagagaacacaatcgcaaagaaaataacactaaaagacgacacagaaacaccataacacgaaacaaacacaacacaaaacaaaaacaacaaaccccaacacagaaaacacaacacaacaaacgaaaacagagaccaaacacacaacgaccacaaaacaaaaaaaaacaacaacaaaaaaaaaacaaaaaacacaccctcgaaaaaacaaaccaaaaaaccaacccagcaaagcaccaacgaacaacacaaacaagcaccaccaccaaccaaaccacacaaagacgcaagcacaccaacagaagagaccagcgaccgaacgcggcagacaaaacgacgcaagacaagagacgaacacagaaccacacagaagaagacgaaaacaaaaacacagacgaaaaaaaagaaaacacaacaaaaagacaaaacgacaaaagaagaaagacaacaccgacaaaagcagcacgacaacaccgaacagcagaacagaaacacaaccagcagaaaagcaaagaaagagcaggagcaacgaagcagaaaggagaacagaccaaaaaagagcaacagaaaaacagcaagaagcgacacggcaaacagaaaccagcgaacagaccaccgacacacaccgaccaaagcggaagcaacccaggacacacgaggaacagcagcaacacgcacgacaacaacaaccaacaaggaaacaaagcggcagaccaagaggcagccgcaccgaaaacagaaagaacaaagcaacaacaacagaaacgaaagcagcgcaagccaaaaaagccaaaaacacaacacacaccccaaaacaaacaacaccgaacacgcagaggagcacagcccgagcaacacacgcacagcaccacaaacacacgccgaacacaccggacaccaaccaacgacacaaaagagagaacagacgcagggccaaacagaaagagaaaaaacggacagacaacccaaccaagaacacaaccaaaagcagacagaacgcacagcaacacaaacacacaacaaagccgaccaaccacacggaaccaacaagacaagaaccacagaacaccagcagcagcacaaacacaaacagagcaaacgaaagacacaagcacacgacgaaaa

SEQ ID NO: 560315 - DNA, 866 bp, Homo sapiens
gctcggataatcagcgtccagctctcaaggctgagtttgatcgcgcctgtcagtggaggaggacaccgtccctttgtccctcttggatgagagccccgcctacctcccgaagactggctgcgccccgggccacgccatcttggccccacactgggtggtctactcgttagctagtcccctcagccgtccgtgtctgcccccgtgcgcagcagggctcgggtgtctgcaccgtgtagtacataatagaagtggagagtcgtgggtggttgggaggaaaccgttcgatcatgacaacccactagatgtctgctggggcagatccgccactgtcctacccagttgccctatgcccagactctgagctgctcaccggagtcattgtgcgaaggaaacagtgcgagaaagtggcaacgtctaagagttctcagataaactcctcctgagggagttgcatcctaggcgaccctagcgaggaatatcatggctccaggcttgcttcactagcgtcgcaagcaccctcgcacgaccgtgtattcccacaacgcactagaggaacgaagcaggttcggttctggttcgtggtggagacgagagacaggcagcttccccgaactttccatacctgtgcgaggcagggtgacggacggttcacgtagaggctcacccaagatcgtacccagctgcgaggtgagaccagaaagccttgtgactcctggggcccagcgcctgatggctcctagcgcaggggtcgccgcgttcgtggtcacacggttctttggtgtaggcctccttgtttggtttgtcccccaaagggaagtggggccaagggggcccgggggaacgggggtctttgggacacgggcaac

SEQ ID NO: 560316 - DNA, 806 bp, Homo sapiens
  misc_feature (195)..(195): n is a, c, g, or t
  misc_feature (227)..(227): n is a, c, g, or t
  misc_feature (235)..(235): n is a, c, g, or t
  misc_feature (254)..(254): n is a, c, g, or t
  misc_feature (312)..(312): n is a, c, g, or t
  misc_feature (332)..(332): n is a, c, g, or t
  misc_feature (342)..(342): n is a, c, g, or t
  misc_feature (368)..(368): n is a, c, g, or t
  misc_feature (396)..(396): n is a, c, g, or t
  misc_feature (403)..(403): n is a, c, g, or t
  misc_feature (424)..(424): n is a, c, g, or t
  misc_feature (458)..(458): n is a, c, g, or t
  misc_feature (497)..(497): n is a, c, g, or t
  misc_feature (507)..(507): n is a, c, g, or t
  misc_feature (517)..(517): n is a, c, g, or t
  misc_feature (520)..(520): n is a, c, g, or t
  misc_feature (532)..(532): n is a, c, g, or t
ggagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatccaaaagcttctggaagcaatcagttcccttgatggaaacagactanggcggcaaattggctgagcaggtctgaggctnagtctganaaggtgtcacgagttcaantgtcagttctgaaggatcaggagaaaagctggtccttgcagatctgcttgagcctgtncaaacttcatcttctttggncactgtgaanaaagcaactgagtagagtcaaatcanagaagacagtggagttacctctgaacanagaaganattgaacggatccacagagangtagcattcaataaaaccgacaagtcctctccanatgggaccctgtcgtcctgaagaaccggccggcagagcnagctggtttntcccctgganganagaggagccagnccattgctcccatctgacacattgtgctcaggttgcgctcgcaacatggcacgaaactccccctggagcaggaccatttctccaaacttccctccataaagaacaagccagccagtgacagaccctttactgacccctgtggcaaaaggcctcttctccgagccatgagcctagaagacggccccagatgagagaagcagagcttccgagggctcggggatctgcagtccttatatggcgccaaggctccacagcaacgacgacaatacagtaa

SEQ ID NO: 560317 - DNA, 671 bp, Homo sapiens
agcagtgcagtggtggttccaaaatgtatgattgtaatggttcctatttgattaataaagatgtttcgaacctagttataatgacttaaaattcacagtccaaaaccgtgattacttttgcaccaacctattaacttccccagtcctatttcctgagccccagctccgtgacagctttgaaaaccaaaagccctcgttcattattaaaatcagcagcctacattgacaaactccacaagagacaaactcaaagagatccacacttagacccatcataatcaaacggttaaaagccaaagacaaaagagagaatcttgaaagatcaagagagaagcaagtcataatgtacaaaggatcctcaatgagagtaagagctgatttcccatcaaaaaccatggcggcagaggaagtgggatgatgtattcaaaatgctgaaagaaaaggattgccaactcaggagtctataaccaacaaagctatcctttagaagtgaaagtgaaattaaaacattcccagataaacaaaaaccaagagaatttgttgctaatagatctgtcttgcaagaaatactaaagagtgtgtatccagttgaaataaaaagacactggacagtgactcaaatccacattattaaataaaacagcactggtaaaggtacacataagtaaata

SEQ ID NO: 560318 - DNA, 562 bp, Homo sapiens
aagtgaggagtgcctctgcccggcccgccccatctgggaagtgtacccaaagctccgaagagacagtgaccatcgagaacaggccatgatgacgatggcggttttgttgaaaagaaaagggggaaatgtggggaaaagaaagacagatcagatggttactgtgtctgtgtagaaagaaggagacataggagacaccattttgttctgtactaagaaaaattcttctgccttgggatgctgttaatctataaccttacccccaaccccgtgctctctgaaacatgtgctgtgtcaactcagggttaaatggattaagggtggtgcaagatgtgctttgttaaacagatgcttgaaggcagcatgctcattaagagtcatctccactccctaatctcacgtacccagggacacaaatactgcggaaggccgcaggaacctctgcctaggaaaaccagagacctttgttcacgtgtttatctgctgaccttctctccactattatcctatgaccctgccacatccccctctttgagaaacacccaagaatgatcaataaatccta

SEQ ID NO: 560319 - DNA, 1013 bp, Homo sapiens
  misc_feature (339)..(339): n is a, c, g, or t
gagagagtcaggtggaggaccaaagagaagctcgattactcgcttcctcatgatagtacgcgcagtccaataggccatcatatctacgatgcaaggatggaatggatgagcagtcgctggatcaaggccacagaactaacgctggagtcatccagtgaatgaaacttatgacactggcgagcagcctgtcaggaggacggggactggatccgtggaggtgcgtcccagtgctggggctatcagttggataaggaatgtatcaaaagtcagctggacccatgtaggccgtgaattggtagagcttcagtatcgtgcatgtgacgtagccgaggagcaagncgccaatcgacctggcatccatgtgaccgactattcatgtggggatgaacagtactgccaatgccccggagaaggcatgccgacagcacatggtgacctggaccagaagatgccataccatagcagtgatcctgcattctaaacccgtcccgtcattaccagcaacgatggagcacatccactccgtcgcatggactggcacagagtccaggaagactggaagagaacaaagactgtcggataacgcaggcagctgcggcaaggagcatcgtgaacccgccgagcgagaaggtgagcatcgagcctggaagacataccagcactgtcaccctggagaaagccgtacctgcgcgaggactacttctgggccttgatccctgacagagggggacttcatccgcttccgcttcttccaacctctaagactggagcggatcttcttccgcagtgggaacatcgagcaccggaggacagctcttcaacacgtctgtggaggtgcttgccttcgaaaacctcagtcagacaaggaggcctgaggagcgccgcacggcaacctcaggtaccccggaacccgaaggtactccaatcggtcctctaaagggagtggaaagacaaggggaccagttaggcctggaaacaggaccttgaacaagaaccggggggaaacgaggaca

SEQ ID NO: 560320 - DNA, 289 bp, Homo sapiens
tcagaagactggagtctcgagttattttttgaacagctttacgatatgcttaggtaggcttattaaatttgctcctccaaacaatacttttctattggaaaacaagccctgtggagacgatccttccctcaacgttgcttcagtttaaccctatttctagacgtgacctagtaccactgccgaacttgtcaacctacccgggaactgaaacagttcacaacagtagactcctaccaagatgtaaccgaactaccttattctaaaccactcaccgactaccagcctcaga

SEQ ID NO: 560321 - DNA, 120 bp, Homo sapiens
atatcgttccacatcagtctgcaagtagctgagacgtacaggcacacaccaccacaccaagcaaataagtatggtgtggagacagcgatttgccaacttgcccgggctagtctggacctt

SEQ ID NO: 560322 - DNA, 954 bp, Homo sapiens
attgcaatatctcttccgaattgggtcaaaacattgggctccttcattatatgccccctttgggttggccacccctctttcgccgtggaacgctctgttggttaaaactcctcccgtgctgtgttttagaaaaaccgttctctcgcctctttctgcccttatccccttattggcccacaaatactcgtgagaagttaataatactcgctccgcccttataactctccttgaaacccctcctatccccttggaatattggtgcaccaaacaacagctgctttgtgtaccaaatacttaagaggggtccaccctgtgttgtaccacaaaaatgtgtgaatcccccgccccgcgttcggtcatatttttctccccctccccgcgagattgtttaagccaacccccccaatttcccaagggtgtcttgtaccacgagtcacaactttttaacgcccccctgtcgttttaaataataataaagctagccgccggcttcttagtcttaaaacacattaatgcattatcgcccaattagcctgctcgtattaccaaattctcccgccccaaaatgttgttgtttgagaacctattttcgcgcaaagactattatctcccccaggtaatatttatacggagatccccgaccatttttgtcccgtggagagaatttttcccctcctctaagaacaatggcccccccacgggaataattttgaagagccagcataatacgggtgagtagaatttgagacaaaaactatgggtagatctctctgggaaccacacagggggtctaaatttctctttttcttataaaaactcccgaggggtaattattccttggctagactagaataaaactcctctatgtttagtgagtcccactcgttcttgaccagcaattatgccgaggccacctatggataaaacaaaaaaacccttgccccccacataaca

SEQ ID NO: 560323 - DNA, 411 bp, Homo sapiens
  misc_feature (119)..(119): n is a, c, g, or t
  misc_feature (121)..(121): n is a, c, g, or t
  misc_feature (262)..(262): n is a, c, g, or t
  misc_feature (284)..(284): n is a, c, g, or t
  misc_feature (341)..(341): n is a, c, g, or t
  misc_feature (384)..(384): n is a, c, g, or t
ccctgcctcaccctgaagtgtcttgtccatccagctgcaggctcctgcaatctcaagctgctgctaaacggcctagacagcgtgatgcaatctgtttttcagcccagacccgcataggngngcatctgggcagtgattaggtggtgtaatccgaaagagatggggagctagatgggtgtgagaacagtaggggtaaagaccttttatcctccctactccaaggtgcaagaaagaaggaggaagcactgtgtacccttggggntgctccggccatgcctccaganactgggcgtaccccacagccttatctacttctggtcttcaggcctcatcttgacttncgttccctttctgtggcttttgatgttaggcccagctcagggnttatgagagactgtaggtgaaatgttg

SEQ ID NO: 560324 - DNA, 338 bp, Homo sapiens
  misc_feature (299)..(299): n is a, c, g, or t
ctgcggcgctcgaaactataggatcccatggcgggcttcgacatgtggactttacggacgtcataaggctgtgagtccgttaaagatggtatctttactaatacaagctattgtgtccgctaggcctatttcgttgctcgctcaggaatttgatagttcttgggcagtgacatgtgagtcgtacaatgttcagtgagcctcgggtgtcgtgactgtcactccccgcgctgagtaggggaagggagcctactagggtgtagaataggaagtatgtgcctgcgttcaggcgttctggctgnttgcctcatcgggtgatatagccgtcgtagacagaggta

SEQ ID NO: 560325 - DNA, 209 bp, Homo sapiens
  misc_feature (179)..(179): n is a, c, g, or t
ggatctgcccgccttggcctcccaaagtgctcggattacaggtatgggccatgcccagcaagaaggacacttctaatactagatagccataattttttatttttaatacgagataaggtttcacctatgtctggccaggctggtcccaaatctccatgaccaagcatggtgagaatccntgtctctactaaaaaatacaaaagcaaata

SEQ ID NO: 560326 - DNA, 315 bp, Homo sapiens
gtggtgcacaacctagggtcagtttgcaggtggtaagccatttaccaagatagttgtaggtaaagaagggcagatttattagagaaattgtgaaaatatgtgcagtgggcagctcagcagagaaggggctacctgcagagaggcaagggctggaggaaagttttatagggtcctgctgaagggtgctacgtgtggaatgaggtcattgtgcccgcaggtggtttgtgattagctgtctctaacaattgttcatacaataattgttcattattgttctcaacttggggctctccccaacctggggacccttcctta

SEQ ID NO: 560327 - DNA, 130 bp, Homo sapiens
ttcccccccccccccttttttatcttttaaaacccccaaatttaacccatttttttaaaaaaaaaccccccccccccccccccccattttttttttttaaaaaaacccccccccccccccccccccttca

SEQ ID NO: 560328 - DNA, 1078 bp, Homo sapiens
tcactatcatagtcactctggtgaatccaagcttaaacagacaaatccaatctacaacctcaacagggtgcaaatggggagggcagggcaacatctcttattgtgttattttgtttcagcttgcctccagcagaacagacagcatgtggctttccagcgtgggactgggggaaaagacccaatttccaagggggttgttgtccccttttgctcgggtgtgagagggctgatactagtgcattggttggacgcttgagcagcgggctgtgggcttgctcttgggcagcgttgcgcagctatacaacgcttagggtgcacaggtgggggacagcggagacttggtggcgccttgcccgtgggttgcctttgccctttccattccgtggtgccacccacttggacacaccaagaacacccaagccgtgtctgtgccgtgagtggcgcttcagccacgagcaaaggggcccaggccctttcctcgaggggcgaacaggggcctcatcttccagtgttcacaccagagggccagaatacaccaccttagggggctccacgagtgtagagcagtgtgccccccgtgggcctcaaccattctttgttgcacggccgacggacgcgcacgcaccggggggacacccgaaaacctcacaactcacgtgcaacacttcccgggcgttagaaggggtctcccccaagtgtgcgccactagacgtgtgcgaaacctttgcacaatgtgtgcacagaacgcgcccttgcgggagctcccccccacattcatgtggcttgcccccgtggagggaaccccttttgggccgcactttcaccccctatttaaaattttctacacccccccgctccacggattatggtggcgaacacgctatagcgacgctcacccccctcccctgtgcagcagacccacaaaacagcacaggggggctctccaactataacgtgtagggaaaacaaaaacgaggggggagatgggtcaagaaacgcggcctttgaggacgaacaacctttccgggggcgaaccacttctggtgcttacgaacccgggtctggctatatatgagag

SEQ ID NO: 560329 - DNA, 318 bp, Homo sapiens
  misc_feature (229)..(229): n is a, c, g, or t
ccacctcaacctcggccatagccaggacctcaggttgtcagccaccacacccacagctaatttttttggtagagatggggtctgtctctgttgctcaggctggggtgtagtaggggcacagtcatagctcatggtaaccttcaaggcctgtgctgaagcaattctcccgcctcagcttcccaagtaactgggagtataggtgtacaccacctatgccggcctcactgtntgcaaaactgagtcctaccgttagattggggttaattcctggtaatgtattcgtctataataaaccaccaacccaatgttgcattattg

SEQ ID NO: 560330 - DNA, 1167 bp, Homo sapiens
  misc_feature (41)..(41): n is a, c, g, or t
tcttgaggcctgactacgctaaccgcttttgccaaagtggnccattatcgaagaattcacaaaaaacaatagcctcatcatccccaccatcatagccaccatcaccctccttaaccttctacttctacctacgccctaagtctactccacctcaattcacacgtatctccccagtatctaacaaccgtaaaaataataatgacagtttgaacatacaaatacccaccccattcctccccacactcatcgcccttaacgcacgctgactcgctaccttatctgccccttttgatactaataattctttattgaaagaaaaagacagaaagacaaccatcgagtagagaaggaaagggaataaaggaacaaaacgagtgagcgccgccttgtccaatcacttgtctctccagtcagcggtggtctcgccgagaccctataggctactctgtgcgccacgcctcttgtggtgtgttgacaccaaggggtggtgccaccagaaatgttgtggcccctggctattggtaggcggcgcccttgaacgcttttgcgtgcgtggggctattcttgtaaagcttaaggctcccccgaggttggcggggcaaaaccacggggacgcctatgggcgcgtcgtccttgtcttgaggggaaaccgagtgaccttctgtgtccatctgtggctgtgggcgcgcgttgggagccttgtgtgctaggcgttgaccccaaacgcgcatctgcttaggacgcactttcttacaacgcttgctttggcgtgtgtagcgtttgcaagcgctttgtgcccttccttggcctggttccattgggtgtgctgacctttcccgagtctttcccgtgtgaacttctccgtggggacttgccccctggtttaggggcaccacgctttggggaggggaaggtttgggctggaagagccattcttttgaccacggggtgagggagttgtctcctcaacacatcaacactctcgcttcctttgacggacagccacttctcacaccttcttactcagaggcccccccttctcctttgggggaaaacacaacaagcactttggcaccacaagaagggttcccgggggaaccaaaaacgggggcataagcacatcccctcagaacccccccaaaaagcttttgcggggccccaaaggaa

SEQ ID NO: 560331 - DNA, 463 bp, Homo sapiens
aaaagacccgctgacgaagtgcatgtcccagagtcacccaggcggtgtgtgagcaagatcccgagcggctccagtgcccacactccctcctctttgttactctgcccctagtggaggcaggcagcccttttgtgctaaagaagcgcttcattattaaagactccacaaagcaaaactcaatcatattaagagcgagattaaggcaaaaaaaactatactactcagggacatatactggctatgaagtataaattcagtacaccagtgtctatatgtcgccttcctcttaaaaatatcacttttcaagcaaaagtatcccctataaaaaaggacactatggaaaaatttagagatgacagggtctctaaaaaatagttcccctaggagttgtcaaaaatcatcttaagaggctgtgtgccgtggctcacgcctgtaatcctagcactttgggaggccaaggcaa

SEQ ID NO: 560332 - DNA, 200 bp, Homo sapiens
  misc_feature (41)..(41): n is a, c, g, or t
tcttgaggcctgactacgctaaccgcttttgccaaagtggnccattatcgaagaattcacaaaaaacaatagcctcatcatccccaccatcatagccaccatcaccctccttaacctctctccctcactagacgtaagccttctcctcactctctcaatcttatccatcatataacacttggagtggataaaccaaaccc

SEQ ID NO: 560333 - DNA, 402 bp, Homo sapiens
tgggtaaaaaacaaaaaggcatactctgatttttatactctgttttggcaggtgctcttttcttgtgaatggagaattggatgaagccaagtgtggttaggaatgcagggaagagcctactagtgggttgatatttccctggttttaggaagcctgttgaagtttaaaatgtgtatccttgtggtggttaatctcttaagggaaatgtcaaattcttgtgacaagaaaacatttttcccttgggaagggctcaactttcaagacttggtatttggggttccccctcagtccctacatataacttccttctggctgaaactattatttaattccttcttttccagaagaagaggaaatataaaagaggtatttctaaaaagttttacaaaaaaaaaaacaaga

SEQ ID NO: 560334 - DNA, 602 bp, Homo sapiens
gatcccaggtcggaacaggggaggaaaactcacctgtacaaagtgtatttgacagggttgggaaatcatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctcta

SEQ ID NO: 560335 - DNA, 239 bp, Homo sapiens
  misc_feature (5)..(5): n is a, c, g, or t
ctttntcatcccccttcgtcaagcactcgagtagcgcctcacaggggccctccaccgtcaggccaggcacctgtgccggcgccttggtgtcgatggtgaagcgggcgggggagcccgcaactgcctccctgtgaggcccgggccaaaacgccttcaccttgctaggcttggttgggggccacatgtttccatgaggaaatggggctgccatggaacggggcactgccggtcattagtgt

SEQ ID NO: 560336 - DNA, 264 bp, Homo sapiens
gtgggctgcacctgcagcgggcttttgcagggttgcgttcggggcgtggtcgctgggaccatcatgttctcggtccgggacacagtgagcatgataaggaggtagagggcaggtgacccctggacgatttggggacctttgggacatctgattggacacagcatagcattggcgcagggccgtagagggtagagagcattgtcactgagggcccaaaactctctgtccattaattctttcaggggtggtactagtaggagatac

SEQ ID NO: 560337 - DNA, 162 bp, Homo sapiens
atcttcagaaatataactggcaagtggaaatgtttaaacagttcagatgatctttaatgcattggttatgtgtgggttactctcccccccccttggtcttaattcttacatgcaggaaacactcagcagacacacgtatgcgaaagaactgagcaagccagg

SEQ ID NO: 560338 - DNA, 815 bp, Homo sapiens
attgaagtggaggtgttctgacaatggatccagataaagatgactttctgggcagaatgaagctggatgtagggaaggtgtacaggctagcgtctaggatgatttggtaccctctacaaggtgggcaatggccaagtacacttgatgctagaatggctgtcactttagtacagatgcatgcagaaaacttggagcaggttctaacagtggaattggggagtctcctctcgaccaaatcccccgtcagctgccatacttagtattgtctacctggatcgggccctaggatcttcctctgcaagaaggggaacaaaggaaacccaaccctatggtacaactatgtacaattacaggatgtgacctcattgatgagcaatgtgctgtctacagtaaccaactgcccagttgtggagagtgaagcgtaccaggattcttcactacaagaccctcaaaagccagtgagctcgatgttgcaatgtgacggatgcattccagggccctgacttataggagcactgactgctgctctggcccgctgctgactgcccagcaatcatactggaacagtggttccagctcagcagtttctggtccaacatccagactctatactgcaactagtcaatgaggatcctggtgcttgggattcatccagaaatattgctaccccaactggtgactggatggtcctggtgatgggaagtgaacagagaaatccccaaaaatgcgcattgtgttacccacctatactgttaacgaaatctaacacattggggagagattagaggaccatgaaaaggccgacttatcgaacg

SEQ ID NO: 560339 - DNA, 352 bp, Homo sapiens
  misc_feature (1)..(1): n is a, c, g, or t
ntatgtcagagctacattcgcccacagggtagcgaagctcatggccaaggtctgggccaaggactgtgtctacatcaacttgcagcatcacagagccttccctaatgagatcagggtaaacctgcttgtcccaggcactgtacagcgacgtggtaatgtagaggcgcttcccatccagttagagctggatcatctgagggcctccagccacccgttttcccttgaccactaggggctctgtctgggactttagttcctcgtcctacagcacttgcacagggcctcccttaacaatgctgcctccgagaaagatctgtcctgtgaggcggggtctctgtgggtcagagatgtc

SEQ ID NO: 560340 - DNA, 408 bp, Homo sapiens
agtctgtggcttgggtgggcttgcgggaggtcactccgacagcttcttcagacgcttcttcagctcccgcgggaacttctccgtagcacctcttacacacgggcttcatgtcgaactccacaaacttgttcttcaggctgagcttgctgttgcaggtggagcaggagaagcagctcacacaccaggccttgttgagggccgacaccacatcgccttcaatcacatggctgcagttgtagcagacgtccccgaagagctggttgtagtgagtctcgcagtaggccaggcccttcttctcatagtgccggtgccccaggaatggcttctcacacttggcacagacaaagtgctccacgtgccactggttgcccaagcgcgttgaccactcggccctcgatggggcggcgg

SEQ ID NO: 560341 - DNA, 135 bp, Homo sapiens
ctacaggagcttaagaggcccaaggaggagtggagctgggtacaaaagccaaatagagactagaccaaaaaggcaagggagagcgagggcccgctaggcagtcagctacggtgcatagtgtggccgcagcgcagc

SEQ ID NO: 560342 - DNA, 579 bp, Homo sapiens
agtgggtttattaatgcacttcagggtaagtgccagtcttattttagcttcttctgggagaaatactaccaattattaataatcacagcaacattttcatttgacaaaaactgtgtgtgtgggtgtggtaggggggtattatttataggatactgcaaatataaactcaattcttggggtatattaacaacactgagcaacaatatttctttctaaaaatttcttttctttaagggagatctggttattactaacatggggcagggtaggtttaggaaaattactattttagtttcttaggggcaataacacagaaggtcagaaaacaagcaacaaaaactcttttttaggtcctctacctggccaccattttaaaaacacaaggtcctcatatatatagagatatttatatattactcggttaaaacacatttttacacactttacaggttattttaaggtttaggttataggcattcatgtgaaaggggtctattagggatggtcacttagaaatcctcactgtgattccacgcggctattggagaaatggagaagaccctttttagagcggtgctg

SEQ ID NO: 560343 - DNA, 514 bp, Homo sapiens
tatttttccacagggcaagattaattttctagctcgaaggtttaaggctcttagaacaatgctcgggtgattggaggacacagcgtgcgccggggctgcttacttgaccttgtcagaagacccttctcacccttccagggccctcaacacccgcttggctgaggtggagtgttgggcggaaagttcatcagcaccggttccaaggagtcaatggcaggaaacaagccagccaatgtcagtcctgcacaaaggttatctgaaacagctggaagaactgctgagttgacattgaaagctgatgtgactcgactcccagctaccattgcccgaatttcccccagttgctgtgaggctacagttgtcagagcgtagcattctcagccgccgtggcaaaccgggcacccgaacctaccccacagcaggtagcccagcagcagtgaagatgcagactgattccacctccaccgctgagcagtgacctttcctcactttctcttgtcccagcttctccccg

SEQ ID NO: 560344 - DNA, 889 bp, Homo sapiens
  misc_feature (3)..(3): n is a, c, g, or t
  misc_feature (5)..(6): n is a, c, g, or t
ttngnncgcggctccgaggcgtcacctcctcctgtcgcctggccctcgccatgcagaccccgcgagcgtcccctccccgcccggccctcctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaaggtgagaccaggaagggcagtgggcccagacctggcagggcccagaacctgacattcatcaaatctccccaccagaataagagtcccagaggagcttggtggagagatttccaccacatctttggaatctgttggcctttttgaagactagaaagcta

SEQ ID NO: 560345 - DNA, 4547 bp, Homo sapiens
  misc_feature (3)..(3): n is a, c, g, or t
  misc_feature (5)..(6): n is a, c, g, or t
ttngnncgcggctccgaggcgtcacctcctcctgtcgcctggccctcgccatgcagaccccgcgagcgtcccctccccgcccggccctcctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaagagccttactttgtccatgcggtggagtggggcagccatgtctacttcttcttccgggagattgcgatggagtttaactacctggagaaggtggtggtgtcccgcgtggcccgagtgtgcaagaacgacgtgggaggctccccccgcgtgctggagaagcagtggacgtccttcctgaaggcgcggctcaactgctctgtacccggagactcccatttctacttcaacgtgctgcaggctgtcacgggcgtggtcagcctcgggggccggcccgtggtcctggccgttttttccacgcccagcaacagcatccctggctcggctgtctgcgcctttgacctgacacaggtggcagctgtgtttgaaggccgcttccgagagcagaagtcccccgagtccatctggacgccggtgccggaggatcaggtgcctcgaccccggcccgggtgctgcgcagcccccgggatgcagtacaatgcctccagcgccttgccggatgacatcctcaactttgtcaagacccaccctctgatggacgaggcggtgccctcgctgggccatgcgccctggatcctgcggaccctgatgaggcaccagctgactcgagtggctgtggacgtgggagccggcccctggggcaaccagaccgttgtcttcctgggttctgaggcggggacggtcctcaagttcctcgtccggcccaatgccagcacctcagggacgtctgggctcagtgtcttcctggaggagtttgagacctaccggccggacaggtgtggacggcccggcggtggcgagacagggcagcggctgctgagcttggagctggacgcagcttcggggggcctgctggctgccttcccccgctgcgtggtccgagtgcctgtggctcgctgccagcagtactcggggtgtatgaagaactgtatcggcagtcaggacccctactgcgggtgggcccccgacggctcctgcatcttcctcagcccgggcaccagagccgcctttgagcaggacgtgtccggggccagcacctcaggcttaggggactgcacaggactcctgcgggccagcctctccgaggaccgcgcggggctggtgtcggtgaacctgctggtaacgtcgtcggtggcggccttcgtggtgggagccgtggtgtccggcttcagcgtgggctggttcgtgggcctccgtgagcggcgggagctggcccggcgcaaggacaaggaggccatcctggcgcacggggcgggcgaggcggtgctgagcgtcagccgcctgggcgagcgcagggcgcagggtcccgggggccggggcggaggcggtggcggtggcgccggggttcccccggaggccctgctggcgcccctgatgcagaacggctgggccaaggccacgctgctgcagggcgggccccacgacctggactcggggctgctgcccacgcccgagcagacgccgctgccgcagaagcgcctgcccactccgcacccgcacccccacgccctgggcccccgcgcctgggaccacggccaccccctgctcccggcctccgcttcatcctccctcctgctgctggcgcccgcccgggcccccgagcagccccccgcgcctggggagccgacccccgacggccgcctctatgctgcccggcccggccgcgcctcccacggcgacttcccgctcaccccccacgccagcccggaccgccggcgggtggtgtccgcgcccacgggccccttggacccagcctcagccgccgatggcctcccgcggccctggagcccgcccccgacgggcagcctgaggaggccactgggcccccacgcccctccggccgccaccctgcgccgcacccacacgttcaacagcggcgaggcccggcctggggaccgccaccgcggctgccacgcccggccgggcacagacttggcccacctcctcccctatgggggggcggacaggactgcgccccccgtgccctaggccgggggccccccgatgccttggcagtgccagccacgggaaccaggagcgagagacggtgccagaacgccggggcccggggcaactccgagtgggtgctcaagtcccccccgcgacccacccgcggagtggggggccccctccgccacaaggaagcacaaccagctcgccctccccctacccggggccgcaggacgctgagacggtttgggggtgggtgggcgggaggactttgctatggatttgaggttgaccttatgcgcgtaggttttggttttttttgcagttttggtttcttttgcggttttctaaccaattgcacaactccgttctcggggtggcggcaggcaggggaggcttggacgccggtggggaatggggggccacagctgcagacctaagccctcccccacccctggaaaggtccctccccaacccaggcccctggcgtgtgtgggtgtgcgtgcgtgtgcgtgccgtgttcgtgtgcaaggggccggggaggtgggcgtgtgtgtgcgtgccagcgaaggctgctgtgggcgtgtgtgtcaagtgggccacgcgtgcagggtgtgtgtccacgagcgacgatcgtggtggccccagcggcctgggcgttggctgagccgacgctggggcttccagaaggcccgggggtctccgaggtgccggttaggagtttgaaccccccccactctgcagagggaagcggggacaatgccggggtttcaggcaggagacacgaggagggcctgcccggaagtcacatcggcagcagctgtctaaagggcttgggggcctggggggcggcgaaggtgggtggggcccctctgtaaatacggccccagggtggtgagagagtcccatgccacccgtccccttgtgacctcccccctctgacctccagctgaccatgcatgccacgtggctggctgggtcctctgccctctctggagtttgcctcccccagccccctccccatcaataaaactctgtttacaaccaccggcaaaaaaaaaaaaaaaaaaaaaaaaaaaaaaaaaaaaaaaaaaaaaaaaaaaaaaaaaaaaaaaaaaaaaggggggggggcgacacaaaatgattctcccctgggggggccacatatataacccccccccgttttttttctcaaggggggtccactattgttggtgactatttataatcaagcacgacagcgcgccgcgcattatataaaaaagctcttacatgtgaggaaaccccgtgtgtacatggggtatactcttggggaagaagcctcacacacggggcgaggagagcacaaataaggggagacactctctcgaaaagttattcaaccctccggcaggatattaagatcaccagcgagagtgagtatatacgagcgtgtagaccacgcgctgcaattataccgccgagggtaaagaaagttgtagcccaagagagattatgttaaagcaaaacttaacccgagggggcggaattagaataagaacccaagagagaactaacattgcaccccaccagccactaaaaacacaagatatcatactagttatcaaacagaacagacacataaaaaagaaaaaatatcgcacattataaaaatcaatataaaaacaacactatataacatcataaataccaagatctaaactacacacccacagacagacgacaacacatactacacagacaaagaagataaagacagaaagctaactcgataataaatcaaaaactcaacaaagtattacacagagattcagaaaaccaacagaatgagcacgacatatattgaacgcgatcgtcaaactactccac

SEQ ID NO: 560346 - DNA, 4167 bp, Homo sapiens
  misc_feature (3)..(3): n is a, c, g, or t
  misc_feature (5)..(6): n is a, c, g, or t
  misc_feature (3918)..(3918): n is a, c, g, or t
ttngnncgcggctccgaggcgtcacctcctcctgtcgcctggccctcgccatgcagaccccgcgagcgtcccctccccgcccggccctcctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaagagccttactttgtccatgcggtggagtggggcagccatgtctacttcttcttccgggagattgcgatggagtttaactacctggagaaggtggtggtgtcccgcgtggcccgagtgtgcaagaacgacgtgggaggctccccccgcgtgctggagaagcagtggacgtccttcctgaaggcgcggctcaactgctctgtacccggagactcccatttctacttcaacgtgctgcaggctgtcacgggcgtggtcagcctcgggggccggcccgtggtcctggccgttttttccacgcccagcaacagcatccctggctcggctgtctgcgcctttgacctgacacaggtggcagctgtgtttgaaggccgcttccgagagcagaagtcccccgagtccatctggacgccggtgccggaggatcaggtgcctcgaccccggcccgggtgctgcgcagcccccgggatgcagtacaatgcctccagcgccttgccggatgacatcctcaactttgtcaagacccaccctctgatggacgaggcggtgccctcgctgggccatgcgccctggatcctgcggaccctgatgaggcaccagctgactcgagtggctgtggacgtgggagccggcccctggggcaaccagaccgttgtcttcctgggttctgaggcggggacggtcctcaagttcctcgtccggcccaatgccagcacctcagggacgtctgggctcagtgtcttcctggaggagtttgagacctaccggccggacaggtgtggacggcccggcggtggcgagacagggcagcggctgctgagcttggagctggacgcagcttcggggggcctgctggctgccttcccccgctgcgtggtccgagtgcctgtggctcgctgccagcagtactcggggtgtatgaagaactgtatcggcagtcaggacccctactgcgggtgggcccccgacggctcctgcatcttcctcagcccgggcaccagagccgcctttgagcaggacgtgtccggggccagcacctcaggcttaggggactgcacaggactcctgcgggccagcctctccgaggaccgcgcggggctggtgtcggtgaacctgctggtaacgtcgtcggtggcggccttcgtggtgggagccgtggtgtccggcttcagcgtgggctggttcgtgggcctccgtgagcggcgggagctggcccggcgcaaggacaaggaggccatcctggcgcacggggcgggcgaggcggtgctgagcgtcagccgcctgggcgagcgcagggcgcagggtcccgggggccggggcggaggcggtggcggtggcgccggggttcccccggaggccctgctggcgcccctgatgcagaacggctgggccaaggccacgctgctgcagggcgggccccacgacctggactcggggctgctgcccacgcccgagcagacgccgctgccgcagaagcgcctgcccactccgcacccgcacccccacgccctgggcccccgcgcctgggaccacggccaccccctgctcccggcctccgcttcatcctccctcctgctgctggcgcccgcccgggcccccgagcagccccccgcgcctggggagccgacccccgacggccgcctctatgctgcccggcccggccgcgcctcccacggcgacttcccgctcaccccccacgccagcccggaccgccggcgggtggtgtccgcgcccacgggccccttggacccagcctcagccgccgatggcctcccgcggccctggagcccgcccccgacgggcagcctgaggaggccactgggcccccacgcccctccggccgccaccctgcgccgcacccacacgttcaacagcggcgaggcccggcctggggaccgccaccgcggctgccacgcccggccgggcacagacttggcccacctcctcccctatgggggggcggacaggactgcgccccccgtgccctaggccgggggccccccgatgccttggcagtgccagccacgggaaccaggagcgagagacggtgccagaacgccggggcccggggcaactccgagtgggtgctcaagtcccccccgcgacccacccgcggagtggggggccccctccgccacaaggaagcacaaccagctcgccctccccctacccggggccgcaggacgctgagacggtttgggggtgggtgggcgggaggactttgctatggatttgaggttgaccttatgcgcgtaggttttggttttttttgcagttttggtttcttttgcggttttctaaccaattgcacaactccgttctcggggtggcggcaggcaggggaggcttggacgccggtggggaatggggggccacagctgcagacctaagccctcccccacccctggaaaggtccctccccaacccaggcccctggcgtgtgtgggtgtgcgtgcgtgtgcgtgccgtgttcgtgtgcaaggggccggggaggtgggcgtgtgtgtgcgtgccagcgaaggctgctgtgggcgtgtgtgtcaagtgggccacgcgtgcagggtgtgtgtccacgagcgacgatcgtggtggccccagcggcctgggcgttggctgagccgacgctggggcttccagaaggcccgggggtctccgaggtgccggttaggagtttgaaccccccccactctgcagagggaagcggggacaatgccggggtttcaggcaggagacacgaggagggcctgcccggaagtcacatcggcagcagctgtctaaagggcttgggggcctggggggcggcgaaggtgggtggggcccctctgtaaatacggccccagggtggtgagagagtcccatgccacccgtccccttgtgacctcccccctctgacctccagctgaccatgcatgccacgtggctggctgggtcctctgccctctctggagtttgcctcccccagccccctccccatcaataaaactctgtttacaaccaccggcaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaataaaaaaaataaattaaaaataaaattaatttataaattaatataatataaatatttaaaaatttatataaattaataaaatttantatttttacccaattcataatttttcatataaattttttttaccaaactctttactcccataattcaactcttaatcccaaactccacttttaaccccctatatcttcttttcaaactatccatattttcatcctaattctaatttctcaaaacttttccccctatctctactaacccactttaccacttatatttttcaccatcacatcttaattcccttactatctttattcttccttttccttcat

SEQ ID NO: 560347 - DNA, 894 bp, Homo sapiens
gggtattcctctccacccttcgagtgtttgctttccttattccttccctggtggtcacccgtccgtccttggcggatccgtttctcatatccgcgacgcgaatttggcttcgcttgctgaggaattgtgacatacgctgcctcttgactcgtgctatcttaactctgtactgtggcgtgttacccttcggtatatcgtgcgctccgttcattccatcgtgtacgtctttgttgaggttctttctccgagttgttggttatccgcaattctcactcgtattctcgttgtgttgttcttggcttccttccggcatcgactcatccaccggtatcgccctctgctcgcgtctgtctttgcgctatggtctcgcctcatgcgatggtccccttctatctctggtgtacttacccagcattctctgcgcgtgacagaatcccacatggtatctgtcagtatggacatccaagtgacgactccagactgtggcatcattcgcccctgttcatgcgttgataacgacaccccctggagtacaccatcgggcaaccgggcggcggagcgtagccctgcagtctggggctgctcttcccgcctgtcggaggtcctttgtcaggtgggcatagtggaccaggtgcgtccctggaaggaagcagcgtcgcagagctctgcagctgtcagcgatagctccacgtggatggccattccagaccatgctgcgacagctgaccaaggccatgatgcgaaaggccacggccagccgccgtggtcacgcagctgcgatgcggagcgtgcagaagcttcgtcagcttattctgccaaagactccatcgcagaagtacctgcagagtgaacttagagacggctcattagaagaaaaaggctaacgatcggtac

SEQ ID NO: 560348 - DNA, 2747 bp, Homo sapiens
  misc_feature (3)..(3): n is a, c, g, or t
  misc_feature (5)..(6): n is a, c, g, or t
ttngnncgcggctccgaggcgtcacctcctcctgtcgcctggccctcgccatgcagaccccgcgagcgtcccctccccgcccggccctcctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaagagccttactttgtccatgcggtggagtggggcagccatgtctacttcttcttccgggagattgcgatggagtttaactacctggagaaggtggtggtgtcccgcgtggcccgagtgtgcaagaacgacgtgggaggctccccccgcgtgctggagaagcagtggacgtccttcctgaaggcgcggctcaactgctctgtacccggagactcccatttctacttcaacgtgctgcaggctgtcacgggcgtggtcagcctcgggggccggcccgtggtcctggccgttttttccacgcccagcaacagcatccctggctcggctgtctgcgcctttgacctgacacaggtggcagctgtgtttgaaggccgcttccgagagcagaagtcccccgagtccatctggacgccggtgccggaggatcaggtgcctcgaccccggcccgggtgctgcgcagcccccgggatgcagtacaatgcctccagcgccttgccggatgacatcctcaactttgtcaagacccaccctctgatggacgaggcggtgccctcgctgggccatgcgccctggatcctgcggaccctgatgaggcaccagctgactcgagtggctgtggacgtgggagccggcccctggggcaaccagaccgttgtcttcctgggttctgaggcggggacggtcctcaagttcctcgtccggcccaatgccagcacctcagggacgtctgggcgtgtgtgtcaagtgggccacgcgtgcagggtgtgtgtccacgagcgacgatcgtggtggccccagcggcctgggcgttggctgagccgacgctggggcttccagaaggcccgggggtctccgaggtgccggttaggagtttgaaccccccccactctgcagagggaagcggggacaatgccggggtttcaggcaggagacacgaggagggcctgcccggaagtcacatcggcagcagctgtctaaagggcttgggggcctggggggcggcgaaggtgggtggggcccctctgtaaatacggccccagggtggtgagagagtcccatgccacccgtccccttgtgacctcccccctctgacctccagctgaccatgcatgccacgtggctggctgggtcctctgccctctctggagtttgcctcccccagccccctccccatcaataaaactctgtttacaaccaccggcaaaaaaaaaaaaaaaaaaaaaaaaaaaaaaaaaaaaaaaaaaaaaaaaaaaaaaaaaaaaaaaaaaaaaggggggggggcgacacaaaatgattctcccctgggggggccacatatataacccccccccgttttttttctcaaggggggtccactattgttggtgactatttataatcaagcacgacagcgcgccgcgcattatataaaaaagctcttacatgtgaggaaaccccgtgtgtacatggggtatactcttggggaagaagcctcacacacggggcgaggagagcacaaataaggggagacactctctcgaaaagttattcaaccctccggcaggatattaagatcaccagcgagagtgagtatatacgagcgtgtagaccacgcgctgcaattataccgccgagggtaaagaaagttgtagcccaagagagattatgttaaagcaaaacttaacccgagggggcggaattagaataagaacccaagagagaactaacattgcaccccaccagccactaaaaacacaagatatcatactagttatcaaacagaacagacacataaaaaagaaaaaatatcgcacattataaaaatcaatataaaaacaacactatataacatcataaataccaagatctaaactacacacccacagacagacgacaacacatactacacagacaaagaagataaagacagaaagctaactcgataataaatcaaaaactcaacaaagtattacacagagattcagaaaaccaacagaatgagcacgacatatattgaacgcgatcgtcaaactactccac

SEQ ID NO: 560349 - DNA, 899 bp, Homo sapiens
gttcctcggaggaaactttccgccggctggtccctcggtccgtgtcccgcccgtgctgccgcggcctgggagcccagcggggccggaggggcggcgggacccgagcgggcgggggcggcggacccagtgtatgcggccgcgggacgcgctggggccgggcagccgggaagcggggcgctgacggctggtaggggagctgcccccagagcagcatggatgccccgcgaagggacatggagttgctcagcaacagcctggtgcctacgcgcacatccggccaacccgagagcttcggcctctacttcgtgctgggcgtctgcttcggcttgtgtcaccctctgcctgctcgtcatcagacatctcgtggggcgcccgacccgcggcccggggccgggtcagcgccgggaccccgcagcagcagcctggagcccgaggagcgacgacgaggaacgaggaggacacggtgactcggctggccccgacgaaacgctgcgggcccgagctgtccagaagagcggaagggtgccctcaacgtcaggtcttcaagtcgggggaggaagctggagctgtgcgcagaggcctggagaagcgcgaacggatcctgcggaaatcctggcggacgggcagcgacttgttgggacgagtgagctgggccagcccaggcagggagctggggcgttgacaataatgtgggcccgtccggtgaagggtcgggtacggacgacaatgagtaagacccaactaggggggtcgcccaagccagggtagggggagccgaccctgagagcctacctgtgaaaaacagagagaggccacgcgactcctggacaaagaaaaaagaggccccacaacaaatgcgcgagacataggcgatagacaagctcacacacatgaggccg

SEQ ID NO: 560350 - DNA, 199 bp, Homo sapiens
tcagaattgttgcgacaccgtcaagctcgaagttacgccgcagatcgcgccggagggaactatcatcctcgacgtggacatcaacaaggacagccgggcgagaccacgcctgccggaatcgggatcaacaccaagcacgtgaagacccaggtactggtcgagaacggcggcacggtgctaatcggcggcatcttcgagc

SEQ ID NO: 560351 - DNA, 3248 bp, Homo sapiens
  misc_feature (3)..(3): n is a, c, g, or t
  misc_feature (5)..(6): n is a, c, g, or t
ttngnncgcggctccgaggcgtcacctcctcctgtcgcctggccctcgccatgcagaccccgcgagcgtcccctccccgcccggccctcctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaagagccttactttgtccatgcggtggagtggggcagccatgtctacttcttcttccgggagattgcgatggagtttaactacctggagaaggtggtggtgtcccgcgtggcccgagtgtgcaagaacgacgtgggaggctccccccgcgtgctggagaagcagtggacgtccttcctgaaggcgcggctcaactgctctgtacccggagactcccatttctacttcaacgtgctgcaggctgtcacgggcgtggtcagcctcgggggccggcccgtggtcctggccgttttttccacgcccagcaacagcatccctggctcggctgtctgcgcctttgacctgacacaggtggcagctgtgtttgaaggccgcttccgagagcagaagtcccccgagtccatctggacgccggtgccggaggatcaggtgcctcgaccccggcccgggtgctgcgcagcccccgggatgcagtacaatgcctccagcgccttgccggatgacatcctcaactttgtcaagacccaccctctgatggacgaggcggtgccctcgctgggccatgcgccctggatcctgcggaccctgatgaggcaccagctgactcgagtggctgtggacgtgggagccggcccctggggcaaccagaccgttgtcttcctgggttctgaggcggggacggtcctcaagttcctcgtccggcccaatgccagcacctcagggacgtctgggctcagtgtcttcctggaggagtttgagacctaccggccggacaggtgtggacggcccggcggtggcgagacagggcagcggctgctgagcttggagctggacgcagcttcggggggcctgctggctgccttcccccgctgcgtggtccgagtgcctgtggctcgctgccagcagtactcggggtgtatgaagaactgtatcggcagtcaggacccctactgcgggtgggcccccgacggctcctgcatcttcctcagcccgggcaccagagccgcctttgagcaggacgtgtccggggccagcacctcaggcttaggggactgcacaggactcctgcgggccagcctctccgaggaccgcgcggggctggtgtcggtgaacctgctggtaacgtcgtcggtggcggccttcgtggtgggagccgtggtgtccggcttcagcgtgggctggttcgtgggcctccgtgagcggcgggagctggcccggcgcaaggacaaggaggccatcctggcgcacggggcgggcgaggcggtgctgagcgtcagccgcctgggcgagcgcagggcgcagggtcccgggggccggagccgacgctggggcttccagaaggcccgggggtctccgaggtgccggttaggagtttgaaccccccccactctgcagagggaagcggggacaatgccggggtttcaggcaggagacacgaggagggcctgcccggaagtcacatcggcagcagctgtctaaagggcttgggggcctggggggcggcgaaggtgggtggggcccctctgtaaatacggccccagggtggtgagagagtcccatgccacccgtccccttgtgacctcccccctctgacctccagctgaccatgcatgccacgtggctggctgggtcctctgccctctctggagtttgcctcccccagccccctccccatcaataaaactctgtttacaaccaccggcaaaaaaaaaaaaaaaaaaaaaaaaaaaaaaaaaaaaaaaaaaaaaaaaaaaaaaaaaaaaaaaaaaaaaggggggggggcgacacaaaatgattctcccctgggggggccacatatataacccccccccgttttttttctcaaggggggtccactattgttggtgactatttataatcaagcacgacagcgcgccgcgcattatataaaaaagctcttacatgtgaggaaaccccgtgtgtacatggggtatactcttggggaagaagcctcacacacggggcgaggagagcacaaataaggggagacactctctcgaaaagttattcaaccctccggcaggatattaagatcaccagcgagagtgagtatatacgagcgtgtagaccacgcgctgcaattataccgccgagggtaaagaaagttgtagcccaagagagattatgttaaagcaaaacttaacccgagggggcggaattagaataagaacccaagagagaactaacattgcaccccaccagccactaaaaacacaagatatcatactagttatcaaacagaacagacacataaaaaagaaaaaatatcgcacattataaaaatcaatataaaaacaacactatataacatcataaataccaagatctaaactacacacccacagacagacgacaacacatactacacagacaaagaagataaagacagaaagctaactcgataataaatcaaaaactcaacaaagtattacacagagattcagaaaaccaacagaatgagcacgacatatattgaacgcgatcgtcaaactactccac

SEQ ID NO: 560352 - DNA, 452 bp, Homo sapiens
tagccatgtgagcattagcatttctcattttgctactttctcctgattgtagtcctatgagccaggcagtgctgcagcacatacatacttgatgtgtaatgctgtgatctatcttgctcagtcttcctatctttttgtagtgcgagacactgcccgaggccactcagtgaaaccggtggtggatgattccaaacaatggtgtctgccagcatacattccatcctgcattgcccgacgctccccctgctgttgtacatctgctcttggtctgttgctctgtgtaaaaccctgcccagctgggagagtcagctcggctggtgggctacacttcgatttgcagtgactccctgctctctttgtagtctctcctccctgctgagccctgaaggtacacactcccataaacctgagcaccaggagagcccccatccagccagatagcaagctgagag

SEQ ID NO: 560353 - DNA, 889 bp, Homo sapiens
ataaggtatgaaaatagtgtaaggtggtcacgttgtttgccacgtcaatagacagcaaagtacattagaaaacaggacttaggccaaacaaacaactactggcatactgaatacaacagacacgtatgattaatattaacatggtttccaacaggttgccgtgcaaaggaggactattactactagtcagcaggaaacagatgcattcagaacccaagcagaatactgccgaagatgtaacttaggattaataacaagttgacccttggccagtgtactcatgtatttctatggctgtgtgacaaattacgcccagaatttatgcaggtttaagaagaacaatacccataggctagtgtctgtaggctgcatggaagtctgggcacaggtgttggctcggagttctcgtgctcacgggtcttaaatggctgaaatagagggtccgcgcgaggacaactagttccttcatggtaggctctgtcggaagaatctgctgtctaagcttcattcacggttgttcgcgccggcaattctagttctttgctgcgctctcagctggaggcccctctctcacctcaaggctgcctgcagttccttcttatgtggtcccgctccagtcttcaagaccaggcttcctgctcttactcatgcttcatatctctctcccgtcctcctgtccttaggggcatatgattagctcaagacccgacagatatatttcaaggtccgattgtgcgatagaacataattgccggcgtactgtctcatctcatcatattcacgggattctggagattagctcattgaaccgtgggaagcgggccatttcccagattctggcataccaaggcaataactgcccatctcagctgtaggtggaatttttacc

SEQ ID NO: 560354 - DNA, 655 bp, Homo sapiens
ctcggctgggaagtcagttacgttctctcctctcctctcttcttgtgtgaacatggtgcggactaaagcagacagggtaccaggcgacttacagaaagagtggtggctgctcgagcccccagaaaggtgctgggttcttccgacctctggcactaattcgacatcagtatcatcgaggaaatgagcatgttcctgtgcaagctgatcaccacacaatgatgaaaaagaatagaacgttgactcatgcatctttgaataacgtgtccttgttgttaccctggtattctacaatgtgaaatttacatacatggtgttggtggccagattgagcttagttgaacaggcatttcttttaaaacatctagggtttacaattctcagatgttacaaagagtaggtgggtggaagatttgagaatttgtgaatgactaattatggtaacttagcttagtattgccaagactataatgcatcgtttggttttctgtttgaccagaattaagtgtctagttcttgctaagaatcaagtcattgcattgtgttctaattacaagtatgtgtgttgagattagcttaggattgttgtactgagaggacatttatgggagtatgattagttggaaatggtggccttattggtcctcccttctaaatt

SEQ ID NO: 560355 - DNA, 117 bp, Homo sapiens
  misc_feature (46)..(46): n is a, c, g, or t
  misc_feature (54)..(54): n is a, c, g, or t
gatcagaatgagctggtaccatagcactcgaggatctccgggcatnccgacgancgctcgaagttctccaccgtattcgccgaatgccgctccaggctgatctgcgcgaacatacag

SEQ ID NO: 560356 - DNA, 110 bp, Homo sapiens
cagtcctgcctgctcaggggttgctgggtgaccttctgcaaattacctcatctttctgggtttcaatttaagtatgcctgaaatgaggcggttgaattgatctccaaatt

SEQ ID NO: 560357 - DNA, 621 bp, Homo sapiens
  misc_feature (3)..(5): n is a, c, g, or t
  misc_feature (8)..(8): n is a, c, g, or t
  misc_feature (149)..(149): n is a, c, g, or t
  misc_feature (173)..(173): n is a, c, g, or t
  misc_feature (286)..(286): n is a, c, g, or t
  misc_feature (323)..(324): n is a, c, g, or t
  misc_feature (331)..(331): n is a, c, g, or t
  misc_feature (334)..(334): n is a, c, g, or t
  misc_feature (350)..(351): n is a, c, g, or t
  misc_feature (353)..(353): n is a, c, g, or t
  misc_feature (393)..(393): n is a, c, g, or t
  misc_feature (398)..(399): n is a, c, g, or t
  misc_feature (403)..(404): n is a, c, g, or t
  misc_feature (410)..(410): n is a, c, g, or t
  misc_feature (415)..(415): n is a, c, g, or t
  misc_feature (528)..(528): n is a, c, g, or t
  misc_feature (568)..(568): n is a, c, g, or t
  misc_feature (578)..(578): n is a, c, g, or t
  misc_feature (584)..(584): n is a, c, g, or t
  misc_feature (587)..(587): n is a, c, g, or t
  misc_feature (592)..(592): n is a, c, g, or t
  misc_feature (595)..(595): n is a, c, g, or t
  misc_feature (597)..(597): n is a, c, g, or t
  misc_feature (603)..(603): n is a, c, g, or t
  misc_feature (611)..(611): n is a, c, g, or t
  misc_feature (615)..(616): n is a, c, g, or t
agnnngcngagctgtctgcggtggcggcggcgcctctcgtctcccgcggcccagcgctcgcaccaccgttctccctccctgtcgcagccgcgccgccgcgcagcgccccagccacacgccggcgggcagaagccgcccgctctccgganaagtgataaccagaattcattgancgtggagaatttttaacacgacggtaccaaaaagagaaagaaaatgccgaaaccaatcaacgtaaggagtacactacaatggatgctgagctggaatttgccattcagcccantacaactgcaaacaactttttgaccaggtggtgaaanncagtggnttngcgtgaggtctggttnntngggctgcagtatgtagacagcaaaggttattctacatggnttaannctanntacaanggtancacagcaggatgtcacacaaagagaactcctttacagtcaagtttagagctaaattctttccctgaagatgttcctgaggaattattcaagaaataacccagagactcttttncttgcaagttaagacgcatcttaatgatgagatatattgnccgcagaaantgcaantcnttggnctncntatgcntgtccaangccnnagtat

SEQ ID NO: 560358 - DNA, 170 bp, Homo sapiens
cgtcatacacgtggacgtccgctaaacgacggtactctttacctactaacacacgctacttgtgtaacgctacgtcactacttacacgtagttgggcgctgggacgtttacacgttgacgatacgtacgagacactgcgcgtacgtacgattacggacttactactaaca

SEQ ID NO: 560359 - DNA, 238 bp, Homo sapiens
cggagtcgattgagggccagagcaggcactgtggttcggatcctgggcaaagtttcccacgttgagggtctcgatgactcctagatctctttcccagtgccatggtgaagccgaagctgctgggacaggagctaagcgaggcggacggcgatcggtgctgattcggcgcgatttgaggagctgctgctgcaggcctcgaaggacgctccagcaaagccagacaaccagaccaagaatc

SEQ ID NO: 560360 - DNA, 631 bp, Homo sapiens
agaaagaccacaatggcaggacaggcgggtggtgatcggacgagggaattccttttcctagtgcctaaaatcctttcctagaaatggtcacttgggaaccaggaagaatcagcaggtctctgcctcctaaggtaggggaaggaccacccggttcagcacagtgctttctctctgctctgagcaggtggggcattcctctagattcaggtttgggcagggtctatagtcctgccatggggctgttcctgtcccttcctcccctttgctggctactctggcataattcaaggtgtcttcttgccttggggatccttagtggatcaaaatggcaacatgggaatattgtcctccatgccccctccagaaggacctaggagagtagggtgagctttgcaaagtgagagacgaatctttctttcttttatttttaaagggcaggatgggtatgcttgggctttctccttctgtggccccggaggaaggagagactgaggcaaggcaaagtgatagtacactgaagcaggactggaaacacccaggaactgttcagaaatctcagaagaaatctgcttctcttcgatggaaagatataattaacgatcaagagctctaagaaaatggcaaagaagcc

SEQ ID NO: 560361 - DNA, 404 bp, Homo sapiens
  misc_feature (165)..(165): n is a, c, g, or t
  misc_feature (174)..(174): n is a, c, g, or t
ggcccccacttgtgttggtctcaaaacctttggggggtttttggggggcctccacacaagaaggggtgaaaacgggggaggggggccccttaacccaaccccccccgggggcccccccccttggggtgtgagtggctttttttccccccccccccaggggggccntttcccccnaaaaaaaccccccccctttttttttttggttttttttaaacccccgagggggggggggttaattttttttgggggaacccccaaaaggggttttttgggggggggggacccctttcccccttccaaaccccatttgggaaaccccgttttgggaacctggtttccggtttttttttccccacccagccccgggttttaaaggttttgaaaaaaattttttttctttttta

SEQ ID NO: 560362 - DNA, 287 bp, Homo sapiens
catccctgacagacgtgttgcaatgtcttgagatgagagaaggaaagaagtaggccgaggggtgtctgggatcgtgtagaacgggtggaaggggataatagtcggaaggggaggtgataccgagggggtcgtacgatcccggagagtgacaagaataggaggtggagtgctgctagggctgaaataatgaccggcatgatgaagtgaaaggaaaacaatcgtgtgagggtgggactgtgtactgagtccctcctcgatattcatggcaacaacgatcatctcagcga

SEQ ID NO: 560363 - DNA, 631 bp, Homo sapiens
gcgagtggtcgagcaactgatcaaattgccacagcgctttgtgttgttctgcgatgacctgtccttcgaagccggcgagagcgattaccgggtgctcaagagtgtactcgacggttctctggagcaggcgccggaaaacgtcctgttgtatgccacctccaaccgtcgtcacctggtgcccgagaaccagagcgataacgaaaactggaaaacgatagacggcgaactgcatccgaacgaagcggtggaggacaagattgccctgtctgaccgttttggtttgtggctgtcgttctacccgttcaatcaggagcacttcctggatgtggtcgagcactggatcggtgagttggcgagcaaggccggtttgcagtggcagcgcgatgaagagctggacatcctcgcggtgcgctgggcgaccggacgtggcaatcgcaacggccgttgcgcctatcagttcgcccgctattgggtgggcctcaagttgttggagcgtcaaccatgatcgatttgcaacagtccggagtcggccttaatggctacgccatgcttcatgcacagctggaatcgctgttggcggatgagcgggatttcatcgccaatgcggcgcagctttcggcgtttctattca

SEQ ID NO: 560364 - DNA, 103 bp, Homo sapiens
ctgcctcagccgcctgagtattcttggtagagatgcagtttcaccatgttgcccaggctggatagactttcaaatgttcctggcttatgatttatctagcctt

SEQ ID NO: 560365 - DNA, 926 bp, Homo sapiens
agcggaggaaaatacttgcaaactacccatctaacaaggtattaataaccagaatacataaggagctcaaacaagtctacagaaaaaaaatctagtaatccaatcaaaaaatgggcaaaagatttgaatagacatttctaaaaagaagacatacaaatggtcattagatatatcaaaaatgttgcccgggcatggtggctcacacctgtaatcccagcactttgggacgccaaggcaggcagatcacctgaggtcaggagttcaagaccagcctggccaacatggtgaaaccccatctctactaaaaatacaaaaattagctgggcgtggtgggatgcacctatagtcccagctactggggaggctgaggcaggagaatcacttgaacctgggaggtggaggttgcagtgatctgagatcacaccattgtactccagcctgggcaacagagtgagattccatctcaaaaaacaaacaaacaaaaaaaatgcttgtctctagccatcagagaaatacaaaggaaaaccacaatgagatatcacctcacactgttagaatggctattaccaaaaaaatgaaagataacatgtgttggcaaggatatggagaaaatgtcagatcgtacattgttggtggcattataaattagtataagacgtctttgaaaaacagtatgtgaggtccctcaaaagcctaaaaaataaaattgctatgtgatccagcaatcccactactgggtacacacccaaagaaactggaactcagtatgccggaagagaatgtctgccctccatgtccatttgcagcactagtaagaataaggctagctatgggaaaccacctccgtggtccgtcaacgaatgaatgggatttttaaatggggtacaatatcccatggaatgtattcagccaaaaaaaaaaatctc

SEQ ID NO: 560366 - DNA, 406 bp, Homo sapiens
  misc_feature (402)..(402): n is a, c, g, or t
gatactggtgatatttaaatggacactcattaggtgatacagttttccattacgcctaggggtgagaagtttggcatatttaagcttcagggttaccgccccattaaggcattcaaatatgtgaatatgcttacatcccagagactacatatatggcaacaaagaaaacaaagtcctggccctcagggagcttctaatccagtaaccacaatttggtggtatgttcacggcatacaagaaacagtggaaggtctgtcaaggtttacaacaatgaaaatttccccctaaattcctagcaggtcgcaaagtgctcatacgcaattcaaaagcagcgacaacctggggtattaggctctctttctatgtcagcagggatgcccacatggcagatgcccaacatgngggt

SEQ ID NO: 560367 - DNA, 841 bp, Homo sapiens
  misc_feature (559)..(559): n is a, c, g, or t
gcttgaacctgggaggcagaggttgcagtgagctgagatcacaccactgcactctgacctgggtgacagtgagactctgtctcaaaaaaaacaaaaaaaacccaactgaatagtattccagtctgtgtatgtaccacatttttttattcattcatctgttgatggacacttaggttgcttccatatcttggctattgcgaataatgctgcagtgaatatgggaatgcaaatatctctttgacatactgatttcagttcctttggatatatacccagtagtgggattattagacctaatggtggttctaattttaattttctgaagaaccaccatactggtttccataatggctacactaatttacattcccataagcaatgtacagggttccctttttggcacatcgtctctaaggcttacttttcatctttttaataacagccattctaacatatgtaaggcgatatctcattgtggttttaatttgcatttttctgatgattagtgattttgagccattttttcatatacctgttggctatctatgtgtcttctatngagaattagctactcaatccttgcccattttctaatgggtgttacttattatcgagtgttgcgtccttatattatatatttaggtgtaacccttatcgatcttgttgccatattttccccttcacgtgtttctccttgtgacggtctggtggcgaagctttgttgtgtaccctcgcgtccttttttggtaataagtcccggggcgggcaccctcccctggggcccggtcggtggggacccctttctctcaaaaaaagagggggcgaaggcggggggcgcgcc

SEQ ID NO: 560368 - DNA, 1789 bp, Homo sapiens
tcatggttctggtaacaatttaatgggcatggcggttcatctctttacaaaaaaactcagcccacaccctaaaatggtaagaccttggagaaaaagggaagaatgtggctccgttaacgcaagctacaatggcagggcgcagactcctagagaaggagacgcaagaatctggccatgggtcccacaccaaaagaacaagaggtatcaatttaattacagtggcgccacatcattggggacgagaagtgcgggtggcgcgcaacacagcaggcaaaaagagcctccggataaacaccttcaagacaattaccaacaaaccctgtgcacaagcggagccgccctttcttgagacacacacaaagagtgtctcacacacacctcaactctgaagcgacacgcagaactctgtgtgctagagggcgttatttctacctatattccactctccgtgtgttctgcagcctaagaaaaagtggcgagtgaaactcttaacacgagacggaagatttgtgcgcacagtcgtgctgtgtcacccgcaggggggcgggcaacaaacaccacataggtacaacgacacacacatgtgtcagacaaattctttctacaacatctctgtctgtggaacaataataacacgggcgcacaacacttataacaaatcccaaactgcggccgcactaattattacgcaccaacgcgtagcatctctcttatgtggcccacaaactctctaacacgggttgtatctggggcggcacacatctctattacgcgcacccaccggagaaaagaggggggggaacacagcattagcgacccccggcggtgtctattataccccgcccgcgttgtcgtcaggcaagccacgttgtcaaacacaacagagccataataagcagaggggcacaatcctaatacgaacaagacgcacctttgcgtcgggacattataacaaacgagggggcggcgtcacccaatcaagaaatgcgacgcatgcggggcagcacatcactaaaccacgggcagcaaccaccaggacaaaacttataacggtggacgccccggctcattcaacacgctgagggcgtatatatgatctgccaccaaaaatatgtcactgttgaaacagtatatatacacccacacgctttcatggcgaacagattccccacaaacaaacacggggaggtctttctacaaacgcactgtccagaaacatactgtataaacacacggcgccgcgagcacatatactacacagagtgagacaccgttcataaacctcaacagcaagttatatagctccaaaggaaaaaatctgtgtctacaacaacgcactaaatctttgactagtacgccattgtttaatcacctatcgcgggcagcggccgcaacattcaatattatctacaaccccagcgttggttaccccttaacatgtcacgatagataactctatattaatttcgaccacgataccaaggcacagcttcacacacgaacataatgcaaacgagcgagagaagccaccggcagacaaacataacagcacacctcgcacacataggcaaacaacacacgagccacaccgagccagcaatcaaccagaaggaatacgaaacagcaatcacaaacacaatccacccgatcaacaacaacgggcagggttagcacccccaacacatcgagcgcacgagaccaccacccaaacgcaacacagaagcgggaacctacacaaatcacagactagagcacaaagagacgatagcaaacaatcagacacacagca

SEQ ID NO: 560369 - DNA, 251 bp, Homo sapiens
gtgcagcggcggcacgtcatagactgctcggcacatgactctgccatccagagagagccggaggggcacggaacagcttgcagaggtaggatgcccagacgtgtctcgcaacttgtggccacacaggcgcccggggtagcgctggcactcgtagacatcgacacacatcctgctgatgccgtcaaatagtaacccgtcttgacttcgcagcggagactgccgggagagttcacgcagctcgcccctgagtt

SEQ ID NO: 560370 - DNA, 497 bp, Homo sapiens
aaataaaatgcattttctctcctataagagcttacggtctaatggcactttaggacatgcagagagaaataaagcacagtctgccacctgtaggagcttatagtctagtggcagggaataggtaaatattccataggtccagaaggctgtacattaggaatgaagaaaccacaaaattcaggaaggttcttatgaaccattcattcattgaagagttgtttttttttctttaaatgtctactatgtaccaggaccagagaacagttcttttttttcttttctattttttggagacaggggtctggttttgtcaccgaggctggagtgcagtgacacaatcttggctcactgtagcctcccaggctcaagcgatcctcccacctcagcctcctgagtagctggggactacaggtgtgtgtctctatacctgctcatttttctatttcttttgtagagacagggtttcatcatgttgctcaggctggtctcaaactcct

SEQ ID NO: 560371 - DNA, 293 bp, Homo sapiens
atctcccagcgtttagcacaacacatgacacccttaatttgacaatcctattcctcccctgcgcgcactactgctcattctatcaccccctctatatgatccccacctccaaatatctcatcaccaaccgactaatcaccacccaataatgattaatacaaactaacctcaaaacaaatgataaccatatcacaatcactaaatcatgaaccttgtctcttatactagtatccttaatcagcttcattgccacaaataaactcctcggatacctgtctcactcattaagacca

SEQ ID NO: 560372 - DNA, 2924 bp, Homo sapiens
atggagtgtgacaaggccaggtgacaggcctgacatgtggtgtccacatccagaagggagaccctggagggatgaccctccactgccaccccctcccatcaggctctggacaccctcgagcctcccaccatccaccttaccagatccccccaagagtccgggaagctcactcccccaggggaccaggagcacagccccttccattcctaacgggcctgactcccaaaggggggtgaggaaagaaaaagccatttcacatcgacttattcttctggccccaggcagcagcacagggcgcagggtgggcctctgcagacacgatggctccgtggtcagggaggggccacctcccatgtgcctggggaggggccctcccaagcccctgcgtggcagcgccaaggggttggagtcagccccagcacacacagggccctgctcactggtggccattgtcagcgccacctccaccttcaggagcctgccacgtgcctgccctcggtcacttagccctccctggcacgcaccactttgtccacacaccctgtgtgtaagtggtgacagcggtgacagctcaggcgtcacctgatcgggccgactctaagccttagtccttccttgtcctgttgcgccggacaagcctctgggaggcgacggtgggacagccacagggttcttggctcagcccccaggagtggggagctggggctctggacggaggtgggcactcgaggctggtgtggcctcctgggtgagggccaggctcgggagaggcagccaggcggccccaagccaccccaggaacaaagcaccagcacacacctccactggtttgctagggctgggagaagttggagtgtttctgtggtggctgtggcagcccacggccccaagaccctggcttccttctgctcccaccttttcaggccccttccccaacaagcagctactgtaggacccagtgggggctagggcaccagcagctgccattacccatgctgggtcctgatggttcctgaccagcctcaaccgtggattccaagctggggaaggaagaagcaggccgggagtggggagggagacagtgaaggacacccaaacacacacacacacacacacacacacacacacacacacacacacacacacacacagaaggaacagtttcagctttgtttcccagtaatctcacttaaaaagaacacttgggtttaccatgttcacataatctcgttgctctgagaatgaacttattcttcctcccagcttggccatgtgttcctccccattgcccaagtcccctcatgacatcatctcccactgccatgtcctttccttggggacctccaagtccctggagtttggggactgcagggtgggtggaggggcccacaagctctgcagggagccagaaggaaacggtctgtcccaccccagggctgagcacctcgctgggagatgatacccacacctggaaatagctcaagggccgcgtgaggccgcacgacacccacgccagtatgagacacctggccatgtggcattcctggccgactgctggcagctgcagactttgtcagccaggtgatgtccccgggatctctgggcaggcagggcacacaggaggcagctcacgctcactcatcatggcgaggcaggtcgtgtggaacttccttggtcttcctcatctgcgccccacccagcctggcagatggtgatgctgtgagtgccagggaaacacacacacgcacacacacacacatgcacacatgtacagacaggtgcacatgcctgggagagtctgtgctgctcagcttccgagggcagctccccaggtctccccccgggtctgcggtgggaggcgagtcttttaacatcagctcaaaccaaacaggatgaggagggcaaatcggccgtccccagtaaatcctagggagtccctccaaggcaaacagaaaatgcaccccagctttcgcttttaggggtttgagttgcgagtttccagtctgcggagtgcgatggccgggtgtaagtctgaaaccctctgggggagagaagccgcacagtgcaggggtacacatcccagatccactccccagctgtgaggcccaggcgcattccgcgttccccgcccatctccacctccgagggttgcgggaggctgagcagttagaaccgtggctggcatacggagggcactcggtaaacgtggctgtgctgagctgtgggcctcgaaggagtctcgcggggctgctgtaccaatgaccttgcactgggtggcctaaaacaacatgtgtttcctcacagctcgggggaccagagctcagaatctgggggtcacagaggagggtccatgctcatccaggtcagctctaggggctgcaggccacccctaatctaggatggtcttatgttgaggtccttaattacatccacaaagaccctttccccaaataagtccccacgcacagttcccagggacagcctctggggcagcatcaccacccactcagtcctccatgcacccccttgcgctatcacgtaacttggatcaggtccacgcgtgtggctttgcggctttcctttgtcacagcgtgtcacaactgttttcccgggtgtcactgctgtggtttgagtttgtgtgtccccagccttcatatgttggaacctgagacccaagaagatcgttataagacgtggggcctttggaaggtgattaagtcaccagggtccccattgaagcgcttgggaaaccatcgaggccccctcccctttgtcctctcaccttccgccgggagaggacacagcaagaggcacccactgggaggcagagagcagcccccactcccactgaggctgctggcaccgagaccctggacttccagcctccagaagcgtgagaaataaatgtctattgtgtgtcaatg

SEQ ID NO: 560373 - DNA, 3109 bp, Homo sapiens
atggagtgtgacaaggccaggtgacaggcctgacatgtggtgtccacatccagaagggagaccctggagggatgaccctccactgccaccccctcccatcaggctctggacaccctcgagcctcccaccatccaccttaccagatccccccaagagtccgggaagctcactcccccaggggaccaggagcacagccccttccattcctaacgggcctgactcccaaaggggggtgaggaaagaaaaagccatttcacatcgacttattcttctggccccaggcagcagcacagggcgcagggtgggcctctgcagacacgatggctccgtggtcagggaggggccacctcccatgtgcctggggaggggccctcccaagcccctgcgtggcagcgccaaggggttggagtcagccccagcacacacagggccctgctcactggtggccattgtcagcgccacctccaccttcaggagcctgccacgtgcctgccctcggtcacttagccctccctggcacgcaccactttgtccacacaccctgtgtgtaagtggtgacagcggtgacagctcaggcgtcacctgatcgggccgactctaagccttagtccttccttgtcctgttgcgccggacaagcctctgggaggcgacggtgggacagccacagggttcttggctcagcccccaggagtggggagctggggctctggacggaggtgggcactcgaggctggtgtggcctcctgggtgagggccaggctcgggagaggcagccaggcggccccaagccaccccaggaacaaagcaccagcacacacctccactggtttgctagggctgggagaagttggagtgtttctgtggtggctgtggcagcccacggccccaagaccctggcttccttctgctcccaccttttcaggccccttccccaacaagcagctactgtaggacccagtgggggctagggcaccagcagctgccattacccatgctgggtcctgatggttcctgaccagcctcaaccgtggattccaagctggggaaggaagaagcaggccgggagtggggagggagacagtgaaggacacccaaacacacacacacacacacacacacacacacacacacacacacacacacacacacagaaggaacagtttcagctttgtttcccagtaatctcacttaaaaagaacacttgggtttaccatgttcacataatctcgttgctctgagaatgaacttattcttcctcccagcttggccatgtgttcctccccattgcccaagtcccctcatgacatcatctcccactgccatgtcctttccttggggacctccaagtccctggagtttggggactgcagggtgggtggaggggcccacaagctctgcagggagccagaaggaaacggtctgtcccaccccagggctgagcacctcgctgggagatgatacccacacctggaaatagctcaagggccgcgtgaggccgcacgacacccacgccagtatgagacacctggccatgtggcattcctggccgactgctggcagctgcagactttgtcagccaggtgatgtccccgggatctctgggcaggcagggcacacaggaggcagctcacgctcactcatcatggcgaggcaggtcgtgtggaacttccttggtcttcctcatctgcgccccacccagcctggcagatggtgatgctgtgagtgccagggaaacacacacacgcacacacacacacatgcacacatgtacagacaggtgcacatgcctgggagagtctgtgctgctcagcttccgagggcagctccccaggtctccccccgggtctgcggtgggaggcgagtcttttaacatcagctcaaaccaaacaggatgaggagggcaaatcggccgtccccagtaaatcctagggagtccctccaaggcaaacagaaaatgcaccccagctttcgcttttaggggtttgagttgcgagtttccagtctgcggagtgcgatggccgggtgtaagtctgaaaccctctgggggagagaagccgcacagtgcaggggtacacatcccagatccactccccagctgtgaggcccaggcgcattccgcgttccccgcccatctccacctccgagggttgcgggaggctgagcagttagaaccgtggctggcatacggagggcactcggtaaacgtggctgtgctgagctgtgggcctcgaaggagtctcgcggggctgctgtaccaatgaccttgcactgggtggcctaaaacaacatgtgtttcctcacagctcgggggaccagagctcagaatctgggggtcacagaggagggtccatgctcatccaggtcagctctaggggctgcaggccacccctaatctaggatggtcttatgttgaggtccttaattacatccacaaagaccctttccccaaataagtccccacgcacagttcccagggacagcctctggggcagcatcaccacccactcagtcctccatgcacccccttgcgctatcacgtaacttggatcaggtccacgcgtgtggctttgcggctttcctttgtcacagcgtgtcacaactgttttcccgggtgtcactgctgtggtttgagtttgtgtgtccccagccttcatatgttggaacctgagacccaagaagatcgttataagacgtggggcctttggaaggtgattaagtcaccagggtccccattgaagcgcttgggaaaccatcgaggccccctcccctttgtcctctcaccttccgccgggagaggacacagcaagaggcacccactgggaggcagagagcagcccccactcccactgaggctgctggcaccgagaccctggacttccagcctccagaagcgtgagaaataaatgtctattgtgtgtcaatgaccccggctcaggtgttttgttacggcagcaggaatggactgaaatgcatcactgaaaggtcttcacggccaggcacagcaactcacgcctgtaatcccagcactttgggaagcactcagcgtctgaggccagtagtttgagaccagtgtgagcaacacaaggagatcttgtctctacaaaaaaa

SEQ ID NO: 560374 - DNA, 123 bp, Homo sapiens
ttcatacacaccacacattcgaatgaaccctgtatacataaaatctacgacaaaaattgaattgaatctgaaccccccaaatgcttgtttcaatgccaaccccattgcctccatgactttttc

SEQ ID NO: 560375 - DNA, 712 bp, Homo sapiens
cactcacgtgtgagttcagcatctgtgaactggactttgcaacctcctgtggtctctcaggaaaccctagagatgttctcagatgacattgagaagaggaaacgtcagcgaccaaaagaaggctcgaggagagaacgccgccgagagcagcaggattgagatcgcggagaacaaaaaacagggacaaggatacccagaagtccacaattccccatcgagaaatctacagacaatttccatgccttcttattactatataccatgcatccatcatgcattcatgactattgacgatcccaccagacacacgtagagagacacatgaggagaccacatcatcacaatatatcataccatcatccaagacagacagaataccaagagatataccacaatgcaagaacaatatatacatgacatgaaaccaccatcatgatcaaccacaacatgaaccagaatcacagggacaaagatcaccatcaaataatactgccgatatggagaacgtttcgtgagaaaagacagtaccatcctcacacagtttcacgcgtgtccactatgtgacaccccaggcagctgccatgaagagggaatatggagcaaaaaaggcaacaaacaaggcgaagaattgtggatggggccccaaagacaacgtgacataccacagcagaaaaagaaatggagaaaacaaggcatatagggtgtccaatcg

SEQ ID NO: 560376 - DNA, 475 bp, Homo sapiens
  misc_feature (383)..(383): n is a, c, g, or t
  misc_feature (433)..(433): n is a, c, g, or t
cactgcgaaaccgatgtagccggcatataacagggggggatgcacaatcatcccgggatcttgcagcaacgggttgaggtcgttccctttttgggacggcaggcaggagacgtgcgaatgggttggaggtgaagaggatcagggcgaggaagccgagtgcaatcaggcccaggacgccaaggatgcgtgcgctcagggtggctgggagggtgtgggaacgtaaggcgacgctagcggtccatcctgccaggagcaatacccagagtaagagggatccttcgtgggcaccccacacggcggtagagcggtagagggtggtagcagtgaatgggagttttcggcgacgtattggacggagaagtcgttgccgaggaaggcattangtgaacagtgcgaatgcgccagcgagcagcttaagttgcacatagcggtngggcgtgcaacggcatcaaaccgtgcggcggcctgggcgcca

SEQ ID NO: 560377 - DNA, 1172 bp, Homo sapiens
ttgcgtcggcagtccgaggccagatcgctgagacaccataggggaaggtgaaggtcggagtcaacaggatatggtatgtattggggcgccgtggtcaccgagggactgcggtttaagctctggctacaagtggatattggtatgccatcggatgacccctgtcagtctgacctgcgactagcatggtttagcgatgtaccaggtatgagttcctgcactcatggacaagagttcgcatgtgccccggtcaatggcttgaggaacgggaagcgttgttcatctgattggaaatcgcgcatctaccaatcattccaggtagcggagatccgctcacaagaatcaagtgtgggcgatgctggcgctgagtactgtcgtggagatccactggcgttcgttcactcaccatggagaaggctggggctcatgttgcaggggggagccagaagggtcatcgatctcttgctcctcctctgctgatgcccgccgatgttcgtgatgggtgtgaaccatgagaagtatgaggagtaggcctcaagatcatcgagcattgcctcctgctccagcaactgcttatgagctcgtggccaaggtcatccgatgaccaatgttggtatcgtgaaaggactcatgatcactggtccatggcatcgactgtcaccgagaagcactggtgactggccttccgggaacatgtggcgtgatggcagacgggggtctcacataacatcatccctgtcttctattgttgctgccaaggctgatgggcaaggtcatacctgaagctgaacgggaagctcactggcatggccttccggtcgcatgccaagtgacacctgtaggactgaacttgcagttaaaaaaaagctggccaagtacgagtaagtcacaaagggatgatgacacaggagccgaagagggcccacacgaggaaccgtggcagacaaggttacacaaaacgtgcattgcttgagcccttacaagagcaacgcagtccaaacatatagctaggtgaggattgcctagacacaatgtgaggcatccggtagccacaagaccaaagaggggagagtaaacgcaagtaagacgcgcccacaacaaaaagaaactacagaaacacaaaacacaactacgagagagaacactctcaccgcgcctttcaacgagcgaacaaa

SEQ ID NO: 560378 - DNA, 1468 bp, Homo sapiens
  misc_feature (1391)..(1391): n is a, c, g, or t
ggttgcggacgacgcgtctgtagcttccttgttgtcctgtgccgtcagctgcagcccggtggagccaggtgcataaacggaagatgaccattctgtgactgaagtggcctgctggatgaggagtcattcgaccacggacagtagcgtgatcgttcagcatggtctacgagactacgacgacgtgagggcatgcccgatcaattaagagactcctaggaaagaatagccgcccaggcaggctcaatgttcttgcttggcgagacggtcatatcctggttcggacagcgaagattcatcggtgacatcacggaccattatttcaggactgagctcgtccagagggctgttccgagcgagagcaaccatgacgagtcgaggcttgaagacgagacgggtgggaggctatggtaagccgagtgggcttacaggtgtcacaaggtgagttgcggtggagccctgagtgattctctccgtcataggcaaaagtgtctagaaaggactcctacaagcctgtgcaaacgccttatgtgataatgcttcgcatggaggacacgggagggattccgaggcgtgccgtgccaaggtgagcaaagccagtagattccttttcttgcattaaaaccaatcacaactcattgcaaacgcaattgtcgtcatccacacacatgtccccttttcaaacgttattatccaccgaaagacgcgatggacccaaatgggtgctccgaggtctttgaaatacatctccaggcacacggggctacgccttttccccattgccaacccaattaggggccactgaacaggtaagattgggcgtgctctttacacaagccgcaattgccctccaaagactaacggcggtctgcacattcgaggggggcgtcccacacgcggcaaccacatcaagtgcaaggaaacgacctgtggagttgttttgagcttcgaaagtgtgtcgttgcccctgcaagcgaaggaatccccgctcccaaacggcataccaagagtatcctttggggatacggtgaacggactttgggcggaggaacacaaaagtacgcacggaacttcaattacttcttcaaagagcccgcacgaaagagagttgtgagagagaagctaactgggctacgcgcgcataagaattgcccccagcgcaaaagcgggaccgaaagtcgtattcgtctttgaattgcgagccaaacgaaaatttagcgaaatttcctcatgctacgagcggaaagcaagctagcatgtgtgggtggccttgtggtaccccatcgacgtacagacgtttaggcgcgcaattgcactacgtgttcctagagcaagtgttggcttagtatccccgatatgcttcagaggatgtaacccgccacaggattcgaccnaagttgtttccacacctgtgaactgagattgtccactacaggaggcaccacaaaccgtggcacaaacgctcccatgg

SEQ ID NO: 560379 - DNA, 1399 bp, Homo sapiens
  misc_feature (300)..(300): n is a, c, g, or t
  misc_feature (823)..(823): n is a, c, g, or t
agcggagccgcggtgttgtgctgtggggaagggagaaggattgtaaaccccggagcgaggttcgaggcatacccgaggctgcagcgatagcaggagacccccgtggtaaggtcccacctgacagacagagtacaaagcatgggaggtccgaaggtctagcaagcggatagacatagtgtgatatagaatggtgaatgagagagatatgagtaagatgctcataggtgcaagagtacagatataaatcgagatactacagctacaactgatgtataaaaaggaacaggcacgttacacaantaaatcactagattaatagcgagaagcgaatacgaatggaaaactatatgagatccacgtatgaggagacaggacatgaagaagactgatgagatgaggagcttaactgagaaatcgtagagaaaggagcaaacatcgcaaatggagacattaaaactaattgattgtcattggaaaaatattatatataatattggataaattgctagatgtatagtcgaaagataattggatgggctatgaactagatcattgagtgaggtaataattatcttaagttaaacggattagaagatctgaagattaccggcactgatacgcttagttattaattgatattggaaaggataagaaggggattatatataaggggggacaagtggaggttgggaaaagtcgtgaaaaattcattgataattatattatttgatccaaagttcttgcctctctagtgcgaacttggggagtatatttttcgttaagctaaaaggagaatcggattgaaaatattaaggcgatatgnaaacctaacctctattgatagaccaaaggatagaggaagtgtttgagttggatccacaaagagaagcgtaggaatatgtggggttattaaagaggagcaaatgggtcgacagggtggcccctcgggacgggtagaaaaaatctccgcgagacaatcgcgaagaatttaaagaaagagtaaaacctggaagaacgcatccagaaaagaatagtgaagcgagcgtcgaagaagtttggcaattaaatccaaaagatagcgtgagaaaaacaaaagttggcaggaggatatgattaaaagtaggttggtggagaagaaagagtcgaacgctcgaattgaggccagagaggttaaggagacccaagaaaaatataagagctatatgaaccccaacatagaatagtccgccataaagagagaaacccaaatctcaagagtaaaaggagaaaacaaaacaggccgaacccaataagaaaccgaatatatagagctatatagcacattgagagggcgggaacaaaaaacagctgggtgggagcactaagaaaaacaaagaagaccaaaatcacactcacatac

SEQ ID NO: 560380 - DNA, 871 bp, Homo sapiens
tttcacaaaaaaaggagacttctatttaaccagcaaaaggttgtaagggagggggtaaaaagggctatcctgaaaaattcctaaaccgaccccaggtcctggggcacatctatagggtgtcaggagggtgtgtgaaaacgggctcttaacgctgctaagggaggggaaatctcagggggctattaggtggtgatttggttaatagaacagaactatcactttggggcctattgtcctgggcatgtgggtggtgcgccggcagtgtgggcaaaatgtgagccgaccagtccactggttcagtcatatgccaaccacagatcttcagcagaatcttgccgggttaatcccctgaagttatcctcccgaaaaagtggctcggtggtaccaggcgaacttgggccgaacattccgcttttatactcgtgatcgtgagtgctccaggaaggctcggctcctcgtgtggcgagagaacaccagtgaatgcgaaatcgagggctccggctccattgggttccgtgccccccttaagtgggccttggtttgagcctcctccgaaaaaaaggggggggggtattcttggagaaacttttccacaaggggccagaagagccctcctccagggtcccggcgaatcccccgcgaaatgctcttctaaaggtccccggggggcaattctcgggtactcatggaaaccgggtaccaggggggcccggtctcggggagaaagaaccggatggaacttggactcgtctggtccagggggttcccccgggggggaataaagtcggggatccccagggcgaagggattgcacgtgggggttccacacggtgcctgaaaaaaaagagagcgcgaagcccgagtggaaaag

SEQ ID NO: 560381 - DNA, 1236 bp, Homo sapiens
  misc_feature (335)..(335): n is a, c, g, or t
  misc_feature (422)..(422): n is a, c, g, or t
  misc_feature (533)..(533): n is a, c, g, or t
ttactagctgctcggggagccgggccaggcaccggcttgggggccggtagcgcattcactccagactggagaaagccgacgaagttctccactggtgaccatctacttcatggaccgttgcctagatttgatcaggggtgcgatggttcatgggaggctggatctctcatgaacatatcatcttgtgtgctcactacaatcagctctaattcgcagatgatctggactaatgcattgacacccgtattcgagcgaccgacgattatgtacatgcctcgtgcagactgcagtggcctcaagtcatgtctcgattaatccctaaggacacgctaagnctagagtgtctcgcttcaccatatcacatgccattcgggttctcacatcatgaccatttgcaacctagaactcgatgaccgtctcancttgagtaccatctacctagctaagcctcaagctcctcctatctagagcgcagaatagtcgttattacaccagataccctggagaacagaaccatagattggactggtggnaactcagtctattaccgacaggtcatgtggtgtatcccttcgatagaaagagtagcggtcatggttagtacatctacgctgctcttattgagcggcgcgctatgaagtcggctatagtgccagatccctcttgactcagttggtgaggcctctcggtgaagtctgtccgtacgatcatattgtgtcctatgcttagaatcgctatccttagctcggtggatacggcgcttgaccaaatggaatacgagatagtcctgcataattccactggcccaattgctctatcgccttttgcgtcgaatggaagcgcgcgaatggcgtccagatggaagtgaagctgagtcccgcactgtggcacgtccagtttgcaagagtaccgggggtaatgagcgagtaaggtaacttctgggagagacccagattatcccaaaattgcgccgtttgccactttatcatccgactgaatgctgggattctaggtatgcaataaggagattgctctgtacctgattgcaacattttactaaaagtttggttagccatgagaaaacttcaaattagaaagttgagggagttctgatcaggatccgcgaaacagggggttttgaattgtgaccagggctaatagtgtttggtggaccgtttttgtgaccaagggggaattgcgggacacaaaggagggaagaattggaagcaagtatgg

SEQ ID NO: 560382 - DNA, 479 bp, Homo sapiens
aagccggctctgatttaggcgaggtccctgtgggcttccgcagtgttggtccctcggtacttgagattagggagtggtgatgactcttaacgagcatgctgccttcaagcatctgtttaacaaagcacatcttgcaccgcccttaatccatttaaccctgagtggacacagcacatgtttcagagagcagggggttgggggtggggttacagattaacagcatctcaaggcagaagaatttttctcagtacagaacaaaatggagtctcctatgtctacttctttctacacagacacagtaacaatctgatctctcttttccccacaggataggagtccaggtaacttgttccatggcaggcagtagtcttttttttttttttttttttttttggaaaagggtcccggattggcaaccctaggttcaaagcggggggggaccccaaaaagtcacccggcgggcatgaaagcggggcagg

SEQ ID NO: 560383 - DNA, 208 bp, Homo sapiens
gaatcatgttgggagggccagggcagaatgagatgattcctcgtgtgtctacccaatcatctcaaacgtaatccccacatgtcgagggaggggccgggctggagatgatgcatcatgggggcggtttcccccatgcgcttctggtgtaagtgagtgagttctcacaagatctggtgggttaaaagtgttgggcagccgggtgtggtgg

SEQ ID NO: 560384 - DNA, 341 bp, Homo sapiens
ttagcggatctttgctccacttggttgcacagtggaatgtgtatgctcttaaacatctcaatcaccgtcctctgtaaactactttggtctttatctcaggaaccagggtataggttcccattcttcgttttgctatccgagatactgcagctgctgtctgtgatattgtggtggccatgtagcgctggttctgaggtagcgactgatgaagggatgggaagcgagggtaacagctgctgtcgtccaaagtcatgaactgttaatgtcgatctcctcttatggttccttatgatctctagcttctcgcacttctcatggaatctttactggctgcatgcact

SEQ ID NO: 560385 - DNA, 513 bp, Homo sapiens
  misc_feature (215)..(215): n is a, c, g, or t
atgcaagctccaccatcccgggttcacgccattctcctgtctcagcctcccacgtagctgggactacaggcacccgccaccacgcctggataattttttgtatttttagtagagacggggtttcaccggtttagccaggatggtctcgatctcctgaccttgtgatccacccgccttggcctcccaaagtgctgggattacaggcgtgacacacngcgcccggctgggaggatctcttaagcccaggaggttgacagtgcagtgggccatgactgcaccactgcactccagcctgggtgacagagccagaccctgtctcaaaaaaaaaaaaatagttaacttaagtcaaacccaaagaccttaagtgaaagagcaaaagctataaaactcttaagaagaaagtattggggaaagcttcatgaccttagatttaggcaatggtttccttagataagaaacccaaagcatgagcaaccaaaagaaaaaaaaagagagagacattggacttttaaa

SEQ ID NO: 560386 - DNA, 579 bp, Homo sapiens
gggcacatgaccaagttggtccaatgcggagccaacccaggtacaggttttcctggagcggctgggaaagaggagtctctcgcaaattattcagcaatctgctaacagcgtaagcgaggggtttcttgaaacggtagaaggccagttaggcttgcgaggcaggaagatcagacctccctgacgttgcttggaagttacctgccgggcgccctttgtaaacatttgggaggcattccgaagctcctcagatgagtcataggccactcaagattgtggagcctctgggtgctaggccatggcgaaattcccaacttctccccgtactcggaaaaggtgcaaccaacccacgaatggggaacggggctggatggcgaaggaaatcaaaactggagacaggacgacgatgggacgacgaaaagtgataggggagtggacagacattgggggcaaaacggggggtcggaaatcttgcgagaaacttttgggggaacaacggggattggtcaattaggggaatactctggggggtagatctggggggtttcggggtaacgtgttttaccggcctggggcatgtac

SEQ ID NO: 560387 - DNA, 877 bp, Homo sapiens
gtattaaatattagactaataggttgctaatagtgttttctctttccaatacgaaaatgtcttctgaggctgatctggtgtctcacgaatctgtaatcccagcacttggggaggctgaggtgggtagatcacctggaggtcagggtagtttcgatgcaccaagttctctggatcaacatggcgaaacctccatctctagtaggattacacaaatattagtcaggtgtggcggtgttcacctgtaggcagcctgtaagtcccatgctactcaggagatctgcggcatgacagtaatcacttgaacccctggcgaggtggaggtctgtagttgatgccaagatcgtgccactgcactccagcctgggggacaaagtgagaactctgtcctcaccagacaagataaaccacagcgcatctctactgatagaatacaaagattacgctggtgcatgctagtgcctgccatgttgtccctagctactcgggaggctgtggcgatagagtcccttggattttaggacgggggaaggttgcgatggacagtgagactctcaactaaaaagtgtcgatactcagagggtacgctgtcatgaaatgttttcctttaatcccatattcgcggcagtttgctctggggcttcggccggattacaggtgtcgccacccggtcgtagccgaggaggttcggctaggagctatgtcctaggatggggtctcttcgacccgaagtgccctcccgtcttccttaggctgcttagccttcccgggagggatttctcactcgcgtccgttacgaagtctctttgggccattttagcctgtccgagtgttggcattggtatgtccggcatcctaggcgactggggcctttccgtgg

SEQ ID NO: 560388 - DNA, 203 bp, Homo sapiens
  misc_feature (126)..(126): n is a, c, g, or t
  misc_feature (164)..(164): n is a, c, g, or t
tgggagagacacacacacacacacacacacacacacacacacacacacacacacacacacacacacacacacacacacacacacacacacacacacacacacacacatatatatatatatagaganacacacatatatacacacagagagacacacacagaganacacacacatacacacacacacacacacacacacacaca

SEQ ID NO: 560389 - DNA, 243 bp, Homo sapiens
gggttttttaaaggggttggtttttccccccccttccttggggggcgaaaacccccttttggaaaaaccgggttttttgggattttttcttaaaccttttttttgggcccgggggggggcccccctggggtttttttcatgggtccttttaaaaaaaaaatttttttccggttgggggggggttttcccctttttttcttttttgggcggggggggttttaaaacccccccgtttttttggta

SEQ ID NO: 560390 - DNA, 136 bp, Homo sapiens
agctgtcctgacctgaaggctgatgaggggacccctgactgtatcccccatactgtgttctagggaggtgctcaccccagactcttaggaagggtctacagaaatgagaggagcccaagccaggtagcacgggtac

SEQ ID NO: 560391 - DNA, 263 bp, Homo sapiens
  misc_feature (98)..(98): n is a, c, g, or t
  misc_feature (121)..(121): n is a, c, g, or t
tgcactgcacacagtcatgcacacagatcttagcccactgagcaagcaggatcgaacccacaatctcatggttcctagtcagatcgttaaccactgancacgacggaactccaggagcatnttattattagtgcagtactgatgcctcttttcccggcatgattcaaagacaaaagtacagtcatgcagaggtattgtgatagaaacacttttcatacatatagatatggcattgtgaaaacggatctctgtgtctatccatc

SEQ ID NO: 560392 - DNA, 254 bp, Homo sapiens
cgaccatttttagaagagacggggtttctccatgttggtcaggctggtctagaactcccaacctcaggtgatccacccgtcttggcctcccaaagtgctgggattacaggtgtgagccaccgcacccggccacctttatttttaaatagtactttatgatatcagtgaatgatatcataaagtactatttaaaataaaggtccggcgtgcagcttatcaatttaaagactgaggctggtgaatcatctgaggtc

SEQ ID NO: 560393 - DNA, 213 bp, Homo sapiens
gactagaatgtacaaccatagaatgggcgcgtgcacatgccggctaatttttgtatgtttagtagagacggggtttctccatgttggttaagctggtctcaaactccccacctcaggtgatctgcccattttgccctcccaaagtgctgggattacaggcttgagccactgtgcccggcccacattcacttttttataggcattctatggttg

SEQ ID NO: 560394 - DNA, 886 bp, Homo sapiens
  misc_feature (594)..(594): n is a, c, g, or t
cacggtggcacactcctgtaatcccagcactttgggaggccaaggtgggaggtcacttcagcttaggagtttgagatcagcctgggcaacatagcgagatccccatctctacagaaaaatataaaaattagaagggcatggtggtggacacctgtaatcccagctaatcaggaggctgaggtggaaggatgccttcagcccaaaaggcagaggttgcagtgagctgagattgcaccactgcaatccagcctgggggacagagccagaccctgtctcaaaaaaggtaacagaaataaaaaataaataagtttggctgggcgcagttgctcacgcctgttatcccagcactttgggaggctgaggcgggtggatcaccggaggtcaggagatcgagacctgcctggataacatggtgaaacccggtctctgctaaaaatacaaaaattagctgggagtggtggtgggcgtgtgcaaatcctagctccttgggtagactgagggaggaccgggatgcttgaaaccccaggaggcaagagggttgcatgtgaagctgagaattggcggcctacgtcactccaagacctgatgtgaccnagagtgcagaactctgcctcaaaaaatagaaactatgtaaaacacgtgttaaaatgttgcggaaacgttgtttggtacacaactctggttaaaattgtagcatagaaacactattgggatatataaatagattataaagtatatataatgataattatggataaacgtttcaaaggaaacacaaagagtgtattgtgtataaacagtccgggaaaacacacgggaatgagggaaggaaaaggtagttacaagggggaggataacagaactcaccaaatgggagagaaaacag

SEQ ID NO: 560395 - DNA, 431 bp, Homo sapiens
gactagaggatacctcgatcctccatctgtctatccacgtgaatctcagcctccaagtagctgggactgcaggcacatgccacctatgcccaggtcatttagttagtcatttatagtaaaaacggggtttcaacatgttggctaggctggtctcgaactcctgacctcaagtgacccacccgccttggcctcccaaagtgcagggattacaggcatgagccaccacacccggccgctccgtgtgttttctgtataaaaattagaatatgaaatctagaggcttttccttttttcctgatctttgtcattactgacctatgaaagagctcaatcacattcatgacttaggatgccccttaggactgtgatttggaagctgtgctccatggagctcctttagggccagctgatggatggatggatggatggat

SEQ ID NO: 560396 - DNA, 202 bp, Homo sapiens
gtcatattccagagagactctgtgaaagtaaagaaggtggtcaaggtgaagaaaccttcagccagattccagatggtattcttaaacaagaaaactcctggagtaaaacccgtttgaaagcagtttgtttggagaagttggcatgggtccttcatcacttaattaggcacatcaagagaatcacactggccgtgacccaatt

SEQ ID NO: 560397 - DNA, 275 bp, Homo sapiens
gtgactcggattgatgtcggaaaggtatagcagggagagcggtattgagactagactataggcggcgagggcgaagctgagaggagagttaggaagctatggcaaaaacccaggtgagagtaggtggcagcttagtgcagggaggtagtgacgcagacgatgctgaagtctgatgcgggatgtctcgcgaaagggcacgcccccaggatgagctgatcatcaaaggtgaggaatgggagaacgaagcacatccaccgcggatgagactacatgct

SEQ ID NO: 560398 - DNA, 135 bp, Homo sapiens
tatgtgaacagtgaggtggtgagataataaatactgtgagggtgaaggaacactcccccaagctggagagagtatgtggcagcaatgtacagaggctctgggagtaagagttcagtgcacaggtgaggtgggttc

SEQ ID NO: 560399 - DNA, 672 bp, Homo sapiens
  misc_feature (139)..(139): n is a, c, g, or t
  misc_feature (374)..(374): n is a, c, g, or t
  misc_feature (497)..(498): n is a, c, g, or t
  misc_feature (652)..(652): n is a, c, g, or t
gggggggggggagaaaaaaatgtgggacagccccccccccccccacggggggggatagaaaaccccccccccccccctcaaaaaagaaaaaaaaaataaaaaattttcttttttgtttgtgtcccccccacacaaaaancccccctctcccttcccctctacacacaccaaagtagaggggggcggcgcgcggttggggtgaaaaaaaaaaaaaaaaaaaaaataaaacccatcgcgcccccccttttttttttttataagagaggggaaagggggggccccccgcggggaagggtgtctctcccccaaaccacccctcttttgggggagaggggagggggggggggaataaattaaacacacctttttttttngcggggagaaaaaaacaaaaaaaaaacaagcgttttttctcacccccccttttttttttcttcccccccgtaagaaaaaaactcttttgtgttttttgaaaaaaaaaccccgttttttccctnnttttttgaaaaaaaacgcgcccaattggttctcccccccctccaaaaaaaaaccaagatgggggttggggggctttttttctaaaagggttttttcccttgccccccttaaacgggggcccacccaagcccttgttctttttctttgcccaaanaaaataatggcctggttttt

SEQ ID NO: 560400 - DNA, 469 bp, Homo sapiens
caattgacggttctcttcgcatcttgtgcattctctcggagtgggctttcccacataaattacatcccaagtcattgtgtttgtcatgccttgcactttgtatctagcagcaagttccttgcaagaagttactaaatgggcccaatattttcaatttactcccctcctcagcttcatgaacacagtcctgctggtgtaagccacgggtttccttgatagagctcaaggtgacgttagtaaactgtgggtcatcgtcattctccagggtcacaatgggactggagctgctcgtgaccacaaggtccaagatgtccccattgctgacggacagcgttggtggccagctctgtcccaagactgggcacgctgcagacggagacatcatcgctgcgggtcatggctttggaggtcgggctatagagctttaccgagtcataagccttactgtgaaacgtggcggatttgtgca

SEQ ID NO: 560401 - DNA, 190 bp, Homo sapiens
gaatagattacatttccaggtcatcccaggcttggtcatcatcatctctcacagatcccaacacaacccaggctgtggccatgtcctgacctagggtgggatccatggatttactggaaggactggcagtgcccttctttccaatgttgttctattggagaccagtagcattgctggagagggccgcgcg

SEQ ID NO: 560402 - DNA, 156 bp, Homo sapiens
aacttctaagcgagagcgcttatgctgcctccatagttccactcggctctttgcacatgcgtctcccagctgtctcctgaacagggaagctcaggcattgagtatgctggagacagacacattcaaattgcactgctaccagacaagaaccacacg

SEQ ID NO: 560403 - DNA, 969 bp, Homo sapiens
  misc_feature (702)..(702): n is a, c, g, or t
tcaccttctcgtgccttttggagtgcccactggttgcctctccccccttggagccccttgggggaattatttttccccctgtgccgcagagtgggcgcaagacctcccagcggtctgttgtttttttacgccgtggggcccacctctcccggtgttctttccccgcctgtgttgtgccacggacggccgcccgttggttgcacacatttcctgtgtaggggatctcttcctgtggcacacaatgttccgaacctattctccagctcgcggccctccctgcggcacgcagatggacccagcacacagattgtggtgtgatcacactggggagttttggcgcgctcgctctccctctggcgggttgtttttcttctctagggcaggcagttgttttagagcaccccacacgaggagcctttcttgtggggcgccgcggacgacacgaagaaccccgtcgcgggggacccaccttgaccaggcattgtgggtagcgcctcgcttgacctcgctcgggactcaattatgagaccgctctcgtgtgggtagcctctcttcttctgtgccccacaaggttgccccgcgttttttttcgggtattccccggagaccccccttcacaatgattcttttccacgcggctggctgtaggagaaactatgggtgacacttgaggagaagctctatgctataaatgagctggtnaagaaattgggaggccgtgatgacccccacattgtgaggcttctccccccccccccgcaaaatgatgctcctctgttatataaggcttccgcttataggcctttattgaggaaagtatttcttttcctccttgaggggaagaggaaaacccaaaccgtgtgcccgaataccttttagggacacctttcccaattccgagaagggggccctgggaccctttactttttgatcaagtgggggaaacaaaaatttttttgtgtttcttta

SEQ ID NO: 560404 - DNA, 555 bp, Homo sapiens
  misc_feature (3)..(3): n is a, c, g, or t
  misc_feature (78)..(78): n is a, c, g, or t
  misc_feature (107)..(107): n is a, c, g, or t
  misc_feature (137)..(137): n is a, c, g, or t
  misc_feature (152)..(152): n is a, c, g, or t
  misc_feature (159)..(159): n is a, c, g, or t
  misc_feature (182)..(182): n is a, c, g, or t
  misc_feature (189)..(189): n is a, c, g, or t
  misc_feature (191)..(191): n is a, c, g, or t
  misc_feature (211)..(211): n is a, c, g, or t
  misc_feature (238)..(238): n is a, c, g, or t
  misc_feature (260)..(260): n is a, c, g, or t
  misc_feature (264)..(266): n is a, c, g, or t
  misc_feature (268)..(268): n is a, c, g, or t
  misc_feature (438)..(438): n is a, c, g, or t
  misc_feature (458)..(458): n is a, c, g, or t
  misc_feature (524)..(524): n is a, c, g, or t
atnccaattttttttcgctcccacttctgctgctgtctcttccacatcctcacatagaccccagagccggtggccccngggtgggcatcgtattgctggtagagcangtcataggtctcgtctttgacgtcacagangcgatacaccaaatngcctggncggtcattgtcataaccagagangtgttgncngccccctggcagctgctttncaggagggctcaccccaatcttcatanattttctcttgtggggcttttngagnnncnggagggcataatcataatccatgccgatgtcattggcattgcccttgatccaacccttgggcacatgggtgcgtttcacccggatccactgaaatttcatctgctcgggcatggctgaagtggagtcgttggcccctcgaccaccatctttaaacttgggctttaggagnccactcgagcttctgggttnctttcacataggtttttccatcgtgtatgcagtgggcagctgtaaagacatgcttctctgccaccngggtgccggtgcagccgtggataacttcact

SEQ ID NO: 560405 - DNA, 257 bp, Homo sapiens
  misc_feature (29)..(29): n is a, c, g, or t
  misc_feature (80)..(80): n is a, c, g, or t
  misc_feature (106)..(107): n is a, c, g, or t
  misc_feature (118)..(118): n is a, c, g, or t
  misc_feature (140)..(140): n is a, c, g, or t
  misc_feature (163)..(164): n is a, c, g, or t
  misc_feature (208)..(208): n is a, c, g, or t
ggttcattctacggtgtgagtctcacagnagtgagagcaacaacaggtgttgcttgctcacaattgccatcctctgtttngccttctgaggtgattggggccacanntggtgcctgtncatggacccctagtggtggaangccatgcccacctccggagtcannataactatcgtgtttgtccccatcacttgtagaatgtgacaganacatcctatcctgcttagcccaccacgaagcgtacgacataaccgcggt

SEQ ID NO: 560406 - DNA, 196 bp, Homo sapiens
gtagagacagggtctcactatgttgcccaggctggtcttgaatacttggtctcaagcagtcctcctaccttagcctctcaaagtgctgggattgacaggcatgagccactgtgcccagcctgttttggtgtttatgtttcctagactatgaatgtttccaagtagaaattcttcttcccccttctgtcgtcttctc

SEQ ID NO: 560407 - DNA, 751 bp, Homo sapiens
  misc_feature (327)..(327): n is a, c, g, or t
  misc_feature (333)..(333): n is a, c, g, or t
  misc_feature (358)..(358): n is a, c, g, or t
  misc_feature (415)..(415): n is a, c, g, or t
  misc_feature (442)..(442): n is a, c, g, or t
  misc_feature (751)..(751): n is a, c, g, or t
gtctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcgttcaacgcccacgggacgccaacaccatcgtgtgcaacagcaaggacggcggggcctgggggaccgagcagcgggaggctgtcttgtcccttccagcctggaagtgttgcangaggtngtgcatcaccttcgaccaggccaancctgaccgtcaagctgccagatggatacgaattcaagttccccaaacgactcaaacntggaggccatcaactacatggcagctngacggtgacttcaagatcaaatgtgtggccttgtgactgaaatcagccagcccatggccccaataaaggcagctgcctctgctccctctgaaaaaaaaaaaaaaaaaaaattcgaaggcacttataatatagaggtatgcagaaaacaaaggggttattggaaaattgggccaattgggacttaaagtgagtccctagacccaatgtattcttggcccaaagagtgggaaaatctggccgggtctccgtatgagtggagtggacttaattccatatagccaggtgtaccatgatattagaatggaaaan

SEQ ID NO: 560408 - DNA, 460 bp, Homo sapiens
  misc_feature (73)..(73): n is a, c, g, or t
aaggcctctctctccccccccgcccctcccacggggccttggggcccagagtggccccagttttattttcccntggtggttgtgggccctttccttccccagggttccagttttttgccgtttttgaaaggaagggttttggctgcccccccccccttaaaggcaaaggtggagggtggggggcccttaataaggaatcagggccatgcctgcccccctccttttttttaaaaccccccctagttttcctgaagggaccttcctttgtttccaggggtagcctcccttaggagcccggccggggcgaatcccccccccgttaaaaatgtccctttgggggccccccctgtttttttgtgtggtgaaccaaaatggaactggggggggtggaaagcccggggccccccccccccccccggccccttttatatattaaaataaaaatgggtttttgggttga

SEQ ID NO: 560409 - DNA, 240 bp, Homo sapiens
  misc_feature (73)..(73): n is a, c, g, or t
  misc_feature (133)..(133): n is a, c, g, or t
  misc_feature (223)..(223): n is a, c, g, or t
cacacactcctctctactgacattctgaaatctatgtgagtcagctcggacacacaatctcttattgtagagntggtctcactatgttgccaggctggtctcaaatcctggtctcagaaatcctctgctcagncttctagagtgctgggattacaggcgtgagttactgtgcgtgctcacggtgcctgggccgggttccttttctgccagcttggaaggcaancccatgactgaatgtta

SEQ ID NO: 560410 - DNA, 766 bp, Homo sapiens
cggaaaaggttactggcgcttaatacctcgggagaatggcgtcaaccatgatccgaagtcaagttcgacggcacccacatcacgtggaagcccctacaagatccgagtaggagagcctgggcatggaggggacccaggcttggtgtctgcttacggagcaggtctggaagggggagtcacagggaacccagctgagcttgtagtgaacacgagcaatgcgggagctggtgccctgttggagaccattgactgcccctccaaggtgaagatgggttgccaggagtgccctgagggctaccgcgttcactatacccccatggcacctggcagctacctcatctccatcaagtacggtggccctaacacattgggggcagcccattcaaggccaaagtcacaggcccccgtctcgtcagcaaacacagcctcaacgagaaatcatcagtgtaagtagactctcctgacaagggccactgtgccccccagcatggggccccgggtcctgggcctgctggcgccagcaaggtggtggcaatggcctggggctgaacaggcctacgtagggcagaagagcacttcacagtaacggagcatgcatgcacaacatgtggtggtgggggtctggccaggaccctgtgagagactggtgaagcctggcggccgtcaaggttctactctcagcaagggagacctgtggtccgccatagtctgctacgcacggaaaaccacgacagaaaaagaaacaaaaaaaaagggatggcagaag

SEQ ID NO: 560411 - DNA, 380 bp, Homo sapiens
  misc_feature (94)..(94): n is a, c, g, or t
gaccacaccgagttctttcgcacacggtcatcttaacctatcaagagaaagcaaaaaggttccaagaggtcggaggggagaggagggggagagncgactcagaaagtggaatctgtaaaagcaacctagaggagaagaaggaaaaccctgaatcgttataactacaccccatttcgttttgcttttggttgcctgaatgttgtcaccaagtgaaaaaattatttaactatatgtaaaatttctcttttaaaaaaaagttttactgatgttaaacgttctcagtgccaatgtcagactgtgctcctccctctcctgaacctctaccctcaccctgagctgtcttgttgaaaacagtaataaaaacattactttacattgta

SEQ ID NO: 560412 - DNA, 2736 bp, Homo sapiens
  misc_feature (47)..(47): n is a, c, g, or t
  misc_feature (119)..(119): n is a, c, g, or t
gagagacagagagagttagaggaaagaagagagagcgagcacgaggnaggggggcgggggagagaagcagggggagagcggggcgagaaagaggtcggaggggagaggagggggagagncgactcagaaagtggaatctgtaaaagcaacctagaggagaagaaggaaaaccctgaatcgttataactacaccccagatgcaacgcaagcaacgacttcgtcacactaaaacggattttgtgagggccaaaagtataaattacgaagcagaaatgattatcaaacaacttccagcggtttgcacctaaagaaacacaaggagaacccactacaaacaaacaaacccagtccaaacaacgcctccagtaggaaaagaggaaaactgcgataacacgaccccccgagaagagacgagaccaacacgctgagactgtggggcgtcagcaaacctccaagtgcacggcggactgagttgtacttcgcagctctctggacattaattacctcctgcaccttccatttgggggagggtgaggaagaaggcactcacctacactgagcgaagaagtcctatcagcgtggaagagaagtttaagaatgaaccactgaatgtttcgcttttatttttaaatttactttggcacttaaaaaacctcatttccagatttctggacaatctcggctgcagacatctaagcctaaccttttggtatcctgagttttttccctctccttctccttcctcacgcccaccccgcttctctcgcacacggtcatctttacatatcaagagaaagcaaaaaggttccaagaggtacttttctttttagaaaatcaccttttctcccctaattcttctgcagaagaaaagaggtttcgaaagagggaaaaggaaaaaacaagccggctacggtatcagccggtcagcccaggtggaaaacgagagtgaaagtagggcttaacggggagcgcaccgcctctttcgaaagccgctgggccaccaccagtgcgtgagccttggatccctcaacgtattgcgagacgccggtgtatagcccggacctgtgccccaacatgatcgccgctcaggccaagctggtttaccagctcaataagtactacactgagcgctgtcaggcgcgcaaggcggccatcgccaaaaccatccgagaggtctgtaaggtggtctcggacgtgctcaaggaagtggaggtgcaggagcctcgcttcatcagctccttgagcgagatcgatgcccgctacgaggggctcgaggtcatttcgcccaccgaatttgaggtggtgctctacctaaaccagatgggcgtcttcaacttcgtggacgacggctcgctgcccggctgcgcagtgctcaaactgagcgatgggcggaagcggagcatgtctctctgggtcgagttcatcacggcgtcgggctatctctcagcgcgtaagatccgctcgcgtttccagacgctggtggcccaggcggtggacaagtgcagctatcgggatgtggtcaagatgatcgcggacaccagcgaggtcaagttgcgcatcagggagcgctatgtggtgcaaatcactccggcgttcaagtgcaccgggatctggcctcgcagcgcggcacagtggcctatgccccacatcccttggcccggccccaatcgggtggccgaggtcaaggccgaagggttcaacttgctctcgaaggagtgctactcgctgaccggcaagcagagctcggcagagagcgacgcctgggtgctacagttcggggaggcggagaaccgcctgctgatgggcggctgccgaaacaagtgcctctcagtgctgaagactctgcgggaccgccacctggagctacccggccagccgctcaacaactaccacatgaagacgctgctgctgtacgagtgcgagaaacacccacgagaaacggactgggacgagtcgtgcctgggcgaccggctcaacggcatcctgctgcagctcatctcctgcctgcagtgccgccgctgccctcactactttctgcccaacctcgacctctttcagggcaagccccattcggccctggagagcgctgccaagcagacctggaggttggccagggaaattctcaccaatcccaaaagcctggacaaactatagggtgctggggactgcttgaaaagcgacacaaacgggcgtgctctctcagacacacaactcagctataaacagcagaaactctggacacaaacttttatgtaagtcacctgaaataggaatccggcagaagaccttcattaattaagaagcaaacaaaaagagagcaacccaaccaaaacaaatcacattcttgcacaaaagtgatcgttttcttccaaacaatgtgaatttaaaaggtcacacaaaagaagcaatcgggctccgccaccacaaaatgaaacccaaggtacattttcaaatcaatgtatagtagttccccccccttttccttctttccccctatcctttttctctccaccccatcccccccccatttcgttttgcttttggttgcctgaatgttgtcaccaagtgaaaaaattatttaactatatgtaaaatttctcttttaaaaaaaagttttactgatgttaaacgttctcagtgccaatgtcagactgtgctcctccctctcctgaacctctaccctcaccctgagctgtcttgttgaaaacagtaataaaaacattactttacattgta

SEQ ID NO: 560413 - DNA, 318 bp, Homo sapiens
  misc_feature (13)..(13): n is a, c, g, or t
  misc_feature (95)..(95): n is a, c, g, or t
  misc_feature (109)..(109): n is a, c, g, or t
  misc_feature (157)..(157): n is a, c, g, or t
  misc_feature (168)..(168): n is a, c, g, or t
  misc_feature (223)..(224): n is a, c, g, or t
  misc_feature (226)..(229): n is a, c, g, or t
  misc_feature (231)..(232): n is a, c, g, or t
  misc_feature (234)..(238): n is a, c, g, or t
  misc_feature (240)..(240): n is a, c, g, or t
  misc_feature (316)..(316): n is a, c, g, or t
gggcacggggggngaggaccaaggggctgtgaggaataaacaatacaaaggccaattgggggggcggcgagaaaagacggagggatcgcggcaanactttacgacaaanacaaatgcccaagggggcgggggaagcggggcccgggggggccgcggncgggaccagcnggcgggggggggcgaacgggggcgatagggtgcgccgggagaggcgcggaggggnntnnnntnntnnnnnantttttttttttttttttttttttttttttttttttttttttttttttttttttttttttttttttttttttttttntt

SEQ ID NO: 560414 - DNA, 208 bp, Homo sapiens
ttctagagttcacgctcacgcccactagggactcatggtgctgagattacaggcgtgagccaccgcgcccggcaaatcagagttcttctttataaggaattttttttgatgacggagtctcgctctgtcgcccagtgctggagtgcagtggctgcgatctcgtgctcactgcaagactctgcctcccggtgttcatgccatttctcct

SEQ ID NO: 560415 - DNA, 931 bp, Homo sapiens
gcagatttacaagccgccagcgtcaccggcctctactggaagctgcttcccggagcaggctgctgcccccgtggcgcaggtgacccctggggcggggtggctgtgggctggcgctggtggggcgacgcgtaactggtgctgctggctgaaagctgaccggagcacaagctgaagcctgctggtcatcgcggctggtgcctggacccgccagcctgcgccaccacaacaggacaatgttcccggtgcctcctacctgtacagccccgacgcctggtcagcctgcccgctgctgctggggctggttctttgaggaatttcgtcccagggtcaaactgctactgcgccggaagttggcttggagcacgaaagggcgttgcttggtggtgggcacaccgtgcttgccaaggcgcaggttgccatggtatgcccgctttggatatgcgacggatgccccccgtgcggtgcaggcgggacgccctctggtccccctgtgaggctcttgctgacaccgtattggtgctgtgcgggttgtgtccttgtccacggggcagcacgcggggcccttatcccgcagcagtggagcagtcctgttgttgcctgccattcaaacacgcttgtacaagcggcaagctggtgagaactgcagttggtgtccttgcagcagtggattcccgcgggttggacttccagtgcggccagtttactgcctcaagtgtactttctcctatatcttggctggccttcccgtggaaccgaggtcgcacgcggggacgcactagtcacgtctagcatgatggccctgggttgcttcgtcccgcgccgttgagacagtgtggcacccgcaggcctaggaaccgcgagcaaaaggtctacgacctcacaccgtgggctgcaacactctgaccaaagtgccatgctcctaaatcggccc

SEQ ID NO: 560416 - DNA, 124 bp, Homo sapiens
aacttcctcaacctcctgagtagcttgaactacaggcacatgcaaccatgcctggctaattttgtttattttttgtagagatgataagctctcattatataaacgaggctggtcttggactccc

SEQ ID NO: 560417 - DNA, 234 bp, Homo sapiens
aatatctgcagataaatatactgatctaccagatgcatcaggcataatctagagacgaccagtaaaagatgagaagaataacatatgaaaagagtatagcattaaataaactggttacctaagtcaggtctgtaattctacgaggtagacacttaaacatcatctctacacaaaaaggctaacccttgctattcactgaatctgaacgccatttgaaaagctctgtcatacata

SEQ ID NO: 560418 - DNA, 309 bp, Homo sapiens
tgcctgtttccagcccgagcgaacgacagtattgatagtagttcatgtcgctgagatccacatgcatctcgtagcgctagggtttagcggtgtgcgcgcagcgagttgtgactgagatctaccccttgcggggctgtacacctgccgccgccagtgcggcgcacacgcctgtgggcgtctccattcctgtgttgcgcagcgctagattctggattgccgggaacttgtggggacagagagccgccatcagtccgcgttcgcccagtccaggattgtcagacaggtctaggctggtaagggccgggaagg

SEQ ID NO: 560419 - DNA, 528 bp, Homo sapiens
aaattgatgctgcagtcgttctagaggatcccgacgctctctctgtgttgagggcagcaattttattgagacaggtctcactctgtcacccaagctggagtgcagtggcacaataacagctcactgcagccatcaacctcaccaggctcatgcgatcctcccacctcagcctcctgagtcattgggactacaggtgcacaacaccatgcccagctaatatttttatattatagtagagatgaggtcttgctgttgcccaggctggtcctgaacttgaactcaagcaatcctcccaactcagactcccaaagtgctgggattacatggcatgatgccaacacgctcagctcaggacaaaattaaacagcttgtacaatagatgctatttttcaatcctctcaggatttctcagagcctatcatatgtccaacccttgttcgaagcactcatgtctcacacatctcacactccaaggtaccatagtggatgcaaggccccgggtcaggtggtcttatgccctgataccca

SEQ ID NO: 560420 - DNA, 910 bp, Homo sapiens
cctcggctcctcgccatggacgccggacgactcccggtgccccaagggctccttgcggaagttcctggagcacctctccgtgggccggcaaaggccatctggcgtgcttgaccagctggctgtgtggattgcctcaaggtatgaactgctgcctgtccggtgcctgtggttgcagcattgggtatctacgtgtggtggccagatggttgtacttcatcttacagatggtgctaccatgggcattgtgttgtgactggagggctcaaaacattctggcatgagcgcctggacttgggtgaagaatgtggtctcacaggacgattcgctgccaaagggttggagcgacggtgggaaacgggaatcagattttgggcaggtttgctggcggtgttgcccaatggggccatttcgctggcaagcaggcctgggcgaaatggtgccctggcccttgaaagggggcttatcgctttggaaagagccccttgggcattggcagcagacatgggctggggcaaattcaaaggcaaaaaacccctttggtttgttcgttagagtccagcgagcacggtggtatgggaactcgggtgagacatgcgcgacttatcctaaacccgcgtgggtgggtgagacccccaacaaacgcaccggttgacattatccctggtggacatgagcgtctgtttttgggacacggttgggagcaccttttgggctttttaggcccatctgtgagcaggcctttggtcggacccagatcgtgtagaacgctgggtgcgcacccaagtgtattttcgggacactaacaacgcgggtggatgagcggccccctggttggcgccatgcgaaagcgatggttataaccgtgagcccattaaacccacgatttcacaagaagcgggtttggaggctg

SEQ ID NO: 560421 - DNA, 462 bp, Homo sapiens
ctatgatcgggataatacgatacagaatgattctatttgaatctgaatccataaattacacttttattttatcaaatacacaaaattcacagtggtgctgactgtaataaccactatggggaaacatcccgtaaacctgcctgtagccatgccaatgaagtgactgacctggtgacatctgtttgagcatgcttggtgtggctggtagaatgccaccgtagtgcatacacttggtacatcaggggtgaagggagggtttactaaattattgggggcgggtacaattgggatttatttgtagtcccttatatgatggggtgtgggggtatagtcctcagcttatgccctaacataacatgtataaaaacccctgacgtatcgtgtgggtgtgtacgtgtgagtgtgtgtaggtatacgtctggcaataaaagcttggtctcctgaaactaagtgaattcttta

SEQ ID NO: 560422 - DNA, 369 bp, Homo sapiens
acagttaaactacgaatctatcttgtacagtcagctatcaccagtgctcggtaggtctgtcgcctctacctataaatcttcccactattttgctacatagacaggtgtgctcttatagctgttcttaggtagcacgtctggtaacgggggtcttacctttggctctccatgagcagtgatatctagtcaattcattatgcagaaggtataggggttagtccttgatatattatgcatggttataatccttgatctttcccttgcggttctatatagactgctgccaggtgtcaatttctatcagtgataccttacttaggttaatggtatgcctaaggctgtccggtagtaatgtgaagtgggtttgcg

SEQ ID NO: 560423 - DNA, 762 bp, Homo sapiens
acggagtctcgctgtcgcgccaggctggattgcagtggcgagatcccagctccctgcaacctctgcctcccgggttcaagccattctcctgcctcagcctcccgagtagctgggactacaggcgcccaccaccacaccaggttaattttttgtatttttagtaaaaacagcttgttcacccatgtttggttcaggctggtctcggaactccgtggaccttcttgtatccacctgcttgggcctcccaaagttgctgggaattccaggtcgttgagccgccgcacccggctgagttttctgcttctaaaggctgcacagtattacagtgtcaagcacagagtctccactcgagaaattttggaacgaattgaatcaaacaactaaaaaatgtgaattatcgaacagcactgcactttacctgtgtcaggcctcaacattttaaattaacattttcaccatttttactcaccatttgtaagctccattcgtattcgtaccttattggaaaaacccgagtaattaaaagatttaagggagaccgaaataaatgtttttatttacccaaaactgtctttccacaatgtttcaaaccaactttttgtggtaaaaaaaagtggtggggggcccccaaacaaaaaccgcctttaaagagagcgttcacaacttttaatagcccaaaccttttcgctccgcccacagtagggctttttacaaccaccacaaaaacaggaaaggggaggggaggttattatcactccccaa

SEQ ID NO: 560424 - DNA, 787 bp, Homo sapiens
  misc_feature (13)..(13): n is a, c, g, or t
  misc_feature (230)..(230): n is a, c, g, or t
  misc_feature (334)..(334): n is a, c, g, or t
  misc_feature (353)..(353): n is a, c, g, or t
  misc_feature (362)..(362): n is a, c, g, or t
  misc_feature (364)..(364): n is a, c, g, or t
  misc_feature (478)..(478): n is a, c, g, or t
  misc_feature (487)..(487): n is a, c, g, or t
  misc_feature (505)..(505): n is a, c, g, or t
  misc_feature (544)..(544): n is a, c, g, or t
  misc_feature (667)..(667): n is a, c, g, or t
  misc_feature (719)..(719): n is a, c, g, or t
  misc_feature (737)..(737): n is a, c, g, or t
agaaatccaaaanaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggctctggggcttggagggagactaaaggaatgtgtagngattctgagtaagatgtagacctacgcagcagagctatggggggggagattaacaaagtcctttcttctaatatcagggtagtcatgagttgcagtcccatccnaaagggcattagggcgaanaggcccccngngtctctgaacatatgggattcttgcgccccccgggggggccaaggggcgtgcaaccgggggggtgccgggaatgagcaccatggcacagtcatttctgagccccccatccagcngtggggaanagaggaagcaaaggaggnaggaaaatgcttaatttggcggacaaggggaggggcggngtgagcccgggcggggccagcccctgggggaggcaccacctttcagctccctgaggcgacttgtttcccttcatatcctgtttccatttatgcccttcagttatggtctagaatcaaacaaanctaaacctcagtgtcttatgaagctgacacttcaaaacctgcagaagcaggntgcctttgaagaaaaaanacacaccaagtacaactagagctgtcatagacagtgtaggtttgcagaga

SEQ ID NO: 560425 - DNA, 706 bp, Homo sapiens
  misc_feature (109)..(109): n is a, c, g, or t
tcacggctatgtccacgtgttgggtggatattcccagatgggaaaaattcttactgaatcctgtacgacagggccaggggccactgtcctcaaaaccccacgttgcacnttagaatcccttgggggaggctggatgcggtggcttcatgccttttgggaaggctaagccaggaggattgctggagcccaggaattaaagaccagcctgggcaacatagtgagaccttgtctctacaaaattaaaaattaagtttgagcgtggtggctcatgcctgtaatcccaacactttgggaggccaaggcggatagatcacctgcagtcgggagtttgagatcagcctgagcaacatggagaaatcccgtctctactaaaaacacaaaattagccgggcatggtggtgcatgcctgtaatcccagctactcgggaggctgaggcaggagaatcgcttgaacccgggaggcggaggttgtggtgagctaagatcacgccatcgcactccagcctgggcaacaagagcgaaactctgtctcaaaataaataaataaataaataaaattagttgggtgtggtggtgtgtgcctgtggtcccagctgctctggaggctgaggcaggggcatggcttgagcccaggagttcaaggctgcactgagccgtgatcgcaccactgcactctagtctgagcaacagagtgaggcccttgctc

SEQ ID NO: 560426 - DNA, 1087 bp, Homo sapiens
  misc_feature (345)..(345): n is a, c, g, or t
aacgggtgatgcggttggggctgagcctcatgcgcctggaccgcttccgagattccatcctacgctccgatgaggctgtgaagccattcgggctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggttacgccgacggctgcctgtcccaggaggaggccgtcctcgctgcctactggaggggacagtgcatcaaagaagcccatctcncgccgggcgccatggcagccgtgggcttgtcctggaggagtgtaaacagcgctgccccccgggcgtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatcggcaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcaaccgcatcacccgtt

SEQ ID NO: 560427 - DNA, 745 bp, Homo sapiens
ttcggcggtgtggtggctcgggtggctgctgctggtgagtgctggtgtgtgagaggctcgcacgcctccagcccggccccggccccccggtgagtggatgagccgagcagccccgtgctctggtgctacggactatgggcgaatagctctgaccacccggcgaagagctgagaatgaagctggagagcatcagacatgaggagcagggtgaaacgtctggacatgggccaaggctctaggaagtgggatttctgtgaaataatgcaaatgagagctggaccattcatccttgctctctgtgccgtaggtccccgtctggtgcaattcacctggtgccaagcatagtgcagtgtattggcgagtgaaagatggcacggatgacttctatcagctgaagatcctgaccctggaggagaggggggaccacggcataagagccaggaagagcggcagggcaagatgctgctgcacaccgagatactcacatgctgtcactcctgcacacgcaggatggcgtggtgcaccaccacgtgctcttccaggaccgacctgtgaaaatcgtagaggacaacatgaatccagccggatggttaagaagatgaagaagcgcatctgcctcagtacaggacctggctactgtgcatcatgacttcagcgatagaccgctgactcatcacctgagactacgtaacaggagaagagcacagagaggagactgtgatcaaaaaaagacaggaatgagccc

SEQ ID NO: 560428 - DNA, 195 bp, Homo sapiens
cgttgagggtccccccatcttgctgtgcatgcagccagtgcttccggttttaaatggggtttggggagtgactacgcccaccagcttcggaggtgaagcatgactattttcttggctcaccaccatgaaatctgaatttatgtacaacgaggacaaacttgttgtgacgactccaccctattatcaaccagccca

SEQ ID NO: 560429 - DNA, 212 bp, Homo sapiens
tcggtaccgattcgatatggcgcagtctttatcgacgcgcggcggtaagtttcgattgaccgcaagctgggcggtaagcggttgttccttgctgtacgggctgctgtcgatcagatcgaccgcaccgctggccaacacgcccggtgcggcgctttccgccggcgcgcgcgccttcagcaccgacaccacctgtttacgccaggcgacggcca

SEQ ID NO: 560430 - DNA, 927 bp, Homo sapiens
gtctcggcgctagggtgcgtcttagggagtagctctgtcgcactgtgatagagcgatagaacgtaaggcctgattcgaggatcgcatcctcaataggcaatacgtcgaggtcttgtgtaccaattgtcaactcgcaaggattggtgatcaatcgtggatccggcgcaagttgctcttgttgcacttcttaatctagggcacgtcgagctagtcggcgtgcaccaactgaatgcagcgtgctgaatccgctggcggcataatcctgcggtaataggcgcttgctgtgtaggccaccatcttttcgtgctaacgtgtggaagtaatcgtacattgactcgattgagctcgtggcgcacgacacaactattactggatatacgacattactcagtcgttgataaacttagacacgttagcaggcccacgtgagcttcgcaacatagtacagttagacagcatcatgaacaaatgtggagccactaatgtggagtgtctatttacacaaatgcagaagagttcgggtacgccgattcataaggacccccaatagtctaggctcgtaatataggacaaaacggtgtcaccaggtaaccaatcattgtgataaacaatatggtgacacagaattgaagatctcgcaagtatgatttatcaatcagatatatgtccccgtattcaatggcacatttaattttatcgccctcttaacatgtgttatatgtgcgatttggtgtactacgacataccacgcgatgaaaacacaaccatttgacaactaagtttagaaccaacacagtgtgcttatcggccgaaaagtgtaccagcaagaacagcaactacacaacgagggcgccgccagagatatagaaaacctaggaaggcaacactgcccaacaaagcaagatatatacgactaagtggaaaccc

SEQ ID NO: 560431 - DNA, 365 bp, Homo sapiens
  misc_feature (25)..(25): n is a, c, g, or t
  misc_feature (32)..(32): n is a, c, g, or t
  misc_feature (133)..(133): n is a, c, g, or t
  misc_feature (152)..(152): n is a, c, g, or t
  misc_feature (190)..(190): n is a, c, g, or t
  misc_feature (335)..(335): n is a, c, g, or t
  misc_feature (357)..(357): n is a, c, g, or t
tgagacgcagctatgccctgtcaancaggcangaaccgcaatggtgcgatctcggcctcactgcaaactctgcctctcctggttcaagcgattcccctgcctcagcctcctgagtagctgggattacaggctnctaccaccacgcctggttnattttattttgtgtgtgtatttttagtagagacagggnttcaccatgttgcccagtctggtctcgaactcctgacctcaggtgatctgcccaccttggcctcccaaagtgctgggattacaggcatggagccactatgcccagcccactttgttccttgcaattttctttccttgcttctttnattttggaatccccagttttanatccattt

SEQ ID NO: 560432 - DNA, 220 bp, Homo sapiens
aggcagactctcgcttcctttctgctagggcctctgaggagtcgtgggggccaatgacgctgtgtgccttagttctacaggtgtctgacttccggctagccgtctgctggcctgtgccggggttggaagctgagcgcgtggtggagttatcctgttgtcacgtgatccctccacacaagcatcctgccccttgtcatctggataggggtctccaaccagc

SEQ ID NO: 560433 - DNA, 150 bp, Homo sapiens
gcagctcgggcagatcgtcatggtgctgatcgtgacggccgtcatggcgcaaatcccgccgcgcgtgtacgaaagctgggcgccctatctgtatattttctgcgtgattttgctgatcctggtagacgccttcgggcagatcagtaaagg

SEQ ID NO: 560434 - DNA, 925 bp, Homo sapiens
cgacaacgtgtcgcctatctattcttgtcgcactcctccacatagttgtccccgctgggtaggatctcaggtgttttgggcaaccctcaatatattggcgcccccaggtgaatggaagccggaggattttttagttttaggacgcagtatgtgttggttcttcagccggttataaccggggataaccctgatttttggaaccagggtccccctcgcgcagactgtctcaaaccccccggctcaaccaatgtgccgcctgcaagtcgcacaagtgctggggtccagatcataatcccccacgcccatccacgcgtgtacgtttaacttataagtctgtggaacagaattgctgcgtccggtcacacacaggcgccgggtatggtgggctcacaacaaaagccagcacttttggggagaaccaaggccagggcagatcacctgaggtcacggagactcgagaaccaatcctgggctcaacgcgggtgaaccccatctcgtaactaaaaagaccagcaaatgtaggcccgggcataatcggcgggcgccgaagtgcccagttactccaggagggctgaggccaagggaggaaatcgcttagaaccccggagaagctggaaggatcagcagttgagccaagaattccggccaatactggctcacactatgagcaatctgggtgaattcacaagtaaagcggtactatatcagcttctcttatactaatcactggaatctggctctcgtaaaaattgaaacttattctttctaaatgctgtaaagctataaaattacggcccggcattggtggctcaccgcactataattccagcacctttgggaggctgaggcaacggaggatcaaccttgaacaccacagagatgtcgaccccgtcttggacaccatagggagaccccgtttatacca

SEQ ID NO: 560435 - DNA, 118 bp, Homo sapiens
gaggctggtggcgagggagttgtggaggataacaagaagaaaacaagtctatcactaatgacttattttacttagtttccattcacgaaacccttttaaatacaaggcaacattttca

SEQ ID NO: 560436 - DNA, 459 bp, Homo sapiens
ccttgggtgcatgcatgtgggtgtggtggtgtgtttctcagtgctggaagggggttgagtcctggactggaggagggagtggtttggagctggtgactgtgggtgtggtggccgtggtggtcagactttgggagggggagctgttctcagggtggaggtcggcggtggcgtggatccagtggacgcagtcgtagtggctgttgtggtcggctttgtgaggatccaggtcgtccccggagttgaggagggcgtggccgtggagctggtggctgggtgtactggggcagtggctgtagtcgtcacagcaaagcacacgcacgttgtagttgaagcacatgttgaacctgcctgtctggtcttcggtcttgcaggtcagccccgtctccaggctgcaggtcagcacctgcccgaacctggtccgatgcgtaacctcgggggtagttctcccgccggcactct

SEQ ID NO: 560437 - DNA, 250 bp, Homo sapiens
cttttctgcctgctcctgcttaaacacaagaagggatcctggattttgccctctccttagctcttagtctctttgggtaggagttttgtttccagaggagctctccccctttggatttgaacttgctctctttggttgttgttgttcttccctcttcctcctccctacctccactaaaggggtgccaaatatcctggttctgtttctaccttgttgtgtctctatctcgtctatactcccatctgttgtg

SEQ ID NO: 560438 - DNA, 514 bp, Homo sapiens
cgtgtatgcatatgagaatatgagaatctcgctttgaatatattaactccaactgtagtccttctaatttagatgctttgggtgtctagactttatctggatcatttgtcactctcaaattagactttattatttccattttatgcagttaacattggtttaccacaagttggccattttatttgctcagtattccttttggtcacattagatcttccttctcagagccttccctcctttctaaggcacatcttttagtaatgcctttcataagtagctatgggtattgaactcagtttctgtttattgaaaatgtctttattttctatggttttaacagtatctcttactggataacatttcaaggccaatagttattttttatgttttcctcagcatttttaatatatttttattttcattggactttctttgtagtggtagagaagtcagctgacagtctaattgtacttccttggtaattaatctctctctcccacttcctgccctcttt

SEQ ID NO: 560439 - DNA, 380 bp, Homo sapiens
catcccatgcgcgacgcttccatcaatagtcattcagagtcctatatatccagcaacgcagggcagcatgggcagcatcaacgatccatcaaatctcttctgcattggctccaaatctcttttcggaggggccggctgtcagatgatccctccaaagcgtccatctgacagcactcccgccgactacatctggaacatcaattcgagagctcgcctgaaggtttcaattacataaaaggcaatgggcacattaggacccgagagtctggagcttcacaagcgctgctcacaccccctctcctgtacacaaagcctctagaattgggtaggcagtcattggcaaagggactcatttggatggaagcgtcgcgcatggggct

SEQ ID NO: 560440 - DNA, 1354 bp, Homo sapiens
  misc_feature (995)..(995): n is a, c, g, or t
ctcgtctctcatgttcagctactcatcttgtttcgtgcggtactgtcttttgttgttgtcgtgtcgtgcaccagtgtgttttgtgttcgtcgcctgagagtctgctgctcttttcttcacccatttttctgccccccggcggtttttacacgtcgtggtgatcgtcctgggggatgttgggcccggggggggctctctttgttggaagttgttccgtctatgtcgccgttcttacatgtggttggtggcgccccccaagaggtgaggtgttttggtccccccccaggctgcttccaacaacccctgtgggtgttaatggagtgagtcctcctcgtgtgggatgactgtgggagggcccccacctgaatcacctccggggggggccacgccccctgtatgttcccaagcctgcccccttttgtgagggtgttttcgtggggtagttccccgtcgccgcgttttgtgccgtcgtgtttgttgtggaatctttctttaggccacccctgtatgggccccccccccgaagattgatcgtggcgtggaacccacaccgatatgttgcaatccggcgtctctttgggcacccctaaaatatgtgtgggccacacgccacgtgcccacatttctccacttcgcctcttttttggttgtaagaagttcacggttcacacgctgttgttaacaagagtttctcacctttgttcacgcttcgtatgacccgaggcgaaatctggggacacaccgccacaataggaggataatctctctgggccaccacacttggcaccccctcggttttcccccagtcgctctggggtgccacgtgtgttcacaccccccacagagttggtaaaaggaggtcttctatgaggaccctctcacccacggccccctcgggaattggttcaccctccacactctctttctatgtgaccacgagaatttcctcgcctggggatcctctcttgaagggccacagccacgaaccctctgtntttccacgcctcgcgaactcgtgaacactcccacctgccacgcccgttaggagctcgttctgtggacccgtggaggcccgaggatgactcgggctctcttgtggctcccttcccggccctccccatccctctgggcctcgccccacgaggaatcttgggcttcttttatttacgcacccctgaatgtgactgataccagctagcccattccccttgtgcgaatgactccagtttattaatgctcttgctaaagatggcttcttttgcgttgcccagccagcccttaacaccagtatttccattaaaactggcttaattattttgagaagacggccccatttaaagctatacactcccca

SEQ ID NO: 560441 - DNA, 151 bp, Homo sapiens
acagcacagaggaggtggacagcacagggagccagaggccgtgggtgtatgtgtctgagggcgatcgtgggactctgctgctccagtgcctgggtgctcaaggggctggtcaatggaaaagtcatgtgggtgggcccctcctctgtgctgt

SEQ ID NO: 560442 - DNA, 866 bp, Homo sapiens
  misc_feature (20)..(20): n is a, c, g, or t
  misc_feature (63)..(63): n is a, c, g, or t
  misc_feature (79)..(79): n is a, c, g, or t
  misc_feature (83)..(83): n is a, c, g, or t
  misc_feature (96)..(96): n is a, c, g, or t
  misc_feature (98)..(98): n is a, c, g, or t
  misc_feature (103)..(103): n is a, c, g, or t
  misc_feature (108)..(108): n is a, c, g, or t
  misc_feature (113)..(113): n is a, c, g, or t
  misc_feature (130)..(130): n is a, c, g, or t
  misc_feature (135)..(135): n is a, c, g, or t
  misc_feature (146)..(146): n is a, c, g, or t
  misc_feature (154)..(154): n is a, c, g, or t
  misc_feature (157)..(157): n is a, c, g, or t
  misc_feature (166)..(166): n is a, c, g, or t
  misc_feature (194)..(194): n is a, c, g, or t
  misc_feature (239)..(239): n is a, c, g, or t
  misc_feature (284)..(284): n is a, c, g, or t
  misc_feature (286)..(286): n is a, c, g, or t
  misc_feature (542)..(542): n is a, c, g, or t
  misc_feature (546)..(546): n is a, c, g, or t
  misc_feature (550)..(550): n is a, c, g, or t
  misc_feature (558)..(558): n is a, c, g, or t
  misc_feature (582)..(582): n is a, c, g, or t
  misc_feature (662)..(662): n is a, c, g, or t
  misc_feature (667)..(667): n is a, c, g, or t
  misc_feature (685)..(685): n is a, c, g, or t
  misc_feature (705)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (724)..(724): n is a, c, g, or t
  misc_feature (731)..(731): n is a, c, g, or t
  misc_feature (734)..(734): n is a, c, g, or t
  misc_feature (740)..(740): n is a, c, g, or t
  misc_feature (840)..(840): n is a, c, g, or t
atggagagtgccaagatcancatcaggtgccgcttccttcctgtggctttccatcttccagtnagcctggtcttttgcnttgntgggccccaaaanancagcnctggntattntcttcatcccaaaagcngagangatgggcaggnaagatcanggngggtgtcanagagaggttcccatcaggttcacagggngcccgctgtacctcttggagatgtcagcttcaatcagcttctgcngctccttggtcttctccagtagcaggtccagcttaggctccagancngcctgctcctcaagtgcctcctgctgcttctgcaccatcagctctttcttcaaagccagcagctgggactgcttcagcttttgctggaggaattcagtcactcggtccacataccttggtgaggccaggatcataaacaggtgttgcagctgaagactggtaagcttgccaatcagatcctccagcactgacaccatggtaaccatcttctctttggtctggccctgcaggatggctggagccagctggaactggntcanaganaggacatntgcctcctcactcaactccactgntctctgggctaagaagatctcaagctcccatgagctcatcaaggaactgattccgggtctcagtgtattcaagcagtgtnagggnatctgggccctggaaaancttctggagcctggggttcntgnttncaagantgtgatntgaaagnaanagcatngtctccccagtctatcccatcacctccaggatctttgaatctgattccgggaagatgcccagtcgattcagcagcctcggcagagatgccagagtcagtnccctcagaaatggctctaccctaaag

SEQ ID NO: 560443 - DNA, 247 bp, Homo sapiens
  misc_feature (17)..(17): n is a, c, g, or t
  misc_feature (228)..(228): n is a, c, g, or t
  misc_feature (239)..(239): n is a, c, g, or t
  misc_feature (247)..(247): n is a, c, g, or t
atcaaatctgagatacncaaaatctcagagcagctatattctcgatgtgcaaagtacggacatatattcgacatctttggggcagagtgcacatgtccttttttccatcttttctgcaactgaaagacaccggtgggaaggaggaccctctgcgcgggccgggctccgggctgtggcgccgagcacctctcggccggggcgcgacgcctggccatgactgtgctgcangcgctcgtccnattcctgn

SEQ ID NO: 560444 - DNA, 120 bp, Homo sapiens
catcatcatcatggatttgctggtgcagtacaactaggcttaatagggacatggctcagaggggactactgtacacaaaaccatacactcatcataattcaaagacaatatccaaatttc

SEQ ID NO: 560445 - DNA, 125 bp, Homo sapiens
actctagaggcatccccgattaagaatagatgcacaatcagattgtgagaattttaagactaaatatttaaaattacaaattgttcataataggattaagacttatagttcctaaataaatctaa

SEQ ID NO: 560446 - DNA, 504 bp, Homo sapiens
  misc_feature (36)..(36): n is a, c, g, or t
  misc_feature (81)..(81): n is a, c, g, or t
  misc_feature (184)..(184): n is a, c, g, or t
  misc_feature (246)..(246): n is a, c, g, or t
  misc_feature (456)..(456): n is a, c, g, or t
tggggtgtctggcaagatggactcaacggtctcctngccattggcccctgtctcgcgtcgactggtgatgctggtctgtgnccccccgcctcctgactcctggtcccctgtcctccagcgctggttcgattcagcttctgcccatgcactcaagagaaggtcacgatggtggcgctactaccgngctgatgatgcccaatgtggtcgtgaccgtgacctcgatgtggacaccaccctcaagagccntgagcagcagatcgagaacatccggagcccagaggacagccgcaagaaccccgccggcacctgccgtgacctcaagatgtgccactctgactggaagagtggagagtactggattgaccccaaccaaggctgcaagctggatgccatcaaagtcttctgcaacatggagactggtgagacctgcgtgtaccccactcagcccagtgtgcnccagaagaactggtacatcagcaagaaccccaaggacaagaggcatgt

SEQ ID NO: 560447 - DNA, 351 bp, Homo sapiens
tgttaaggcggtaaactgtgtaatgtgatcactactttcttgtctttttaaaacatgtttatctatccttttaactgtttagctagctccttcaccattctgttttacttttaaaattcatcttttctaaaatctaaaaagagtcctactgcaatgttttggaattttgttaatttcacagatccttctgagactggcatcttatgttcagtcttccagtctatgagcgtgctgtgtgccgtctctccacatacatagtctttttagcatacagatcctgttttgtcttgttagatttatacctctctctctctctcaggagctactgtgtttttaacttcagtttccaat

SEQ ID NO: 560448 - DNA, 115 bp, Homo sapiens
cgaggcccatgaggagctggcttaccttaagacgaaccacgaggaggagatcaatgcctgagaggccaggtgggtggcgatgtcaatgtggagatggacgctgcacgtggcgtgg

SEQ ID NO: 560449 - DNA, 428 bp, Homo sapiens
tggcatcagaactgcatcaggtacatgagactgaatagaggggtcacaccaagattagctatgacatagtggggaaattgccaactcgcccttgggaaaggttggaccagagtgtagctgtctggactccgtcccagaacttcctctgcataactaagtctattgctagtcaagaagctcgacacgtggcatctcacggttgcttttcttgtaccgactggtgaggttgggcatttgttccatttcaaccaacactagctgagcatttgcttacagccaggaattgagctggggaggcggctgagtcctggtccctgcccttaggggagttcactctctccacatgaagcatgcatgtgtgcaggtggatgcaacaacctgaatatagtgtcagcccgtggggtaggaggtgggtaccgcactcgaat

SEQ ID NO: 560450 - DNA, 861 bp, Homo sapiens
agcgtggggggcaggagcagacaaacacacagccaagggatttgaattaactcagccattttggagaacttggggaacatgaaagaaaaaaaaaaaaaaaaacttttttaaaaaaaaaagggggagaaaaaaatagtttctatggagtgagctttaatcagtctcaatggaattctttccttttcccgtgcatgaagacagcgttggtggccgagtgtgcggcaaagaaagccagaagggacccagaaatcccagtgtgccctacaacccaccaccagacacacttcacacccacacaggtttctcgagacacacacaaagaagttgcctgtgcgcggttataatagccgacaaacgcctaactataacgtgtccgtggcagaaattctcactcttccacaaacagactcgctaacccaattaacacccaattctttacaacagaggcacccaaacacaaacacgtctacctgcggactgtgcagccaaaacagaagggccatttttttgtcgtggcacatttggggctcccgggggctgtgacaaaccacactcacagacaagcagacgacagcaacaatacctccagcacaattcagccagcgcggaaatatcaccatgtgcgaggcctaccctatattttgcaccccttatattgtcaccctaaaccctgggggttttgcggcacaaccacgccggggagggtcctggggcggcacccgtggtgaaaaattttcactggggcccatgacacactttttccaacatcatacaaggcacacagcatccaaacacacgttcagccacaacgagctttcggcaccccccacacacaacaatcacaacaccacagccacagcc

SEQ ID NO: 560451 - DNA, 298 bp, Homo sapiens
gtgtgggcatcctgacctcgcttaccttttggagaggccactggtctgcgcctgggcagggcacaccgggacctgccctgagggttagacactgtgggccaccgtggcaaggaccctgcccatctcaccttcctgcaccgcacgcccaggctttcccctgtgtccgtttgtcctctcagccttccggtcatcatgaatgtgcagaatgacaagggaggaggtgctatcccaggcgagtggctctatccccaaaacacaggcagggctcggccagagcaaaactcactgcccttcacag

SEQ ID NO: 560452 - DNA, 197 bp, Homo sapiens
aggcagcggataccccataatcagcagcttggttgatggcatccacaatgctggcattacagggactcccgttcccggaagactttgtccagagagagtttgccgagcctctgatctcatggttgtattgagctagctagggtagacggcatactacagaggtcctaccacaaccgtcagctatgcctattgttaaa

SEQ ID NO: 560453 - DNA, 194 bp, Homo sapiens
gatcccttcgcgcataagggttatagagtgtgaaaatgtaggcttggattaatggtgacagggatacctagtgatagtcatatagaattagaatatgtgaagatgataagtgtggatgggaaggtaaatggttgatatttgcttatgtggtggtgcttccaattaggtgcatgattaggtggccttatctgtgt

SEQ ID NO: 560454 - DNA, 387 bp, Homo sapiens
tctcctctgctccctcttcaggcctccaatgtcatatcttctctatatactatgtggcagaggagttgcttggataagttacagcctttacctcatattgaatcccagacagtatgggcagggatctctcagaatattcagacaggaactctcagtatccagagcagggctcccaaggcactgcttgattcaaaaggcgaaagcagttggtctacacaacggatgtgtagctctagcacctgacaggtagaagataacctcaaggcgcctcctgtagacacacgggtaacatcacacactatgttctatacccacgcagcaataggaggaaccaggctctgggccaggacagtttccagtgctgtgaaaccggaggcagaaagagta

SEQ ID NO: 560455 - DNA, 193 bp, Homo sapiens
cttggatagacgcgtcagatttggccttataggttaggccaaattacacaggtaattttaaaaagatttgtttgtgcctccgggggacactctctttatccaagctagcgtctacacctgtaccctccccctttttttgcgtttttctttgtttttttacatcacttttgggggggtttaggccccaacatac

SEQ ID NO: 560456 - DNA, 166 bp, Homo sapiens
  misc_feature (122)..(122): n is a, c, g, or t
tctgtttctgctgtggaagtgggtaagaatctgattgcagcactcagttgccggtagaggtgtgagttaatcaccggcccgtgagtgggtaaagaatccagcattgggagttcccgtcgtgncgcagtggttaacgaatccgactaagaaccatgaggttgcgggt

SEQ ID NO: 560457 - DNA, 1468 bp, Homo sapiens
ttgtttttttgtttattgtgtagtttttgtttatgttatgttgttgtttgtgaatgtgtatttttgttgtttcatgtgtggggtttattgtacgagtttagtgtatgtggttgttttttttttagttttttaagttattgtttcttttaatttagttgttgttaatgtgtttgtgttgcttttatattgtcttagttgttaatttttgtaataagatgttagtttgttatttaggttatttgttatggtggtgtggtatttgtgtgatttattggtgatgagtgaagttttgttgttggttgtttgtaagtttatataatgtgtttgttgtttttgttttgatgtgatgtggtgttattgtgtttgtagataggtgtgaggttatgttgttggtggttaatctatgatatgtgtttttatacggggtgtaaatctttgtttatatattacctcctctttgtggtgttggaaagacaaacaataacacgttttttgggggaaccacacttgggtattctcgtcaagggattgcccctcacaaagtgttgtgggaccaccaagtgaaagacacggagtgttttgtttaaacatcgacgcgccccccgctgtgatattatttttagacgcggtcgctctcatagggtttatgttgattagtctctcttgtggtggtgggcgcaatattgtcgcgctccagagggtttttttgcacacacacggtggtgtgccacctttcacacgggggaagatctcctctctcgggaattccaagtctatgtggctgtttgggtgtgtggggtgccaccagcacccactcgggatgttgttccaaaaccttggagagatagtcactctttttgtaatgttctgagagcgcggaaatgtggcggtctctctagtagcactcgtttaagagattttgtttgtgtgtgagacaacactgtggcgcaaaaatacacactccacacacacacacctgtgtcccagggcacacttttatacacaacactgttgtgtttatagaccacacacaggtgggacatccccacacacacacgctcgtgttgtgggcccacacacacacaagggcagcagcgcggggcacacttgtggggcacacagaccacccgaggaaggcattgtttttctactgttccacacaacctgtgtgaagtgtgtttaaaaaggggttgcaatataccgtttggctccggcccacacgtgtgagccttataacttcccaaatggagatatagaaatttaaatgttctcccacccaccaccttacaactgtgagggcaactatttaatatcaggtgccactttgcaggggtaatttaaaaacaaaattttggccattttattttaattcacacccaaccacacagtgcccacccaattataagcaaccttcacttttgtttctcctctttgtatataataatatataatataatatataaataat

SEQ ID NO: 560458 - DNA, 182 bp, Homo sapiens
tcaaattatgtgtatcacggaaagtcatgtcagtggtagtaatataattgttgggacgattagttcagcattggagtaggttacggttatgtacgtagccaaggccatatgtgtaggagattgagactagtagggctagcgccaccgatgcttcgaagcgccacaaaaactaagtatggcaa

SEQ ID NO: 560459 - DNA, 575 bp, Homo sapiens
ggaagcgggatgtccatcgctccagcttggtggtgaatgctgagtgagagtcactgttgctgcagtctgtgccacccggaggaagttgtgtgagtgccgggctggtgagctcgcggtgctctggggaatctgaaacgcggggtcggtgcgaagactctgctgctgccagaccctttcctattctggccatgcctggaagtgaacaaggcgaagtctacctgcagctgccctgacctgcagcccaatggacaggatcttgggcgagaacagcctgggtttgccctgtctagtgagcggatgaatcttgagtgaagatgtgtgactggagtggggtctctcgagtaattgcttgggtgacccgtgagatctgtcaatgtctcccagctgagcccagagcaataccgagtacattcaaattacatgaatggcttgcagggcacttcttgatttcagacctaaggtaatattgggaagggtaaaacagtgaaatacaacatgattgatgaagaaggaagaggagggtggagtgaagaagaagaatgttgattgatgaggattctggaggctgaaaatag

SEQ ID NO: 560460 - DNA, 288 bp, Homo sapiens
  misc_feature (1)..(1): n is a, c, g, or t
  misc_feature (213)..(213): n is a, c, g, or t
ntttggagtggtgcgatggatcgtgtttccggggattcactgtaaagtccccgtcctttccagtgtcttgcgtgcctggtgtgtggaaggagatggtttcagtttcctagtgaggctgtggcagttcttggaagtggatgaatctgggcacacagcttctgcccatgtcccatgcctcactgcctgatctgctgtcctcaaggtttacatacntggtgatgtcaccatagctgctctggagatcatgaaactgatcctcaacattgccttactggacatgccattcca

SEQ ID NO: 560461 - DNA, 1034 bp, Homo sapiens
ccactacggtcggtactgcttatttgttggaagaatcagccatcgtcagtgctttatcactatcgtaaacattcatgatagggcacggattctaacatacaagggattcttgcgttctgtatctctatcagaggtgaacatgaagcgatcctacacaaccacataagggtctctatgttcgtgtcatgcctcttcaaacaccaaggagttgaactagtgcttccagtgatggtctccgtaatgccttcttcctttatttggccttttctttctttctgtaccttcacgttcttgattgttcaaaattccaagtctagagaaaaccagtatattggtggtgctgggcatttgaagatgatgcatatcatgacgccgttggttctgtttgtacagcttagccttacatttcaggaggaggctgtgcattaggggcttatgctagctccttgtggccttttgaacattcaatattgtattttttcgccatgtatcctttcattgaaccgttaagggagcctgtcatctaacatttctcaactagttgcaggcctagctgaactgtctagtgtgttatacacttgctgccttcttatggtgaaaaccaggggatgagtggcttccatggagagatctctgattctcagggaggacaaacgtgatgacattaccactactttatgttttccccttttccaaatttgataagatttcctggttcctagtgatcccgggattgcgcaacacgtggccgaacctggcaagtcatgcccgtaggcccggaagaacgactgtgcgctacctgctcgttccgccgcaatctggcaggggtaatccgcccgacggtcggcccgacttgcattgacccaatccaccggaaatcccccctgggtcaagaacacaagagctatacctcacggcataccgtggcaacagcgactccgcctccaccccctcacattgctctcacccccacacctctcacatctacacacggcccgcacacacgcacaacgagcgccccccgcaccagcacc

SEQ ID NO: 560462 - DNA, 139 bp, Homo sapiens
cggaatcagctcgaccgtgggttaggatctgttgagctgtagtgtaggtcacagatagcttgaatctggtgttgctctggcggtggctgtggccaggaattgaattcacatacgttcacttaatgccgctaccgcgaga

SEQ ID NO: 560463 - DNA, 101 bp, Homo sapiens
cctgatagactgattgggcataaaatggattctggctcgcctgggcttaagaactttctgcagcttttcagcactgactccttccttccttctttctcttt

SEQ ID NO: 560464 - DNA, 107 bp, Homo sapiens
cagagcatagacgtgtccgcaggtcacctgtaccggcttctcgtacacctctaagcacacgggacacgtgaacagaaggaatatagacacgagccctatagtgagga

SEQ ID NO: 560465 - DNA, 463 bp, Homo sapiens
ccgtatcagctggcagatgctcgcccggggttgcggtgctattccaggctgtcagatgctcatctctgcagtatgggtgctgttccatgttatcagatgctcgcctgggggtgtgtgtgctgttccagggcgtctgatgctcagctgggggtgtgggttgttgtcccatgttgtcggatgctctcctggggactgcggggtgctaccccagtctgtcatactctcagctgggtttgtggtcattgcgtctaggctgttagattgctcccctggggttgtgggcgctgttcgcagactctctgttgttcctgctgttgttgtgggtgctgctccaggtcctcgtattctctcctgggagtgtggttgctgttccatgctgtcgaattctcacctgggggtgcagggtgctgttccaggctgtcagattctcacctggaggtgtgggttgtgctccacgttgcga

SEQ ID NO: 560466 - DNA, 159 bp, Homo sapiens
ctggtcacgtacagcaagcagggggatgttcagtggggcccaagcctaccctctttcctggggggtgtagatccaagccaggtgggtgaactgagagtccacctgagacgcccagcacttcacagcccagcttgcgggaagtcctctgcacggttgctg

SEQ ID NO: 560467 - DNA, 932 bp, Homo sapiens
ggcgctcgttccagcgcgctcgcgcgcgccgtcgccctgcgctgctgaagctggcgtcgctgccgccctcgtgccacgcaccgcctgcacgcgctggagcaggaggagacgccgctgtgacgccgccggcgggagagggtcctgctgcgctcatggcttggccgctcgtcgccctttcccacctgctgccgggtaaaccagatggctcgtcccatactggatttgctgttgaaagccatgcgccaagggttccgtggctcgcccccatggctcgagcccctgctgcccggtggactagactcgtgggatccgtgactcaagggacgctctccgtgcagccatggacgtcacgggccctgacctagcaagagtgctgcaggtgcctcatgtctgctcgctgctaaatgcggctctttggtggcttgtaatgctgcccgctgttcacaggtggcccgtcagaccagcgagtctattgagactttgcaggcgtagagaggttgggcaaggaaacagtcgtatccaggtctagctactagcatgtctggggcggagtttaggaccttccttgatagagaccatgttagccgtgcctcccagatttgccgcgcacccatgagtttcctgtctctagccacgacgccgccggtggtctcatgtggtgggctggcccgcgtgatactggaccctgtcacccaactagtacgaggatctccggggcctgagctagtctgcgacctaggcgcgggaggttcgactcggtggtgcccctggctggcgtgacgcaggttggccttgtgcgcggcggatgcttgccatagaatcatcggccaggttctttaagtggactggtggggcccagctaggctgctctgtcccccttaataatctcagggggcttggacggggcccagggcactgtcccctaccaggtc

SEQ ID NO: 560468 - DNA, 438 bp, Homo sapiens
acacctctttatattggctgggcttactacagtgtcaccctacacgctctatggtacataccctagttgccgcgttctcacaatgagttgcagacagatgccaagacacatggcgtctcaaggcatgtataagcccatgctcttgggagacatgtataagcccatgcccatatgcagacatgggccaagatgtgcaaacagaccaggacacacagacccatgggtacatgtactaagacacacatggatatacacacacccaggacatgtggacgatcaccaacccagagatgcataaatgtggagctacctctagagagccagagtcaaaggacatgtgtgcagttgcctgttggggtgagcaggcctatgcaggcacacccttagacatatagcagctcactcagacggccacaggccatgctccaagacacacac

SEQ ID NO: 560469 - DNA, 420 bp, Homo sapiens
gtccaaacagtgccctagcaatactgaaaatgggtgtctttctagctctcaaaactagaactctgtaataatcttactggtgcctgatgctggaacactaagtagagtatacacacacacgcacacacgcacacatacacacaccaacccaggagaggggacacttgagatgttcagatcttgataagcttacttggggtagagtgtcttaaaacccctgaagacccatttcacacttaagggaagcctcagataggcttgtccaggggcaaaaaaaaaaaaaaaaaaaaaaaaaagctgtctgaatacttctaaaacaataaagataatttgtaaaaccttcactgagcttaaaatccatgtagttaatgaaaagtctcattacaattaaaccaatgaaaataatgttcacaaatgttt

SEQ ID NO: 560470 - DNA, 242 bp, Homo sapiens
gcctcgagtccagacagctgggcacatggaaaaccatctctacaaaaaaaatagccaggtgtggtggtgcatgcctgtggttccagctactcaggagactaaggttggaagacggcttgagcccaggaggctgaggctgcagtgagctgtgatcatgccactgtacttcagcctgggtgacagagtgagaccctgtctcaaaaaaaaagaaaaagaaaagctcttattgcccaggctggagt

SEQ ID NO: 560471 - DNA, 867 bp, Homo sapiens
gcttagcgagaaccaagtgccagggggagtgtgtgccaggtgctctgcacacctccccagcctgcctgcctgcctgccatccatccgtccgttcttttacagaatgaatgcttgttggttcagtacagtgcctggtgattgaacacagtgaacaagacagaccaagccttggccctttggcacttggtgaggaagactagtaggaacccaaacaagagaatcagattttttcggaactatgaaggcaggcaagaaggacatgagcttccctgttgtgttcactgccatgtcctcaacacttaaaactgtgcctggcctctagtagacggtctctgtaggtgtagacatggagtgaaacagaagtgaaacggtaggatagagactggtgggctgctttagcctgaggggtcagagaaagcctctctaaggagatgatgcttttgagctgagccttaatttcgatagaaggatctggagaaacagcagtccaggctgagggaatcagtggtgccaagaccttcaggtgagcagagacgtcggttcttccgcaagcaaaaggaggccccatgtgggctcggagaacaggcccaggaacaggtcagtgaggtgggtgggagccataccatggaggacctggaacggccatagccaaaaagcagtggaaagccattggaacggttctaggcaggagatgacacaaattacccattttacacattatgtagcaagcaactgaactactgcgaaattggatggcacggcactgagcctgcaaggggtaagaagggggacgcatgggtacacccaatctacgaagtggctgtctagagtgtccaggccagaacatgacaagaggcttcggctacg

SEQ ID NO: 560472 - DNA, 431 bp, Homo sapiens
tctgttcgccaggtcagagaacgtatatacagagactaagaagcatgcttgagatcacagtgactaagggatttgaagtaatgattacagtaaataaccataacttttcacttaactattcacattccatacagtggagattatcctctcctccagattttgcacttacactctgaactttaaagacctacagtgaacaaaaaaccaacttacagacgtccaggatgtgtgtttttttctgttaatgccaagcacacagtgtacatcataaaattcatatttggtgtttggcattattgcaataggtatgatcaataccacaaatatccttgccataaactgttctacgataataatgaaaaaatatatcattacatcatcagtgactcgaataaaatatggtatagatatggcattttcaatgaaagttg

SEQ ID NO: 560473 - DNA, 375 bp, Homo sapiens
  misc_feature (26)..(26): n is a, c, g, or t
aaaaatttccgccacatttgtaaaantaactacacaggtctttttttttccttttcttttttcagggacagggtcttgttctgtggcccaggctggagtgcagtggctcaatcatagtctcctgcaggctcgaactcctgggctcaagtaatctttgtgcctcagcctcctgagtagctgggactatagacatgtgccaccatgcctggctaatttttaagtttttgcacagatggagtcatgctgtgttgccaggtctcacactactggcctcaaccaatcctcctgcctcaagtcatcaaagagcttggattacaggcatgaacctatgcacctagttaaatagcacatttctaaagtaatctatgagtcagt

SEQ ID NO: 560474 - DNA, 110 bp, Homo sapiens
  misc_feature (28)..(28): n is a, c, g, or t
  misc_feature (36)..(36): n is a, c, g, or t
  misc_feature (62)..(62): n is a, c, g, or t
gtcctgcagactgctcttagccccctgntttgtgcngcactggaggagggcagtcccccatngtgccgagccaacgcctcaggaatcaggaggccagcctggtaccaaaa

SEQ ID NO: 560475 - DNA, 100 bp, Homo sapiens
tttagctcggtaccctctacgtttttgatgcgcgcaatctctttttctgatagccgaacaacctctctatcgataactacccgggtggatttttttaata

SEQ ID NO: 560476 - DNA, 277 bp, Homo sapiens
ttaggtgatcctcccatctcagcctcacacagatgcacaccaccacacccagctacttttttatattttttgtagagacggggtcttgccatgttgcccaggctggtctcgaactcctgtgcccaagtgatctgcctgccttggcctccaagagtgctgggattacaggtatgagccactgtacttggcagtagtttcaactatatgattttattttacctcattgtacaattcttttttttttttttttttttgagatggagtttcacgtcgacgc

SEQ ID NO: 560477 - DNA, 912 bp, Homo sapiens
ttatgaaatgtatttcttaagttataagacttaaaagtggaaattaccccttaattcataggctgcaggatggatgctgtgttatcaggcatagaaacaatagtaatctacttgtacatctccattagggatcttgggtgacctgatgcatgccaatgaacaataatattttcaaatgaatctttttttcttattagatctcaaaggtgggcttaaaatattcagtaaaccgtgctgcaaacagattgctgtcagccagccttgtgttccgtttatagagcacaggcagaatagacttagcataattcttaaggacgtaggatttttgtatggaaagtgagcatggcttcaacttaaagtccccagctgcattagcctctaacgagagtgttactctatctttgaagattgaagtcaggtaatcctctctagctatgaaagttctaggtgacatcttcctccaatataagacctattttatctacatgataagtgtttgtgtagccactttcatcaaatatcttatctagatcttctagttgacttgttatagcttccatatcagtacttgctgttcacctttcactgtatgtgacaaaccgatgacttctgtccttaaacttcatgaaccaactcttttagcttcagatttctttctccgttcttcacctttgtcagactccatggaattgaaggacggaggtaggggctggctctggatcagactttggttaggaattatggggtggcaattcctctatctagaccaataaaggttattcaatatcctagaacagggtggtcacttttaatatcaggattcccggaggggcattaattccttagggacttcttgattcaatgggctgggccaaaggcaaaaagagagtgggaagatgacccccacagtaa

SEQ ID NO: 560478 - DNA, 325 bp, Homo sapiens
  misc_feature (148)..(148): n is a, c, g, or t
  misc_feature (151)..(151): n is a, c, g, or t
  misc_feature (160)..(160): n is a, c, g, or t
  misc_feature (241)..(241): n is a, c, g, or t
  misc_feature (245)..(245): n is a, c, g, or t
cgccacatcagagaataatctgctccaaatagaaatagtggccagagtgacaaaccctgctctagaaaccctacagtgtacaggccagccgccacatcagagaataatctactccaaatagaaatagtgcccagagtgagaaaccctnctntagaaaccntacagtgtacaggccagccgccacatcagagaataatctgctccaaaatacaaatagtgcccagagtgagaaaccctcctntagnaaccctacagtgtacaggctccagaaaccctgctctagaaaccctacagtgtacaggccagccgccacatcagagaataa

SEQ ID NO: 560479 - DNA, 206 bp, Homo sapiens
gagatgaatatatatgtaaagaatccgagaacaaacaaacaaaaagacgtgttataaaaaagctctaggtgcacagtaagcatatagggtttttattttttccaggtgtattttaaaacaagggaagtgtcaaaaaatggggtcaacggggtaagagtaaataacatacatgggtatatggctggcactggaatgggaaccttggg

SEQ ID NO: 560480 - DNA, 398 bp, Homo sapiens
ttctggaaggcgaaaccgttggtaactttgtgaacttgggctgtaactactttataactaacatgtcctgcctattatctgtcggctgcacggtactctgtgagtccccacttcaggcttttctccgtaacagattttgttggcatagctctggggtgggcagttttttgaacatgggctcaaccagaaaagcccaagttcatgcagctgtggcagcgttacagttctgtggtttcatgttcgttaccttatagttactgtgtcattggtgccacttaatgtctgttaccaaacatacatatctctaccccgggcttggtgtagtattttttgtgtacttggatttcataatactgtcatcctcaaagcacgtgtgttggttttttaaaacagaacgt

SEQ ID NO: 560481 - DNA, 272 bp, Homo sapiens
  misc_feature (95)..(95): n is a, c, g, or t
  misc_feature (98)..(98): n is a, c, g, or t
  misc_feature (107)..(107): n is a, c, g, or t
  misc_feature (188)..(188): n is a, c, g, or t
  misc_feature (192)..(192): n is a, c, g, or t
cgccacatcagagaataatctgctccaaatagaaatagtggccagagtgacaaaccctgctctagaaaccctacagtgtacaggcagaaaccctnctntagaaaccntacagtgtacaggccagccgccacatcagagaataatctgctccaaaatacaaatagtgcccagagtgagaaaccctcctntagnaaccctacagtgtacaggctccagaaaccctgctctagaaaccctacagtgtacaggccagccgccacatcagagaataa

SEQ ID NO: 560482 - DNA, 223 bp, Homo sapiens
cagaacagcatggacacaggcaggggaatgacaaacacttgtggaggcttgggggtagtgacagcaaaacaaaaatacaagaaaattgaagaatatacagatttcaaggaaagaggttcataggagtgtatttagtttttcaacccttctaagtgtttatggaacaatccctcactgcattgcattgtttattttaaattctgaggtcaggctaccagattat

SEQ ID NO: 560483 - DNA, 132 bp, Homo sapiens
tctgtctgcaaatactttaacgagatacaatttgtgtggttggacagaataaacagcccaagtttcaagagtctgaatatcactctctggagatttgaatgtataggctctatttctgactcagttaaaaaa

SEQ ID NO: 560484 - DNA, 798 bp, Homo sapiens
  misc_feature (23)..(23): n is a, c, g, or t
  misc_feature (33)..(33): n is a, c, g, or t
  misc_feature (66)..(66): n is a, c, g, or t
  misc_feature (70)..(70): n is a, c, g, or t
  misc_feature (75)..(75): n is a, c, g, or t
  misc_feature (78)..(78): n is a, c, g, or t
  misc_feature (85)..(85): n is a, c, g, or t
  misc_feature (88)..(88): n is a, c, g, or t
  misc_feature (90)..(90): n is a, c, g, or t
  misc_feature (92)..(92): n is a, c, g, or t
  misc_feature (129)..(129): n is a, c, g, or t
  misc_feature (139)..(139): n is a, c, g, or t
  misc_feature (147)..(147): n is a, c, g, or t
  misc_feature (150)..(150): n is a, c, g, or t
  misc_feature (155)..(156): n is a, c, g, or t
  misc_feature (203)..(203): n is a, c, g, or t
  misc_feature (279)..(279): n is a, c, g, or t
  misc_feature (403)..(403): n is a, c, g, or t
  misc_feature (464)..(464): n is a, c, g, or t
  misc_feature (483)..(483): n is a, c, g, or t
  misc_feature (611)..(611): n is a, c, g, or t
  misc_feature (643)..(643): n is a, c, g, or t
  misc_feature (717)..(717): n is a, c, g, or t
  misc_feature (744)..(744): n is a, c, g, or t
ctgcgcgccgctttggggctgcnctcactcgtntgcgcgctcgtccgcccgccagtcctctcaacncgcncttgnccncccgacnacncngnatccgcacgcgccggacgaggctcgctgcgctccctntttcccatcncgggcccnttnaggcnnagctctcagttcccggccaggacacggtctgggccgccgaatctccngccgaatagcggcggcggcagctgcgggaaaaaaatgaagaatgaaattgctgccgttgtcttctttttcacaagnctatttcgaaaacattataattttaaaaaaaaggcagttgaaaggtttgctgagaaatttaccctaatacttcaagaaaaatataaaaatcactggtatccaaaaaaaccatcgaaagtacatncctacatatttattcttttcaataaatttcagagagttgatccttatgtccttaaagcctnttaaaacagctgcatcttntatagttacctgggcttgccaaaggagctcactctctgggtggacccatattaggtgtgctgtcggtatggagagaaaaacaatgcattcattgttgccagctttgaaaataaagatgagaacaaggntgagatctccaggaaagttaccagggcccttnataaggttacctctgattatcattcaggatcctcttcttcagatgaagaaacaagtaaggaaatggaagtgaanccagttctgtgactgcagccgcaagtnctgtgtaccagatttcagaacttatatttccacctcttccaatgtggcaccttt

SEQ ID NO: 560485 - DNA, 278 bp, Homo sapiens
  misc_feature (217)..(217): n is a, c, g, or t
  misc_feature (247)..(247): n is a, c, g, or t
cgcctcctgggttcaagtgattctcctgcctcagcctcccgagtagctgggactacaggcacctgtcacatctggctaatttttgtattcttagtagagacggggtttcgccatgttgcccaagctggtctcgaactcctggcctcaagtggtccacttgccttggcctcctgaagtgctgggattacaggcatgagccaccacacctggcctcagnctcccggatagcaggcgtgagccaccacanctggtttcaggctcccagaaagcagattttt

SEQ ID NO: 560486 - DNA, 232 bp, Homo sapiens
gagccgtgctggacgcgaggtgtaagcgacgcgcctgggtcacgagtaaggggcgttgaagagtgaagtcattaacacacaagatgcagtctataaactgtgtctatttttaatttgttattccatacacctatctagcttagaaataatcattagccattatgcctaacatgacataaataataactaacatatattaatacttgatcctcccatgatcaaacatttttgg

SEQ ID NO: 560487 - DNA, 200 bp, Homo sapiens
tcacttcctcccttaagaagagaagagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgt

SEQ ID NO: 560488 - DNA, 1187 bp, Homo sapiens
agcggggcggaacgtgggagcgggcctggtagtcttggccataaagcctgaggcggtggcagaggcggagttggccggtttgcgaagacgctcagtggacgagttccactggataccgatgaatctggtggaggtcgttctcggcttgtctgttcttccggtttacgtactcctgccttcgagacgagcgtagccctcagtccgcacgcagcccgggcacccggagtccccctatgcgcaagacgggtggcagtattgatatggatcgacctactatgtaatcaagatgctgctagcattgagatgggtgtattctatccatgggggagaattcatggatgtccgaggcaagagagtcagcatcagtgatagccagttactgttggaagtaaagaagactttcaaggtaactcgagatagcgaaaatgcccgatcacatttacgggagacctgaactattgcatggaacgcgcaggcgcagagtcgcactagtgcttgggagttgatccgacgggcgcaagttccaccaacattggtcgaagtaataagttgcgtgatcgatcaatggtacgagaagctagggatagcggaggtgtcccatgctcgtcctgctggatggtaaggccacatattcctaaccactaagggttgcaacggactggacttgaccgatatcctaggatacattttaggagtaggtagaatcggttggtcacgcgccaacatcaatcgattttcaaataaaggcaccatgaaagaatgagcgcgtagggaagcacgcagtggaacgatgtttgcgttcaagtgctcaaggaccgccaaggttcgctccacggaaggatttccctggcggaacataacttgtggcccccaagtgtatggttctgctggtgtggcggaaaaggacctggtggcaatttgtggaaccccgtccggtaaatatatccaaggaactagaaggtggcgaccatcgaaaaggccgggtggcaaactacgggcccgttgggtcgccatatcaaggcaagaaaaaaacaaaaacaaatttcccccttaacttttttgaaggaacgccacggttgtcgccaaagggaaggtgcccatcaaaacggttggaacgcaggggcggtttcccaaggaacggaatttgcactgtggaaattgccactttttagagccagggcgaaaac

SEQ ID NO: 560489 - DNA, 797 bp, Homo sapiens
  misc_feature (107)..(107): n is a, c, g, or t
gggccacctggctaattacattttccaagattctctggcccacctgcccctcatcctgtgcccataaaacccagttcatagggggcataacacaaggggctggatgncgagaggagcagaagagcagaagaacacaccagcagacaccagcagacactgacaggccatcgacaacaggacaacgcggaagtctggcgggggaggaacttgaagagcccagccgctaggtttttcaactccaggggaagaccaccttcccactccatccttttttttttttcacatccatatcactgagagctactttcccccactggggggccccttgcgcccatgctgtagaaagagaaggataaaactcgttggcctcaacagaggagctctacagacggttccttttagggagggataatacatggagctcgcttactcactcgtttggctatgccattctgttcgccagagcgcgagtcaaatacatccctgcgaggtaagactaaccacaaaactaggatgaaacgaaagtaagatctcatctgccaaattcatagccaatgacctgcgacccagataaacatatcaaatataaaagaaagctcataattgaagatagttacaagtaaaaaacataacacatttgtcatgactcaggactggagggggagggtgacagataattatggcgcgcgtcaggaaaatcagaatggggcgcaccggtaccgagagtaaaagggcgggcagcaaacacaaatattaactatcgaatgaataacagtatgagaaataaattagttaga

SEQ ID NO: 560490 - DNA, 453 bp, Homo sapiens
  misc_feature (1)..(1): n is a, c, g, or t
ntggtgatagaggatcctcgggagccttacctacaacttcgtttccactccatggattcgtgtcaatggccgagtcgtgggagctgtgggcatcagctgtcggaacgggcctcttttccaactgtgattccatctgttccttgagctccttcagctcgggggttgacatcattcttctgcttgcgggtgtcatccaggctgcgcagggcctcagccagctcgctcaccgcacggtcccgctcccgcctcaggttgtcacacagtgtccggatgctgtcacgctctgctacaatcttgtctcgctcctggaaggcccagtcccgccggcacttggccacatccgccccctggagggcttccttcagctcctggcacagagccttgacttgtttcgaaggattcaacctccttgttggtctcccagcatccattggtcacggtctttgatcttgc

SEQ ID NO: 560491 - DNA, 358 bp, Homo sapiens
tgctcgggggcactcacattattacagctatctggggcagagcaccatgggccaggcttcctgctctcctacagccaagattggctgatgtgcctgcaggaagagtttcagtgcctgaaccaccgctgtgtatctagctgtccagcgctgtgatggggttgatgcctgtggcgatggctctgatgaagcaggtttgcagctcagaccccttccctggcctgaacccaagaaccgtcccctccctttcttgcaatgtcaccttggaggacttctatggggtcttctcctctcctggatatacacacctagcctcagtctaccaaccccagtcctgacataggctgctggaaccccaaga

SEQ ID NO: 560492 - DNA, 297 bp, Homo sapiens
gagtggtctcggagtatcatctcagcattctctctccgctgacttaggtatatttcattgggtcagaaataatacgtggagaggatgtatcttacaacggaaatggacaaaatgatagtttgctacattaagtaagtaaattcatgtatcgatataattaaatccatgttagaactaagagttctatatacgatatccattgtcttacttgggcttattctaaacttaaatgctagtgaacacagtgttaggaatatacacaggctgcttctctggagttattacccactcagttta

SEQ ID NO: 560493 - DNA, 323 bp, Homo sapiens
  misc_feature (10)..(10): n is a, c, g, or t
  misc_feature (238)..(238): n is a, c, g, or t
  misc_feature (244)..(244): n is a, c, g, or t
  misc_feature (283)..(283): n is a, c, g, or t
atggaatcanctcgagtggagtggaatggaatggaatggtttggaatggaatgcagtggaattgaacagaatcattccgactggaatggaagggaatgtaatccagtggaatggaaaggaatggaatccacccgagtggaatggaagggaatggaattgaattgaaaggaagggaatggaatcaacccgagtggagtggaatggaatgggaatgggaatgggaatgggaatgggaatnggaatnggaatcatcccgagttgcaatgggatgggattgggattnggattggattggattggacttggattgtaccccgattgga

SEQ ID NO: 560494 - DNA, 218 bp, Homo sapiens
tttcaggttactcgtggacaatccattgggaatccgaggagggtctgtcctgttcgggctgctgctcgtcctggctgtcttctcgcattcaggtcatagcctgcagtgctacacctgccctaacccacctgctgactgcaaaacagccgtcaattgttcatctgattttgatgcgtggctcattaccaaagctgggttgcaagtgtataacaacgtgt

SEQ ID NO: 560495 - DNA, 741 bp, Homo sapiens
gggccctgcgggttctcagaggcaagttcagaccgtgtgttttcttttcacggatcctgccctttcttcccgaaaagaagacagccttgggtcgcgatgtggggcttcgaagagtccagcagtgggaatttctagaattggaatcgagtgcattttctgacatttgagtacagtacccagggttctggagaagaacctggtcccagaggagcttgactgaccataaaaatgagtactgcagatgcacttgatgatgaaaacacatttaaatattagttggacagatattccatctcgggatatatggggaaagatgatggcggaggaaggatgatgactggatttgttgtggtaatacgttacgatagaaatttgaagagttgcgcgcaggatagaatgagaggtggattttatgttgtgtagggtggtgatctttttcatgaaaataagccctcaaggaaaaacattacatacctggcctcgagttattaagaaaatattgtatgggtgatcgggctgtccagtttgaaattctcagtgatcagtcagtcaacttggttttagtaagtttccatgggtgaactatcaagatggcaactcaacatttcaattccagtgtgtagtattcatggcaatcatgagatcccacagggggcagatgcacttttgtgccttggacattttaagttgtgcttggatttgtaatcactttggacgttccaagcttgtggagaagattga

SEQ ID NO: 560496 - DNA, 245 bp, Homo sapiens
tctccctcttcagctgtgtgaggggaaagggggccgggaacaggctgaggctgaggtggctccttaacgtaggatcagctggtgaagaagagcggacgctcggagcgcctggcagcctgcaaaagctggaagaagctgaaaaagctgctgatgagagtgagagaggtatgaaggttattgaaaaccgggccttaaaagatgaagaaaagatggaactccaggaaatccaatcgggtacgagctca

SEQ ID NO: 560497 - DNA, 447 bp, Homo sapiens
ggggactatcagggggttcaaggggaccacagagttaaagggcaaatcgaaggtggaagaggggtcagacatgtccactgtgaccagccagttgatgctgaaggtgcacagggaggacgatggggtccaagggatctgccaggtggagcaccttgcggtaactggaaacctgcagacccagcggaatttagaagtccagtttaagcctaaggggcacattcagatgactaatcctttacagggtttaacccggaagggggacgcgctggagttaacatgtgaagccatggggaagcccaagcctgtgatggaaactgggttgaaagtcgatgatgaaaggcctaaacacgccgaactgtctgggcccaacctgttaatcattaacctaaccaaaccagataagggtccataccgttgtgaagcttcaaccatagtggggaaagctca

SEQ ID NO: 560498 - DNA, 310 bp, Homo sapiens
  misc_feature (16)..(16): n is a, c, g, or t
  misc_feature (24)..(24): n is a, c, g, or t
  misc_feature (106)..(106): n is a, c, g, or t
cagtagtgggcaggcngacaggtnagggcagtgcaccctgcacaaggtggaattggttgagcagatatgtggctcctgtacagccagagggggtcaaatccagccnactgcagagctatagatttttgggtgtttaccccttaataggcctgcacacagggcatatgaaagtccccaggctacatgtcaaagcagagctgcacctgctggactatgccacagccacagaaaagcagtatctgagctgtctctgtgacctacaccacagcttacaggaatgactaatagcagtcgcgggttaccgaagctc

SEQ ID NO: 560499 - DNA, 796 bp, Homo sapiens
cgcaaggtcatctggttggtattgacatctttactgggaagaaatatgcaagaatatcgtgcccgtcaactcataatatggatgtccccagcatcaaaaggaatgacttccaggctgattggcatccaggatgggtacctatcactgctccagagacagcggggaggtacgagaggaccttcgtctccctgagggagacctgggcaaggagattgagtcagaagtacgactgtggtgaagacatcctgatcacggtgctgtctgccatgacagaggacgggcggctgtggcgaatcatatggccatgggctgatataactggcgtcccagggttggcggtggtggcaggcgaggtgatcctctgaacctgtcaggggccccctccccgagcctggcctggctctggcccggtgctatgctggactcctccttatcacaatttatttgacgtattattgggttttccccaccccctcaactctgtcggggatgcccctgcccttcatcctagctcccttgggcgaggagcgaggcgaagctgtgggcttgttgagagctgccctcctcttctcccctcacactacagcctggtggggggagaagggggtgggtgctgcttgtccgtcccagtcttgtctttgatgctctggtgtcgatgccttgcagaccggagctgctgaaggggggcactctgggcgacggtgccgttggggccctccccaccagatccctggttcgggcccggtggtgcttttatgcgctttggccctggggtgccctcatattgtgggccccc

SEQ ID NO: 560500 - DNA, 256 bp, Homo sapiens
ttgcaatatcattgctgttagtaggggtgtgtgccctttctctcattgacaagggtctagcataattgcaaaagcgatgctctctcaatagtgtcttcataacagaaggggtggcaatactttcccaataccgtcttctctctctaaggtactacatgcagaccatcaatttgggcttgcaagtacccgaattttaattaaacatcaattgtgaatggggaaaaaagagaatatttgtatgttttaaccgcgggga

SEQ ID NO: 560501 - DNA, 233 bp, Homo sapiens
  misc_feature (69)..(69): n is a, c, g, or t
aaaaaatttttttttcccccccaaaatggggcccccaaaaaaatttggtggccctttaggcccttttanatttttcccccaaatccccggaaaggccccttttcccccctttttaaaaaaaaatttttttttttacccccccccagggtttttgggggccccgttttttaaaaacccccgggccccctttattggggcccccggaaaaatgttttttaaaatggattccggga

SEQ ID NO: 560502 - DNA, 665 bp, Homo sapiens
tccatatttatcaccaaaggtgtacccccccgttgtgtcttttttaaggtgtattagtataaacacttccgaggagattaaggccaaagggaggggggccccagcccctcttgtaatatccggcccacgggatagccccttgtcgttgtgtgcgcaacaccctttctcccccagacggggtctccacatgaaacagtggaagatctccttgttttgaatacgccccaaccacccacccatatccacatggtgctggactaacacataagagaataggggttgtagaagaaagaataccaatttgggggttccacacagaggtccatattggaaaacacttttttgtttttggttttggtaaataatatggtgggaaaacattttctcacagatggacacacagagaaggaatggtgtcctaactgtggaatgtagagggagtgaaacaaaggggagatggctttgagatccacaatggaggcctgggagaggtgtgcccacgaaaagcttgtctgtatagcgggttttgtgagagagagtgaacacactttccacactttttgagacacccctatcctgaagtatggttcccggatttggattttgattttcccaaagtagcttgaaatttccaaaaactttggtctgtttttttataaaatata

SEQ ID NO: 560503 - DNA, 196 bp, Homo sapiens
acatggatcgcgatggcgtaactccccatcactgcctgacgaagggcacgtggcccagagcatgggaggccaggagcatgggaggcccagagcatagggaggggtccccagtgtccagcacagttgtggggctagggccctcctatagaactacagaccctagcgtgtagcaggcatacaccggctacgaggaagg

SEQ ID NO: 560504 - DNA, 1697 bp, Homo sapiens
agctaccaatgtcgtgtcattctccactctgatatgaaagagagccgtgaatttagtagaacactaactacgatccatgcacagagtcatctaggtgctgtgcatttctcgatgcacgtcagataatagggcatgatggagtacctagcaagactctcaaccgatcttcattcattaattggagaacatctgttactgccctcatagttagctggagctccgtacatcattccaagttattctgactagcaaacccaggcaccgtctgcatgaccttagacgtgctatatcactataggtatccctgctttccatctgagaatgcaacatgacagcacaacataggcctgactgcataaactccttgcatggactacattctgccactgtcacaggaactgtaatctcactggacaataaactagggagtcttccatacttgagatgacatgctgcacaaatgatcttcaaaagcactttacagccaccagaggaactctcttgaaactacccaaaaatccatcagatatcttgcaatcaatgcctggcattacgaaagaatacattaaacacacccatgataacagggaggctcatctgagcattgaacatccgtgactgtacactcattacagacaacgggaacacataccaaaatgtgtcagaactaccaatgacacctgctcaaacacagaataccagcacaactacagggacacactcttcccaaaagaggtaccaagcctcccacgaacactactaagtaacacaagaaatccacgcactaacgctcacgccaacactgccaccaccatcatcgagagaacaaaaaatcaagaatagcacctaaaaacgaacaacacgcatataagaaaagcaactagccaacaacacacactcacaatccgactgaaaacaaaaagaatccgaacgaccaccaagaaacacccgtacacagaacaccagcgacggacaaggcaccgccagtcgcggcaccagcgcaggcgccgatccagccacagcgaacaccctcaccacatctcgccgcaccaccaaccaaccccaaccagcgcagcaccagcaaaagaacagaaacgacacagcaccacaagcaaggacagaagagcaaagagacaaagccaaaacaaacgagcagcagcaaaaacacaacaaaaacaaaacacacaccaacacacagactgaaaagaagacgacggaaagagacagcaatggagagggagatagggagcaaaacacgacagggacgacaagcaaggagacacaggggaaagcgacgcaagaggcaaccaaacagcaaccaaagcgcgacagagaggcccgacgcgccgcgacgcagaacagaagccgaagacaacgagacagacgacacacacagccagagaagacagagagaaagaagagaagaagcggagagcgaaccgaaatgcccaagacaaacgaacgaccacagacacggccaccacagacacaccaccaggacagacacacgagacaacgggagagcgaacacgaacgaagcaccaagacagcaagagaacgagcaagaagacaacaaagagacgagagaggacaacgaaacacgagagacagaccaagcgcaaagacagagacaaaagacgaacaagacacagagagaggcgagagaagaggaagacgaaggaagacagaaacgaaaa

SEQ ID NO: 560505 - DNA, 326 bp, Homo sapiens
gagagtttatattcattaaatttattttatcatttaaaaaattactgcctttaggttatcctaccctgatttaaaacacttggggacccatgccgttactggaatttactttaacaaaccccgcctttttaaaatgatttacccttgggatgaaattcaacagtggtaagggggactttttaaactaaaaacattgggaatatacaaattttttttttatttcattgaaagggctttaaaattcaacattctgccagggaagcaccttaatcccatagataacccctttgctaattgcttttacctaacttcacccttaaagggga

SEQ ID NO: 560506 - DNA, 133 bp, Homo sapiens
accctatagaagaactaatgttagtataagtaacatgaaaacattcttcttcgcataaggcttcgtcagagtttaaacacttgactctgcacatatatacacagcccatatactctcacatctacaccccaca

SEQ ID NO: 560507 - DNA, 510 bp, Homo sapiens
  misc_feature (344)..(344): n is a, c, g, or t
  misc_feature (416)..(416): n is a, c, g, or t
  misc_feature (435)..(437): n is a, c, g, or t
  misc_feature (449)..(450): n is a, c, g, or t
  misc_feature (507)..(509): n is a, c, g, or t
gcatctcattttaaatcattatgatcaatctctgataaaggcctagaatacaaattatgtcaaaagtgaaaaaatactatctcgaaaatttccttggggataagactactaaaattataatgcttcctctgagaaaatcatctctttgcatgtggtttgtaatggtaacagttctgtttccttcctgtcagaatgaggtgaaattgttcaaatatgtattttttatgaaatttacagtgttacctgtgtattctaattatttgattaaataagcctttggggaggcttgttgaggagagatatggtaggggtatcctggaacgtacataggtgtttttaaaggngatgtttcttctttctctaaaagaaagaaaagatcgcctaaatgtctactcttggtattcttctgctaaggnttaagaaccaggctgctgnnntttttctttttnngtgtcctgtctttctttatataaggttcaccgtaactgtaaaagagaagctgggaannng

SEQ ID NO: 560508 - DNA, 138 bp, Homo sapiens
tgaggttcccaagcttacgagggtagtacacgttcttactctttctttgcctcaattttatcatctttaaaatgggaaagggcacctatctagtaggctttcacttgacatgtttttaccactttcccacccttccac

SEQ ID NO: 560509 - DNA, 195 bp, Homo sapiens
cccccaggtcacactgcgactgtgcagtcattcgaaaggaccttgcccgtacttacctttcaagatgcttcaatcttatcaacgctacatttgtatttttcacacaagtataaattctgcaataaagagatgtagtttttttttgtttgttttttttttttttgtgtttttgtttttttttactgtttttatgtg

SEQ ID NO: 560510 - DNA, 784 bp, Homo sapiens
  misc_feature (23)..(23): n is a, c, g, or t
ggagccattgtggctccggccgnttgcgcgggccctcggaaccctcagggtaggcagagggttcgagggcacgagttcgaggccaacctggtccacatggcccaaaaaacatacacaacacaacaccaaaccaacaccatgtgtgtggggccgcccctgcgcctccggaaacaagacgttttatagaccccattgggtggggccggcggcgggccccccagttggctaacggcgaccgcgtgggccaataagccggtgtcccccacaagggggaaaacctctggggcataagagaccacagagggcgcggcgcattctcccaccacactcaaaaaaagccccgcggggggacaaccgcgagagcgccctggagacaacaacttccccagaagtgaccacacccgggaggggcgaaaaaaaaccggggggcttatatcaaacaaagggggggtgtcccacaaagcgcggagcctacgagaatttcacaagatagtagcccgcccttcgcgtgtggaggacaaaacacagaagagcagccgagcacgagcaacaccacgacgaagagcaagaagcggagacgggaccagagagcagagggctacaatgcgagcgagggacggagcgcgcaccgaggagtcgaggaggaccggcgaggtgaggaggaagagccgaggggggaggaagggggacagaacggggatgcagagagaccctagccagcgacggccgacgccgagcagagccgatcacccagcgcagcgaggaggagcgaccaacagggaga

SEQ ID NO: 560511 - DNA, 438 bp, Homo sapiens
gcacgagcaggacgtctgtcttcccagcacagcctcacccatcagcagtgttgtccctacttaatgctgtgtagactcggctcttgtaaaagcagtaggagcctgagagtgctcgtgtttccccgagtcctctggctgccaaagtctctgctgcaaggtcgaggtttgttttctcaaagtttccatgggcacactcatgacatttttaaaaaataaaatgaagccaaaatgattctggattctctcaaccacattttctttttccttacctgatttttgcctcaaaatcttgggtatcttgggtagtctctaaaaaataagtcatttagaatcatcgaattatattatttgtatataaggaataatagtttgaataatatttcttacttttcctttgaaaataaaataaatccaaacttgtttggcgttggtaaaaaa

SEQ ID NO: 560512 - DNA, 1627 bp, Homo sapiens
  misc_feature (180)..(180): n is a, c, g, or t
  misc_feature (929)..(929): n is a, c, g, or t
  misc_feature (1508)..(1508): n is a, c, g, or t
tacttcttagagggcccgtgatgtgcctggtattgattaatcaccacttggtggatgtggccagtgggcaaaggacctgactgagaaattcagtgattgtggccccgttacgactttccagcgatcgactggctcgtatcgtgcctgcctggtgggcttggttggtctggtcggtctccntccgatacctggcgtcatctctcgcctagctggcgcagcctgcgtggagcgatcgctgcacttgcgtagcggattcatgacctagcgtagaggctcgctgggatacactgagcttaagagtctggtaccggttgggtctagaacaaaaaagtagcgcactgtgacccgcagggaacttgacacgcgtaaccgacgtgcgacaacattgacggagtgactccatgggcatagactttgcttttgcccggggaagaagtttcaaaacgaaaactaagggctttcacatcacacaaactctcgggcggttcctacaccccttaagataccacctagggtaaggggccacctttccggcctcgaggcgaaactccaaccctccgtacctgtcggcggaaacttagggcctcagaagcgggacaaagcggtcgggcgtcgttggaaggccccactgactcggtgggccctttatggggcacggtcgacgcgctaatggacgggtctccaagagggcggtgtaattggctaacgccacgcatggggcccccaccgggtttaccctttgtccacgctggcggccggccacttttccccggagggtaagcggagaagcgccaaagctttggcctacggacatttttggcgaagggggcataacggttgggccgccctcttgtgtcgcctttgcgcctttgacattccaatcttcctaattatcatggctagggttcacgcggccccctttgtgtccnccgaggcttttacccccctcttcttagtgtcaacgccccgttttgggcggcggtccccctttccggcggctgcgcgacacttatgtgtccctctaggccccgaggggggagcttccgcgtgtgtggggcgcaaaagtccacggtggggaacccctttggttttggccgccggcacgtgttggcgggggcgccctttcgagtacggttgggcgcatgcgcatccggcctgagtgcggcggcttggcgggagccctatttaggaccccctcccgttgtccacacattgggtttggagggggtgcaccgcccacagtgataatccccgccatggctgcgcacttcgggctgcaccacctcgcgagcttgtgctggctgcgcaacagcggagaggcgcagagagcgtcggttaatataacccccttgtgtctcgtgtgtcccgtcacaggtaaataggccaccccccccactatagatgggacgtctctattacccaatagccattggaaacagaaacggtccctattttccacaaatgggtgcggaggtgagcaatcacacacgttagagtgtccagcgggntcttcctatcatgagttgcgcccccacgagggggatacacctccatcagagcggtgggacgtatataataggcggcccagggtatgttcgcatctcccgcagcggggcgcacacacagt

SEQ ID NO: 560513 - DNA, 102 bp, Homo sapiens
tgattgcgtcatgagtaaggcacttactgacatacagcgacttccccacactccactgcaagatggcgcgcgagggctggataggacaaggagcacttgagg

SEQ ID NO: 560514 - DNA, 544 bp, Homo sapiens
tcgggatagagcttgacccctcaatgccccttctatcgacgtcatgcgacgcagggagcgcatccgcggcgagtagcgcggcgacctgggcatcgtcgccccagaggcggatatcgacacccgagacgcgctgcgcctcggcagccacatcaacagcggggcagagtttctcgaacgagcgcagatcgtcgacccacagcctgacggtgtggccgcgctcctgtgcgagctgccgggccaggcgccagcacacgccgatgtcgccgtagttgtcgacgacgcagcagaagagatcccaggatgtgatggtgcgcatggggtgaagcggagaaggccggagaaggccgacattgtagtcggcggcttgttctacactgacgccctctgagcctgcgaacgccatgccgcccgaccccacgccccccgatcttcctgagacgcccgagagcgttgaacccagcgcagccgcgaatgtgcctgatttcgacgcgaaagcgaccatcgcgcgcctgccgaacctgcccggcgtctatcgctactttga

SEQ ID NO: 560515 - DNA, 150 bp, Homo sapiens
atcttataggactggagagtcaagtacttaatgaggaatgataggtactaggcaaagagatagggaacatccatggaagtgactctggctgaaactacctgagggaaatattgtgcagaggaggctaattaaccataacactctggaatc

SEQ ID NO: 560516 - DNA, 80 bp, Homo sapiens
  misc_feature (7)..(7): n is a, c, g, or t
actttcntgcccttacaaaaaaatggaaatttagtgtttttcagcctaagacattaaatttcatatcagaacaaaaaaaa

SEQ ID NO: 560517 - DNA, 207 bp, Homo sapiens
tttttttggggggggccaggggccttgtttaaagttgtatttggtattcttcccaatttcggttttttaaaatatggaaattaaaattgtattactcctgttttgatttttttggcccccagggtattttttgcccattttgtttgaaagtataaatgttgaaaattgtttaaaatgcgcccttgaaagaaaaagaatctgaattct

SEQ ID NO: 560518 - DNA, 406 bp, Homo sapiens
tataaccttctgcctcagtcttctgagtagctgggatacaggcacaagccattttacattccagccagcagtgtataagggtttcagtttctccacatcctcaacaacactttttattttctgtttctttgatagtagccatcctgatggatgtgaggtggtccttgtggttttaatttatatttcccggtgagtaatgatgttgagtactatttcatatacttaatggcactgggatatatccttttgtgaagtgccttttcaaatcttttgcccatttttgagttgggttgttttttggttggttggtttttcttgtaaaagttcttttatatcctgcatatgagtcctttgccaaatacatatgttacaaatattttctcccagtctggtttgccttttcact

SEQ ID NO: 560519 - DNA, 989 bp, Homo sapiens
tgcgggggccaaaaaggtttctttttttacaaaaccgattgggcccggggaaaaaaaaaaaaggggagggggccccccccgcgttccccccggcgattgtgttggtgggttgtggcgggccggcccctcctactactccgacgagtgggggtgctcgcagccgggccgcggcggtgggccgccgagaggatgtgtgtgggccgcctcggccccatgttctcgcatttatcccggaaggagagcagatttagttcttccccgggggcagcccagtggctggcgccaaaagccgggggtgggggggcgcctcgtgaagagggcatggggggggagcaccagcgaggagcagccgggggcaggaggccggcccccggaaagcgggggcgcggggaggaccccacccccacagagcggggtccttctacccatagcacgaccgccgcgggtcgttgtcaggcaaaacactgagcagctgggggaccccccaccacacagtccgcaggaggggggctcgacgggagacagcaaaacagaccccccaccagaaaaatctcggggggagacccccgcccgccttcctcctggtggcgacgcagcgaaaacacacccctcatctgtggggcgtgcttcaatccatcctcgcgggggacgaaatccacaccaccacacggggggggaagacgaccggggctttggccggaaacacccccgaaaaaacctaagtatagtccccccgacaacggggtggcgcaaccccaagaaggaagagggggggtggtgctcgcccccacaccagcgtggcctcataaaggtgtcagtgcccacaccagcaggagaacaaaggagggcactaaggtggtgactaacagacaccaaccgaaggcggccatcgagtgtgaccaagagaggagccgtagaccccacaccgagccccggtggattctgtctaacaagcggacaaccagggggcaagacgtgcgagtgggacc

SEQ ID NO: 560520 - DNA, 758 bp, Homo sapiens
tcttcccataaaaatgggtccccacggtgctgcccaggttgctctccaatcccgggggtcaagaaatcctccggcctttgcctcccaaagcgcggggattacagttggaagacgccactggtcctctgcactggaggaggctccttaccgggcggaacatcaggcaggtctcggccaggccaggtttcaagaacttacggaaagctgggtctgggatgtagttgcttgtaagagaagcttctagagagatggggcacatcctgtactgtggctgcttctcctgtccttatgttaattaagtaaagttctggaagtgattgtaaatggctaaaactaatggtaaaactggtaatgccagaaattaaagagagactatgtaacattccaggattataaaggaattgtatgtggtcactggggacagaaaaccacacacctaacagaccagtgtcacaaagagtccgaagggaagagacaaatataggccagggaaacacgtgctaggaagtgaaagactcccagtggcaccccctctcatgtataacgccgtgaagcttgcccctacccgagaacttacgtgaactagaagcataactagcgcacctatgtgagaaagcccgcaaggaccaaagtaacccgaaggggcccaaacgacaatagcagcgcggagacacacccttgaaaaagacccaacggggagaacagcaaagtacagggggacctcaaaggaaaaccaaggcggcaacggcgacggggaa

SEQ ID NO: 560521 - DNA, 710 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccccaaaaaaaaaaaaaaaaaacaaaaaaaacaaacaactgtgtgctgcggcgcgcgcgcccgcgggccctccggagaaaacgtttctaaaacaccaatcgcggtggggcggcgcgggggcgcccagaggaggtgaaagtgggacaccagtgggcgccaaaaaggactggtgtgcccaccaaaggagagagcacccgggggccaatagagacaaaggggcggggggggttctctctcccccaatataaaaagaaccgcccccggggcggcgacacaccgagagcgcggtcttgtgagcccaaacccccaagaagggggggcgcgctccaggggggaggcccactataagggggggagttctttatctaacacgcgaggggaggcctcccagcgcgcgagagcgtcccgagatattatctccacaatttgaccgccccccggtgccctgggggggggggataaggacgtaatcatacgcacatgaccaaacaaacaactatcataaagcaaccaaccggccacggtaaacaccagaacggtaactaccaaactacatcaagcacagacacaacatgacaagacgaaaaccagg

SEQ ID NO: 560522 - DNA, 133 bp, Homo sapiens
tacccacacaggccgtcctgcgcgggccctcccttggaaatctgccctgcctgagggcccctctgcccagcttgggcacagctgggctctgccaccctacctgcttcagtgtcccgggcgcagtcgtgtgagg

SEQ ID NO: 560523 - DNA, 1274 bp, Homo sapiens
  misc_feature (326)..(326): n is a, c, g, or t
  misc_feature (776)..(776): n is a, c, g, or t
gatcaccatggcggctggaagcctgtgacacatatcctgaaaactggaagcggcctctacacacgctctcatcgctgctctcgctgacagctggggctcgaggctccgcctgctgcgtctccgctatccaccctcaccttccgatcttttggtcaagacccagaatcgtagccccatgcaatttgctccgatacaggtcgctgcgcggcccaggtcccaggcttggtgagggtgattgactgggacttactcgtgatagtctggacgacgccatacggcacaatatgctcctaactgagtggttgacggcaattcgacgcgtaggncttgcccgggcgaaaagttaccgtccccaccggacgcgcaagcctagggccgcatgcgatggggtggccaatgctagtgggctagaaagcgtgttgcgcctggaatctcccgggactaattaagtcagcgacccgcaagagctcgagagataactccgtagcgagatcgatttcgcaccaaagcgcatttcgagagcaagttccaatatgggcaatcgcgaacaaaagctatatataccccaggggcgcgccaccgctcgaaacggagagattggcctagaagataagtgggcaccgtgcaccaagtttcgaagagagccttgcaggaatactcccctgcgggcgcagcctttgcggctctggcgcaataagcctttgtggacatctttgtcgcgcaccaccgcaagtggcaacggcggcaaccttgatgatatgacctgtggcgcttangggccgcaggataaccccggaggtgcggaaccgcatgttaggcggcctttgcgaagatatcggaggcaaaaggagtttgggttcctggtggggccaaggcccacccttttgaatcttgggtgaggtaggcagttcccttggacctggaccaattgccacggaaggggggacttgtttgccaattaacggaaatgggcccccgttccccggttcatataccgccatgggtagcccacagggagcgacggatttaatattcaccaccaacacaagtcaacggcccaaaaaggcgcgaaggcgagttgggggattatcatcacccgtatccagacccccacaatttgcgacggaatatgataaaccccaccccgaatgagtcattgcacactctagagaggtaatcctcccacaaggggatagtcccccttgggtgtccacttctaggaaacgacacaaaaaaagcgcgcttggacaagagaaaccgatacgtcggattgg

SEQ ID NO: 560524 - DNA, 101 bp, Homo sapiens
gtgtgatctcacgaaagctgtgcttacttgcgtctggtctagaggccctcctggaaaaggccaggttagtattgtgtccctggaggcaggtacagtctaga

SEQ ID NO: 560525 - DNA, 666 bp, Homo sapiens
  misc_feature (154)..(154): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (173)..(173): n is a, c, g, or t
  misc_feature (662)..(662): n is a, c, g, or t
cttcagggtctcaagatggccagcttttggacttacaccataggctctactggtccttaggcctttggactgaggctggaaccacatcctcagccctcctggatctccagcttggcaactgcagaccttgggacatttcagattccataatcangacgnagncgntggcagcngttttccaggctagctgtcttcacaacccgatggctctcttcttttctgctgccacagagactgactgtctgcctcctgcaaatttgaaatttggcaaacctgcctcctctgcttctcagaaccaaactggggccaggagaacttctgacccaagtgttgatcacctctcttcctgcacctcactgtgcaccctctgctcaggaaatgcctttggcgtgttgctgacgtctgtccctgctccatctcttaccaccctgcacttcaccctttcccacacaggtttcacctgatctcagctgctttgggcagaccatccaggtattttggagtctgaaaaggatctctgtctctaagtctggtgcaaatggagtttgggggttttaaaattcattcttcttgctgctgtttcacaatttctcagaaaaggtgaaaatgcagactttggcagttatgttcaatatgaaaagtcttaataaagtaatttttgnccta

SEQ ID NO: 560526 - DNA, 105 bp, Homo sapiens
tgaaattacagattttaaatgccatgttcattaagaaatccagggtattcagattctggggtttttcatattgtatatatattcatatacgggatagttcaatgt

SEQ ID NO: 560527 - DNA, 152 bp, Homo sapiens
catatctaagtagtgagactgagtctatattctagtgagtcatggggtagctcccagcttcttataagactcacagtatcactaaacatgatatatcagcttttggctttcaaattatcaatctcttaaagagaatccaactttattacggt

SEQ ID NO: 560528 - DNA, 428 bp, Homo sapiens
tatgacaggcacaaggagtaagagcatatgagtacgctacaactcattgcatagaaatctaaaacaccaaacattaaatgtggatttacctcaatcaatgatttgttaagcactgaacacttactatgtaaagtatgcccactcgcatcaatcgaatgtacccttgtagcaaggtactacggaacacttgaaatcagtttgtttcaccatcaagttaaaaaaagacttttacttacagacgaaggcaaaccaggaggcacctttctagactttttcatgcttgcacaacgcgatctgcacgatggaacacaatacatatctatcagcataatataccagaccaacatccagacttaaaattaacagaataacttttcccctagcgtctttcttgtataccaatatttgcgagtaagcagcaacataca

SEQ ID NO: 560529 - DNA, 300 bp, Homo sapiens
cggcccccatgtaggggagagcccaagttgacaacaagtaatttaacaatattgtatgaacaattgttagagacagctaatcacaaacaacctgcgggcacaatgacctcattccacacgtagcactcttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 560530 - DNA, 393 bp, Homo sapiens
  misc_feature (393)..(393): n is a, c, g, or t
atcgattggttcatgcctggttccagggcgacgttctgcttaccagcttgcctctcgtacgactttgcatgtctgagagccgtgcgcgtatcgaacacgataactgacctgtatgagtgtagaaatgaagatgcgacctgacacttactacgatggaatgtttggagagctaatagcgacgactgacgatgtacatcgagatgatactactcaacaggcgagccacagttgtgtgactgtaccgtgatacactacgaccacatggacaacagtgaatgcatgtatatttagagtggctcgtatgctacacacacttagagatgacgacaggcatggtcacaagagtgttgtttgaccttcatggctgtatcgtagccctggtgtggttcgctn

SEQ ID NO: 560531 - DNA, 128 bp, Homo sapiens
ggtacgtggtgtactattggatatgtattggtatgagccaaaggccgacaccccccttcgggctgctatatatattttatttgtaggtatttatatattgaaatattaaaacctagattttaaaaatc

SEQ ID NO: 560532 - DNA, 267 bp, Homo sapiens
cgtcgactctagtagtatccccaaaaccaggtattaaaggactaagaatgtggaggacccaggacatcaattaagagagtgcccaagggtgttcagcataattatttgcttggttggcaagttattggactctatccttgagtttttttatgttgtcatataccaggccagattgatctaggtaaaaacaacactcttcatttaaaaatatacagagtcgtcctttttcagcactgagtaaattgaggccttggcgattttgaagca

SEQ ID NO: 560533 - DNA, 643 bp, Homo sapiens
ccctcttgtagttattttcgcctctcttgtcgcggcttgcgcgaaagagtgtcttctcttgggaggtgtctctggttatataaattcttgaagacgccagtgagaggtggcacaacacaaattatttgcgttgggcggtaccacaacacaacagcactccctccgtcgtgagataactcgctgcgcccacgagggcgagagaatatagtaggtgattatagaaccatttttagtggagaggggtaattatataacacgcagagttggggacccacacaagcaataggagctatccaatctagttctctctgctgccgcacgcccgctctgtggcccgcacacgcttgtgcgccccgccacaaggatatatatgctgtatctccgctctgtatgtgtatgtgcgatctctatatgcgagagaagtatcttgcagcatacacaatatatgtaggaaacaatcgtggggagacactctgtctctctgtgggacaatgatgtcatcaccgtgttgctagacccatcaaatctccaattatcatgaacttcttataaccccttcatcacctcatttctctcgtttccccacacaaactctattcttgacacactccccgttctcatcaatagatacacaaaatataca

SEQ ID NO: 560534 - DNA, 359 bp, Homo sapiens
cgttaaagcccgtaaaaccccctacgctccaggcactcacgaagagccccaggacagatgccggttttccagtaaactggcagtgaagacggtgcctgtgccagcgtatcacccggacggcggtgctggcgcagcatatcgagggtgatgaaactggcctcttcactcagtaacctgaccggcgttgtctgccgcggatcggatttctgcatccgtaacggctgtaagacgccacggttcgccagcaatgcgtacagttttgccagttcctgcatcgtcacttcgccaccgcccagcaccagcgataaaccataatggttctcgctggacatatccgccacgccagtctcacggagaag

SEQ ID NO: 560535 - DNA, 244 bp, Homo sapiens
accccatttcaaaaaaaaaaaaaaggaaaaaaaaagagagggactggatgcagtagctcacatctgtaatcccagcactttgcgaggccaaggctggaagatcccttgagccaaggagtttgagatcagcctgggcaacacaggaagaccccctctctacaaataatagaaaaattagcagtgagcagagatcacaccaggtcactccaacctggtcaacagagttaagacccctgtctcacca

SEQ ID NO: 560536 - DNA, 231 bp, Homo sapiens
cgggcatatgaaagttatttacctcacagaacctggtggatgatttacggtacttcagagcccttcccgtaatgtgatgggcagaggttccagaatgttgccaagggtacggagtgagatgtctgatgaaagtgagagaactaagggagagctcgtgaagcagttgagaaagaatttgagcctcgggtgaattggttgacagaataaagcccttaaggacacgaatgttca

SEQ ID NO: 560537 - DNA, 1088 bp, Homo sapiens
ataggctaggtggaggccgggtgtaaaatcggacgaggcatatcatagcgactactgagcctgggagtatcatcattgtggttgtcctcatcaaggtgatgctggataaatagctagtgcgtctgcggggcagcctctccaccttcatcccgaggaagcagtggtgtgagcggaagctggactgtcccttgggggaggacgaggagcactgtgtcaagagcttccccgaagggtctgcagttggcagtccgactctccaagggagcgatccacactgcggggtgctggacgtcggccacagggaagctggttctctgctcgtgttgcgacaaacttcaccagaggctctcgctgatgacagggcctgtaggcagatgggctacggcagcaaagccacttgcagagcggtggagatcggcccagagcagggatctggatgtcgttgaaatcacagaagacagccaggagcttcgcatgcggaactcaagtgggccctgtctctcagggctccctggtctccctgcactgtctttgccttgtgggaagaagcctgagagacccgccgtgtggtgggtggggaggaggcctcgtgtggattctgtggccttggccggtcagctatccacgtacgaccactcatgcccgtctgtgggagggagcatgcctggagccccagtgggtcctcagctggcagcccacgtgttcatgaaacataccgatgtgttcaactgggaggtgcgggcaggctcagacaaactgtgcaagttccatccctggctgtgggccaagatcatcatcattgagttcaaacccccatgttaccccaaaagaaatgaccatcgcctcaaggaagctgagttcccattcagtttctcagggaagtcgggccatctgctgccttttgggtgagagtcacatcagcacccacttggtcaatggatggcgtgaagcagatgggggaaatcttgcatggtgggggccgcggtttacgcacggatgccgcagtccgggaacaaaattgggcgcagggggcgcgagggcataacaccgagtggcggggtgggcccacgcacataggggggcagagc

SEQ ID NO: 560538 - DNA, 461 bp, Homo sapiens
  misc_feature (380)..(380): n is a, c, g, or t
gaaatatgacacccatgtgaagtgtcactagtgacggtggaagtgcccccaaaaggtagaaaaaaatcatgacattgcaagaaaaacttgaattgcttaatatgtaccagagattgaagtctgcagctgtggtggcccactatttcaaaataaataatccagtgtaaggaccattgtaaaaaacgaaataaggagattaaccgaataagcagtttctgctgatcaggaggccatagacaaattcccaagtactattaaggaaatcattgaggagaaaggacatttgcccctacagtttttttaatgcagacaaaagtgcactattccagaaaaaatttttcacaaagggcacttattaggaagagaaatgagcaccaggntttaaggcaagaagggaagactaactctaatttttgtgcaaatccagttggatttatgatcagaaccgctcttgtttataa

SEQ ID NO: 560539 - DNA, 929 bp, Homo sapiens
  misc_feature (566)..(566): n is a, c, g, or t
ctcgagtgactggaatcgctccaatgcccccactcagagtccagacgaaggtcagaaggctgacaccatatgtacctccttcatggacgtgctgaaggccttgtctcagaacctcttcaggccatgctcttgggtgtctggattctgctgcttctggcattctctggccccttctgatgggctgatacgtgctgtgtagaatgttcctccgatagctcaaagggaaaagcagaccagtaatgcgtaaactgttgtgaacgctgagatggaatactacgccatgacctctcctgatcattcagatgacctgtgctgcttcttgcatcctgggcagtcccatcgccgtctttcgacatgcatcggcacaggcaaaaggaaccccatggatcttggatggcaaccatggatgcgcctccttcccatctcagccgcgcaaagttccatcccatccggcgccgcacattgacgcccgtcgggcctgcgagcgcacgttgcctccgacgctcatcgacgtttgcccccatgtcgctgttactaccccgttgccccaatcgcaatagcctccngcgttcgacttgtccaccctcacgtagacgtaatgtccattgttagattaccataaacgtcgtcatagtctgattcgttcctccacgcaaaaaaatagaaacatcaacagttttaataatatcatccagtgggccgcgagcaagtccaaaaaaaaaatttcccccctcgagaggggggcgccccagaggcgttttccgccgtatacccccgagctcttctcttgtggtcgcacaccgtgtggccccccctaattggtggcacgctcgtatttattgacgcctaggggcgaggtggccccggtagggtgtttcccaccttttcgatgacctgtgggacaaacggtcggtacgctttggacacct

SEQ ID NO: 560540 - DNA, 159 bp, Homo sapiens
ggtctatgcatctctcgatatccatgagcagagcaaggcacagtactcattactgtaatgtctctatttacagctacatttatcttatacatagctactcatgctcatgaactacttgctgactaaatgttcttcatatcactagataaccttggtctc

SEQ ID NO: 560541 - DNA, 835 bp, Homo sapiens
tcagcgtctgtcaacacggtgagcgtttcctggagcttttctgagtggctcctgcacccttgaggtccagcggcgctggtgagtcctgttgtgagagctgttgctgaacgttcgcgagtggcggtcactgaggctgcgcgtcagacctcgcggaattctggccggtgttcgtgatcccgcttttcgcccccgtaggggttcggatcccgctctcgcccccgaggggttcggatcccgctctcgctccccgaggggttcgggatcccgactctcgcccccgaggggttcggactcccgcgtctcgcctcccgcagggtgtttggagtcccgtctctcgacgccccgttgcagggctcttgtgcgaggtttcaacgcggatcggtactgaacaatgggaggttccacgttcggaggcagagcagtgtatcagagatccgggactactgcatactcagacgaccctgagtgcagtcgccctaccccattcaacgaggtggccgtgagcaaattctccatgacgattgattcatgactcgacataagtacatccgggaaagttcatctacaactgacatccctgtctggcgccagtaaggccccaggctgggagactccaggtctcagaggtctctgaaccccacggagcgatcagtgctgcccagtgtgaaagaataatgccagccggggcagccaaagataacggtgtaaaaattagacattctgtggaaggcccacgttaagcataagacggaagataggagatcacggcgctttacacatcaggcttgagtgacactgcgcgcaacttcggctcattgaacactctagatcccgg

SEQ ID NO: 560542 - DNA, 140 bp, Homo sapiens
ccattttttttttttccccgggggcccccaaaaatttttttttgggggcccccaaaaaaaaaaatgggccccctttggggatggggggggggtttaaaaaatgggggaaaaaaaaaaaaaaacccggggggggtttccca

SEQ ID NO: 560543 - DNA, 356 bp, Homo sapiens
aaagagtgtctatccagcacgtcagcctcatggcagctttcaattcattcaatgtcaaacagtcacctcaacagcagccacaggatcgtcaacctcacgaaacctgcatttacacaatttcggttgggagcagcactcggcagtcacaaccgaaactccgcagcagtcacgtgctcaagcacttcaccagtcccacagcgcaactcactcatactccaattgcatccgacatcaacttgcacccacacggcacaccacagttcaccctcagggcatcacacagcgccaatcctcattctcagcagtcccatcatccacacaatcaaggtttacgcacctcgcatgtctggctccag

SEQ ID NO: 560544 - DNA, 209 bp, Homo sapiens
tgctgtagtacaggcatgagccaccaccacacctgaccataacaagtcttatctttttaaaccttggaaaactcttagtcccagctacttgggaggctgaggcaagaggatcacttgagcccaggaagtggaggctgcagtgagctatgatcacaccactgcactccagcctcggcaacagagaaagaccatctcaaataaaaatacaa

SEQ ID NO: 560545 - DNA, 196 bp, Homo sapiens
aagcagtatacagactcaaaaaatgagcaattaaagacttaaacggccaaacatggctgccttagcgagagtcggtcctgcctcattaattgtatgaacttgggtttgattgcccaaaaggaaaagagatgagaccttgtgccgtctaatggatggatgcgaaggatgaaactgaaatcctgtctatatggctgag

SEQ ID NO: 560546 - DNA, 376 bp, Homo sapiens
  misc_feature (5)..(5): n is a, c, g, or t
gttanctgcagctctctctgatggctggtcttcatctcccttctgctcttagcttcatacagggcgcgagtggggctcgttgaagaagcgactcccacagcaggaggatgatcagccccagcagcagcagccttgacccacgggcaccagcaccatgcacatgtcgatttcggccggcagctcctccagcagctccgagtcaatgtccacagagaaccacgtggtcttgttctccatgttgatggtggggatgctggttcggaggaaatagggtagcccagccatttacccggactcggccaaagtctctgtaatcctcgatgaaggtgctgttccacactcgtgccttcacagtcacgttggtgccaaggggggg

SEQ ID NO: 560547 - DNA, 528 bp, Homo sapiens
ataacttactttctgcaactgttttcttagaaatggtgtccagatagctttcactaagtgtgttaaatgtaagtgagagctatgatatatatgtgtatatgtatagcacatatatatacatcacgagcacagtatatatagtttagaaacagtgagtgttaaagatagaatttgttttcaggacaaattttgaagaacaatgtgggaatgaccaaatgtcctttagtaagaaaaatagaagtttgatttcaagggagcatactagtttcagggattttcagatgggaagctgcatttgttaggattagcccatcttaagagatgcttgcaggaagagattgtatccagatattatagtttatttcatgttaagataattttcaaaggttaattttctagataagattaattctcagtatggtgtttgtgctttctacaatggccaagtaatacatatctttcagtcatcattgtacactaatttatttagagtttaatttgtaagggcttaggaagtaaaatcttgtc

SEQ ID NO: 560548 - DNA, 422 bp, Homo sapiens
tccaggtcgtccctggcgcagggcaggacgaccctggagggcgcggtcgggctgatgcttctgcagtgcggtacccggagtctcccaccgcaagaaggaggaagaggagcgcagggccccctgtgtcctacaccttcccacgatcagaccatgaaccagatgcgtacaccagaaaagcatagtgtcaccgtcgacgagagagacaccaacgatgaagcagaccccactgccgaggagcgaggggagccggcggacagacgggagcagacacaggagacctgacaccacagaccacgcgcggatgccaacaatcaacatgctccaatacgacagccaggtgccaaggaggagccgctcgcctgaaccagcaaagtagataggataataggtagcctgccaacaatgcagcacaacaactacca

SEQ ID NO: 560549 - DNA, 597 bp, Homo sapiens
tgtgtgtgttgtgtgtgtgtgtgtgtgcgtgtgtgtgtgtgtttaacagagaatatggccagtgcttgagttctttctccttctctctctctctttttttttaataactcttgctgggaaggtggtttataagccctgtgccaggtgtaagctggttgtgaaatacccaccactagagttttttaagtctccatattttctccattgtgccttcttatgtatttcaagtattattctgtgcactttaaatttacttaacttaccataagatgcagtgtgacttttcccacacagctggagttgtgaggctcttaacttcttaaaagtataggtggcatcgtgtgaatcctataaggcagtctttatgtctctaaacattcacacctacttttaaaaaccaaatattatgactatttctatcatgggtcgggccctttataactctctctcaaagatcacgacacctttaagaccccatggagttcacgtggtagggcaactccaacttcggagttcatctcttcaaatatgtcgtgtatagtccatatcacagggctgaaactggaccacactatggctgatggtatgcgaacacac

SEQ ID NO: 560550 - DNA, 186 bp, Homo sapiens
gctcttgagaggtatggttctgagtgtcctccgtattttttcgaatatcgttgtccttgttaaggttgtggatgatggacccggatgccattttagtatggctttgaagaaggcgtgggtacagatgtgccggagtgctaggtgtggttggttgctgcctatggttacttttatgagtcctagttg

SEQ ID NO: 560551 - DNA, 313 bp, Homo sapiens
atacctccgtgacactttctattttcagtagagacgggtttcagtatttggcgagactggtctcaaactacctgtatccctcgtagatactgcccgccttggtctacccaaggtagctagtgattgcaggcgtgagccaccgtgccttgcctactggcaaacttttaagttgtttctaagcttttccttattcataacaataaataattgcatatatgtccagtatctctgcacagtacattccctgaagaatttactacgccaaaagatggattcatttagatttttcatagttattatcaaattgtccggg

SEQ ID NO: 560552 - DNA, 473 bp, Homo sapiens
  misc_feature (50)..(50): n is a, c, g, or t
  misc_feature (88)..(88): n is a, c, g, or t
gtactctagagatccgtggtctgtgctgggcgtggtagtctgaagggatnccatgagggttgaggctggagatgtgtctggcctcggnccagtggtgagcgcatgctcatgtgcaggaagatctggtcctctgataactgcttaggctgacccctctttttcctggaggacggctgtcagagatggggctggctttctatttgaatttcagaggcagactcgtgcagatgggtgcgggcagaggaagggagcccatggtcttcctgaacactctgagaattcccagagcaggctgcatgcaacttcctgaggttctcccaaagccagacagggagaacaacttgtgttcaggagaagggtaccatataatttaacaaactgttacttagataggtgccttggccagagaaaaacgtccttgggccctggctcagggaacactgtggctctgcctgttcttggtgtaactcctg

SEQ ID NO: 560553 - DNA, 246 bp, Homo sapiens
gatttctaaaaataagttttagcctgggcccggaagggctaaaataaaagtttttaaggggctggcctttttccccaccttgactcatataccccaaaaacaaagtttttttggtgtaggaattggaaacccaaagtggaaaggaacgtaataactcgttggggttttaaaattagggttttggccagtaacccttattttttaaaaaaaatttaattttaattaattaataaaaattagggtcca

SEQ ID NO: 560554 - DNA, 323 bp, Homo sapiens
ggatcaaaaatttaatcttaatctgtttatttccaagggaaaatttatgtttggggaaccaaattaggatggatggggccccaagggagaagggtccccgcctgttatgcatcctttcaggaggtactggatttgttgttctttcaaaaagccttgaaaactaaattatagggtaaaaaaaaactggaaacccggaactttggggttcctcaaagttatggggcccaattgtctttggggcctttcccctgggttttaaaaaaaggatttttttcttatttccccccccaggttgtgagaaacctccccataaagggctttta

SEQ ID NO: 560555 - DNA, 443 bp, Homo sapiens
atagggacatataaatggcactgtctccatcaacacgtatcagtattgtcgcggtatcacggagtgttttgtggttcctccggagggtcagctttttgttggctttgtttactgatgtatcacatggcacatattacgtttttagcatggcctattctctgagccttcagatcccttctgtcatcgtctgtcatatcagttccgtgttttactacttcatttaatgtgggccatcattttttccaaacttcctagagccatcccagtagtatatttgagcctccactgagcccacgcctcagtgttaatcctatgttaggtcatagtgcctcatttcagccttcatccagcgttcacatttactgcctcgagtaaacattactcagaatcactctggcccattacagaggcacagtacacttctgagtactttagctactggc

SEQ ID NO: 560556 - DNA, 971 bp, Homo sapiens
  misc_feature (640)..(640): n is a, c, g, or t
gggcgcgccattctgtaggcgccctcccaaaaccccattaagcccccgcgccgccccaccttccctctaaggtattgttaacgtggaaaatgcgctctcggagagtatcatggggcaggggtgttccaaatactagtcttcgtcatgtgggtaggtgcatagtgtcattgactatagctctcagactgtcgtatacagcggggcgaacccaaaacaacaacacgcatccccgccaaaggaataccccaaaactggcacaaacgcccccaacgcacccattatccggtctctgtttcgtctctcatgccccgtctcttttgaatattataattatttatttttaataatataaatatgattataacatcgctatcgtcctggtgagggcatcatgtcacagctcaatctttatatagtatagtaactccgctcatacacttccgccgccaacacgggtcgtgcatagtctacaaccgtcgcccatgtccgggcatcctcccacacaaacttgtatattgtctctgtctagtgtggctgtgtagtggaccgattcgtaactactagaacaagctaagacacgagtgacagaacggcgatgagagcgctctacccgctccgctctgccccagcatacgcactncacgaccaactcacaaacaattgtctttgatcagtgaagtagctcccacccagctgcgcggagccgaatatagagtgataagtagtagtcatgctctatgagagtactataaactcactctccagtcagtgtttacgtcaacgcgttaatttacaaacgatgtcgtctgcctactagtatgcccagttatgaacgcgcgaaggaacaagcagtaacgggagagtacgagtaggtccgcgtgagcgcgtcgcacgtcggaccacacgatgcccgccgacgcggaatgtagtgtgagagatctcatgccccgcgcgcgcgcgacgcccgacat

SEQ ID NO: 560557 - DNA, 1308 bp, Homo sapiens
  misc_feature (1231)..(1231): n is a, c, g, or t
tgctgctgaggaagcggagccggagcccgagctggcggctccgggagaagatgcagagccgcaggcggggccgtccgcgcgcggctctccgagccctgccgccccttgtggcccccgtgcgggcccgctgccccgcattggaccttgccacttgtgcggggcagccccttgcgccatccagacccgggcccggccggcggccggggccgctcagcaccaccaccgcccgccgccggggggggcccccagggtacccccagccttgcccgcagggagggggaattgggctcaggtgcccgcgttgaccgagggccgttggagggaatttcttctccaaaggggctgatccagcagggatcggcctcttgggcccccggagggagggaccccgggccaattgaggggcggggcgccatcctttgtcccccgttagcactggcgaaaggaaggtctgggcacccctctttgtgcctttcaaagaagccctcgtacaccgcgggggttccacggggactgattcttagagacccagccccttgggggcagcttccccgaaaccccgaaaaaacctacttttggggcgaccttacctgcgggccggccaaaccccgttcccaggcccgtggtggagacagctagggggggcgcttgacggggggaccaccaggcagccccttgacccctttgccgggcggggaggcccgacctttcgcttacccagagggagaattgcagggcctaacttcggagtggatacgtggctggccttgcccgaggaaggaggcgaccgcttgggttccagagccccggacagaagccgggcggccctttagagcgggggggagaacacgggagcttgcgctcccatccttttggagccgggggggttccacgttaattgcgtgcgcaagagatagggcgtctcgcagaggccacggcggtgttcccgacgcggagaggagagccacgcaagttggggcgctcagaaaggcgggggctacgaatggtggactatggacggtcaccggggggcgcccccatttttattaattgcgcgccccttttttttttgggccccttgagaacggtctgcgcgaacggggggaatcctcagtgaaaaaaggggagggaaagatgaatacgcagagatgcgggagaagagagcgaccactggtctgaaggagaggagacaccaaacgaataagagatgtaaagagcgcgcgacgagagngctctctttttcctattcactctcttcttctctccttcctttctttctttcgtgcgcgtgactccgagagggagaag

SEQ ID NO: 560558 - DNA, 420 bp, Homo sapiens
  misc_feature (46)..(46): n is a, c, g, or t
  misc_feature (67)..(68): n is a, c, g, or t
  misc_feature (78)..(78): n is a, c, g, or t
  misc_feature (81)..(81): n is a, c, g, or t
  misc_feature (83)..(83): n is a, c, g, or t
  misc_feature (110)..(110): n is a, c, g, or t
  misc_feature (118)..(118): n is a, c, g, or t
  misc_feature (120)..(121): n is a, c, g, or t
  misc_feature (123)..(123): n is a, c, g, or t
  misc_feature (139)..(139): n is a, c, g, or t
  misc_feature (141)..(141): n is a, c, g, or t
  misc_feature (154)..(154): n is a, c, g, or t
  misc_feature (158)..(158): n is a, c, g, or t
  misc_feature (160)..(160): n is a, c, g, or t
  misc_feature (163)..(164): n is a, c, g, or t
  misc_feature (166)..(167): n is a, c, g, or t
  misc_feature (190)..(190): n is a, c, g, or t
  misc_feature (205)..(205): n is a, c, g, or t
  misc_feature (213)..(213): n is a, c, g, or t
  misc_feature (224)..(224): n is a, c, g, or t
  misc_feature (229)..(229): n is a, c, g, or t
  misc_feature (234)..(234): n is a, c, g, or t
  misc_feature (248)..(249): n is a, c, g, or t
  misc_feature (255)..(255): n is a, c, g, or t
  misc_feature (257)..(257): n is a, c, g, or t
  misc_feature (266)..(266): n is a, c, g, or t
  misc_feature (271)..(271): n is a, c, g, or t
  misc_feature (278)..(278): n is a, c, g, or t
  misc_feature (286)..(286): n is a, c, g, or t
  misc_feature (289)..(289): n is a, c, g, or t
  misc_feature (295)..(296): n is a, c, g, or t
  misc_feature (385)..(385): n is a, c, g, or t
  misc_feature (400)..(400): n is a, c, g, or t
  misc_feature (404)..(404): n is a, c, g, or t
  misc_feature (407)..(409): n is a, c, g, or t
  misc_feature (414)..(414): n is a, c, g, or t
  misc_feature (416)..(416): n is a, c, g, or t
tcacttccactcttcttcctttttaaaccattgctagtcattttantacatatgaaattctgtttannccgggcagcntcncnaccatcaccatcttgatcatgagagcntatttaananngngccaataacgtgtttngnggcaacacatganaagngnagnngnngacccagggggggctaggcatcngcggctatcattgtnaatttacngtacgtatccnaggcnaacangttcaatgaaaagnnctttananatggcaganatganatcattnccatcagnccnataaannacccatttgagcgtcagacaataattgtcctccctacacttaaactatcctactatatgttaaatgatacaactccctctaacagtggnaacagaaaccaaggnaatnatnnnctccncnaggg

SEQ ID NO: 560559 - DNA, 773 bp, Homo sapiens
gtgattccataatcaggcgtttaatgaaaatgaatcgaggaattaaaggagctttccaagagtgtaaactgatgagatttgatgatccactgttggggcctcgacgagattcctgtcctgggacaggagtacaccgagaagacccgcgatttgctgagcatgctgttattcaatgtgtgacctcatgagcaagaaaattgcatctgactgagaatgggataagggtggatagttgtggatagcaataatctatctggttcattgaaactcatgcacattggagatttatcactggtttcattaggaatactacatacatctgattggtgtctactagattgggctatcagaaccttaggctaggacctaaatagattgatttcatttctaaccatccgaattctgcatgtattcataattctatcaatgtcatctgttgattcgctggacctaataaagtttttgttgtaccctttctttgggtgtgcaagagaaatggttgtggacaaaggtcttttgtaaaagaacaaatagttgctatttgcctagaagttctggtattcaagatgaacataaaagtgtcagtatgcttcttttcatgaggtgtactttatagttcgatgaaggctaaggtgtacctaaagcttcacatagtatattcatttatggagttagcggtattcctctgaccaacgaacagtagtaacttagcagcttcagatcacacatgaagagaacttcctgaatcattcaacagcagttctcacaaatgt

SEQ ID NO: 560560 - DNA, 629 bp, Homo sapiens
  misc_feature (138)..(138): n is a, c, g, or t
tttacaagcagcacttggcttccaaaatggaccccctgacaatgttggggtcacatttcacaatgcgcctctttctctaaaattaaagctttagccctctttccaggtttaccaaaagttacttttattgaggcagtncccgagcttttaaaaagccgcttgtcctctaagaatccatattaacataaagaggtctttctacaaatgataagagactcttaaaatgagcacttccaattacaaaaagaatcgcgtattgagcatcaaccaagcgtctgacttctcgggaacctagtcaaatcaatacatcagttgtaaccaacagtagtttcattctgcgggtagacagacacaagcacgtttcttcctctggtgtaattagttctaaacaaataagctgggaattgccagaccaggacagtttgtttttattccagtctacaaataatcaagtcaatgcctgagtaagccctctacatagatttaggcacatgctaacctcgttgtaaaatctgtatttagctacaagttaatgaaaatacatatgttcattttaaaatcataactgatttggctggattatactaccccttacccccaaactcattatttttaggccaagatttccc

SEQ ID NO: 560561 - DNA, 798 bp, Homo sapiens
  misc_feature (23)..(23): n is a, c, g, or t
  misc_feature (63)..(63): n is a, c, g, or t
  misc_feature (66)..(66): n is a, c, g, or t
  misc_feature (108)..(108): n is a, c, g, or t
  misc_feature (132)..(132): n is a, c, g, or t
  misc_feature (158)..(158): n is a, c, g, or t
  misc_feature (189)..(190): n is a, c, g, or t
  misc_feature (203)..(203): n is a, c, g, or t
  misc_feature (216)..(216): n is a, c, g, or t
  misc_feature (231)..(231): n is a, c, g, or t
  misc_feature (237)..(237): n is a, c, g, or t
  misc_feature (386)..(386): n is a, c, g, or t
  misc_feature (390)..(391): n is a, c, g, or t
  misc_feature (429)..(429): n is a, c, g, or t
  misc_feature (543)..(543): n is a, c, g, or t
  misc_feature (625)..(625): n is a, c, g, or t
  misc_feature (677)..(677): n is a, c, g, or t
  misc_feature (679)..(679): n is a, c, g, or t
ttcaagaaatgggaattccagangctattgtctattcaattcaaaatctacctgaaggatttnggnatcgggtttactcagaagttcgatttcttactccaacagatnatgtatgtttctgttgggcggccngaaaaccctatgacttaggccggggnagggggaaaagggatatcagagaatgagganngggaagatagggnggtgacaagagangattacgaagaaaanggacanagcggcggggaagagaaattggagaggtaagcaactatttgggaaggaaagttgtgaccataaggttgaatttctaaagttcctgttaaaagaggttaaggaactgtgttaccttttgtcctaagaaaaaggcgtgaaggtatgtaaanactnngatcgattgctaattttcaaaggcttcttaggtaggtnactacagtaaactgtaactcagtccacattttcatttaggagctagactaccataacaatgcttatgctgtttccaagggtaggttatttttcattaaaagaagaatgaatgcnttttaagtttaattcttcatagctgaaagcacaaatttaacggcttcactggacagttttccttagaaggtagttttgtgtnactgtgactaaactattttattttaaaatgtcattcttatttatacattccnanagttggaaagactgatcttatatgtgtataatgttatattttgtacccctagagtcacactttaaaaggcgtcggagcactaagcctaatacaagtttttttagaaccactaaaaacaa

SEQ ID NO: 560562 - DNA, 846 bp, Homo sapiens
atataaatgacaggccctatgaagagtacccgtaagaatcaagagaaaaagaacctacaattggtacagaaagaggagctgagtcgatttttatatcataattcagaacgttcggctcacacagatcaaattttgtcttcccagtaccaaaacagtatccatgatcaggacaggcattacgcttaaagctgtaacctcttaactttctttgtggatatgtactaattaacaagtagttgatgatttaagtcaaatcataaacatatcagatcgatcacatgtcaagcaccgtgtttcctagcaaccattcaccaggttagcatttctcaggtggaaggtcagtgcttgcacacgtaaccctaaaagtcttagtggactcgaatcacatttcattattataaatctcagataccagtttttatcattgatcattaatttgggcttcatagggataacttggggctaacttattatggttgcagggcattgacagattttctttaaaagccgtatttcaagcaagatactagaattgttcatgggaatcgtttgattatagcatgtcttctcaaattataatattaggactgcttgaacacggaggccaaactcatattcacgttatatttccagttatagagttattgctcttatcagttggatgggtgtgggaacaaatttaataaaagttgaggtaattataggtttacaagtttaaattatcaaactgggaaataggatcgaaatattcccatctgaagacatgatcaattcaaatgtcaattttgtgattttggctaactgtcatgcttggagataggaaaagcactatcaaagaacagacta

SEQ ID NO: 560563 - DNA, 1320 bp, Homo sapiens
gatccttggatgaggaaactgaactctactcctctttacatctctatctctcttaaacaattactgctactcacacttctctttgccttcgcatatgcctggaacttttcactttcttcttaaccttactcttaagccactagaagaataagcaaagcaacacgggccggggtgccagtggcctcacggccgtggtaactcctcagcaacttgtgggaagcgcatgaggccaggcagggactcaccgctggaggctcaacggcaacttgcgagaacccagccgtggaccaaccagtggctcgcacaacccccaagctcttcataacataaaacacattcacaaacacctctagccctgcggccgcctgcactgggcggccggtgcccttaaataactcacccgagcactaaccatccaggcgcagcgcccatgacgcgcccagcgagccaaattcagccctgagaacaacccctggagcaaggcgccggcaacgctcggccacgcgggcacgccgcgcaactcactctgcgaccccaccgcgcccaactctcccaagacccgcgcgagccacgccaccgaccgtcgacggcccttcccacatcctccaaccaacacaacacacacaaaaaacacacaccacacaacaccaacacaaggcgacacgcccacacgacccacacgccacccaccacagcacgaccgcccgccctcacccacacacccccccacgccggccatctgagcaccacaaatggcccacccccaccatagagagaaaacagggaaacaaacaaggtgagaccagaatcagaagacgtaaccaacacaacaggaaaaacacactcacggggagcccccacacaccccatcagcaagccacgaccacaactccactacaacacaaataaccaaacacacaacccccccaagagagaaaaaacaccagacgaccacagacctacagagagacacgaagtatcacacaagcacagaacaaccccctccgcacccaccaaacacgacggcgaccatacatatcaaaccaagacgtaaataccacccacgtaacgaagacgcccagacaacccaccaaccacaacacacacgcaacacacccgcagacgaacctcacacaccaacccgctagaggacagacgcacagccatccactacgcaccgcacgccgcccccacacaaaagacgaccacccaacagaacaaacagcctaacgacggagacaatcagactacgacacacaaccaacctcaaccaccacaccacgcacccgcaacaccaacgaccacgctctaacgaaccac

SEQ ID NO: 560564 - DNA, 918 bp, Homo sapiens
caaaagaaagaaaaaaatcaaggggagtaaacacacctgtcgtgcgccgtggagacacgatggggcgtcagacctttgggagcacactataaaggggtcttttaatgcgagcgcgccgggttgcggtcacaaaagactggggtgaataccagtatgagaggtgaaaaagtacaaaacttgcagggggactctaaaacggccggggaatttcttcgggcgcccgccgaaggcgcaaaccacatcagaggggaaagcccagcggttgccgtgccccacgtcagggcaacgagcttcccagaaccggggttttgctcctcaaccccccaaggcaccctgtttctgttgaaagcccctagcgccggctatgccgcgcccgcttttaggaaaaggggctgttcctgccccacaggggagccccttttgctcccaccttattgggaagatttcttcccgcgtgcaagggccacccagggtctttcccagatattttctgccacactggggagcaatgctttctcttaaaataataactgtcgaacgcacaatgcggtgaaaaatgtgcccgctctaattggtgcacgtagtctcgtcacccgcgtagcatgttgggcgtccccgttttttaatgccgagggggtgactgtctccctcttcctgctttaaaaaacaattgtgcccaggatgtttgcccaacgaattagttgaccccaagaacccgctatgttggttgtggacaaagcagggagagcctcaccccctatgttgcgggtcgtattctaatcattcgggaagtcttctactaccagagaacgatatggagagcgggcgcacacacgagagaaaggtggggggaccaaaaaaaaaaaggcaaaaaccccctttttaaaaacccacaaacaaaaaaaacaaacataaaaa

SEQ ID NO: 560565 - DNA, 151 bp, Homo sapiens
  misc_feature (122)..(122): n is a, c, g, or t
  misc_feature (132)..(132): n is a, c, g, or t
aatcccagcactttgggaagctatggcgggtggatcaggaggtcaggatatcgacaccatcctggctaacacggtgaaacctcgcctcgactccaaatggttgaaaacagatctacagcctngcattcacangagatgggctctgcggtct

SEQ ID NO: 560566 - DNA, 105 bp, Homo sapiens
cctttcagttggagtaagaggttagctgtgcgttaagaactgtagaaatagggaaagcgctggaagatgaaatgaatgaaatgaagcgagaagggaagtttagag

SEQ ID NO: 560567 - DNA, 1004 bp, Homo sapiens
  misc_feature (12)..(12): n is a, c, g, or t
  misc_feature (93)..(94): n is a, c, g, or t
  misc_feature (142)..(142): n is a, c, g, or t
  misc_feature (762)..(762): n is a, c, g, or t
  misc_feature (857)..(857): n is a, c, g, or t
  misc_feature (935)..(935): n is a, c, g, or t
ttaggaggacangagaagccgttgtccttggtgccccctcagaaatctgcctgcagttctcaccaagccgctgtgaaaatggggataaacacnnccgggagctgtttctcaacttcacttattgtcttgattaccggttatntcttatcgtggctccttcgtgagggtcctatcagtacctgagaggccatgccccatggtcctgggattcgactgagatgctcccggagcttgcctgctcttatgccctgagagcgcccactgctgtcatttgtcacacggatgccatttctccatcctgaggggcacctggtgaccttgcacctcacaatatcacgctattgctgtagtgcataggaattgattattgtgcttctgccaaacgatgcctgcctcccaacgggctgaccaagtcgtacgctcaggcgaaccggttacattctatttctcccacccttctcaacttcgaaacattgtcgttaatcacaagtgcctacaagagcttgaaccactaaatcttgcgatttcataggatgatttgttaggaatctggctaccaacagctccgctgcgaaacttgctattcacccaccatattacgattttaatcccgcgtacggcgactgccaccctcaacatttgatcctccacgactggccctagaaggggcgcacgtttacgcgggatggtccttccgcccacgcccctttatcaatactattcactggtcgaataacacgtcagaacgtcaaccttctcatnacacccaccaagcaacgacacagtgtccctcctctctaccgtcctatcgctctgtgccgcacacatcttagctaattacgtctattactccgttntatcctcgagcctcactatctctcaactcctacctctcgcgacgaaccttcactctactctttgtcgtcatccagcantctactccttcgttcccctgcgcgcgcgctcgtgtcatctctctgcacacatacaacgcggcgctctcg

SEQ ID NO: 560568 - DNA, 536 bp, Homo sapiens
  misc_feature (10)..(10): n is a, c, g, or t
  misc_feature (40)..(40): n is a, c, g, or t
gagaaatgcnaggaatagacttagcattcacacgtcctgnttgcagcaatgagtgaaaggaatgagctctggttatgtatggagacttcatctgatagtatgtgatacagtacagatagagagatgagttgagccaagatgatgacgagagagatgagcgaaggatcagatactgatcatcaattgttataattgatttgaagactatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaatagggtgtagcgttttatagaactgataatcaggcttatggataagaaaaatgagtttcaaatttaagatgtatattgatcgaagcaattgaagtatcatggattggattgtactgattcagtaaagtatgtttgccatagatactatataa

SEQ ID NO: 560569 - DNA, 738 bp, Homo sapiens
taaaaacaatggggaagggtttaattggtacttgggtatgaaatatgtgcggaaggggggtaaggaaggtattgaaataaaggcttgtatctgaataccccctgtggatataatgcacaacccggttgtgaatccccgttggactccctttttctctcccaacagctccagaaacgagcccatctcactcccgtggggctgctaccatccacccttcaacttcaggcttccccttccacgtgtcccatcacaagaaggtagttgacaagctgtgaactaccttctggtctcttttactttaagtttcctctggcctcttcttgagattggacgcttcatccaaacatcccttttaatccagaggctgggtgctactttcagcagactttatccttaattccctcaaacccatcttgcagcgtgtcctgggatccccgtcgtaccttaaggggaaactttcacaatgtccggagcccttgatgtcctgcaaatgaaggaggaggatgtcctaaagtccttgcagccaggaacccacttagtgtggcaccaatcgttgatctcccagatgtgaccagtacatctataaagggaacacgtgagggcatctatatcataacatctcaagaggacctgggaaaaagcttctgctggcagctcgtcgcattgttgccattgaaaaccctgtctgatgtcaggtaaatatcctccaggaatacgggccagagggctgtgcctgaa

SEQ ID NO: 560570 - DNA, 283 bp, Homo sapiens
tcaaggcagtggtctgtggctacaggaagctggttctactgtctgcttaacaaactgtctttgtgagtacagagattgggtttaccacttctgctgaggagaccacttaaaattcattcctgagtttccactgtgggagaatacccatggaataagataaaaaattaattccacaccctagtgtgtgtaagttcctcgctcataggaaatgcaacagtttgatgggagcatttgccctttgttcctgtgaggactggcaggcttttgactgacctctcattcc

SEQ ID NO: 560571 - DNA, 482 bp, Homo sapiens
  misc_feature (17)..(17): n is a, c, g, or t
  misc_feature (66)..(66): n is a, c, g, or t
  misc_feature (82)..(82): n is a, c, g, or t
  misc_feature (85)..(85): n is a, c, g, or t
  misc_feature (115)..(115): n is a, c, g, or t
  misc_feature (123)..(123): n is a, c, g, or t
  misc_feature (201)..(201): n is a, c, g, or t
  misc_feature (208)..(208): n is a, c, g, or t
  misc_feature (215)..(215): n is a, c, g, or t
  misc_feature (245)..(245): n is a, c, g, or t
  misc_feature (287)..(287): n is a, c, g, or t
  misc_feature (317)..(317): n is a, c, g, or t
  misc_feature (328)..(329): n is a, c, g, or t
  misc_feature (338)..(338): n is a, c, g, or t
  misc_feature (344)..(344): n is a, c, g, or t
  misc_feature (445)..(445): n is a, c, g, or t
aatgatttcaaatgtgncatgttacaaagaaagcagattgttactagtacttgtgcaaatatgtgnattaccataaaaatancanttctcatgaatagttgcccaattctggggnagtaaggnagaaagcaaaagtaaatgtttcaattacggttcccagaaagtatagtttattgaactgctataagctgtagatagatnaaaaganaaaaatnccaaaaatgaagaaaaaaaaacatttaaanaatcagcaaaattatcaaataaaaaatcataaaaacattaanttcattattaacaaatatttcaataaaaanaatgttcttanngcttggtcnaggcgnggaatattatgatgatatcagcctgtttgttaaagttttcgaagttctaagacaaattaggagggtaaaggagaagaatttgggatttgcttgtgcacatnggaaacaggctgggaatacaattgttttcctgactct

SEQ ID NO: 560572 - DNA, 212 bp, Homo sapiens
tgctcgaagagggccctctcgaaatccagcgctgacgccagcccctcgtcgccggtccgtccgccaccgaacaggatcccaccccgtgaacatccgcgaactgacccgcactcgcgctgtccctcctccttctgcggcggcgaccctcggcgacgcgcacggccacgacggaccgcgagcacgccggcgccgaagaggtcgagaaggctcgc

SEQ ID NO: 560573 - DNA, 109 bp, Homo sapiens
cgctctcgaggattcggtattgagtggcatgtgaaatggcgtgacaaaactctgtagcttatgctgaaactgtgtgccccctgaggctctgaggagacagagaaaggag

SEQ ID NO: 560574 - DNA, 470 bp, Homo sapiens
tcacgcccatgtcacaattcccacatgacatttccaggccagccagttcagttaaaggctgtcctgtgtcataacaaagccataactaggtcactcctgtctccaggcccctgtcccatgggctgtttcctcagctgagaagaatgggtagtcttctcctgcctgcttcctcccaggtctagctcaaggatcatctcttttggaaagaacatttctgatctcccaagcccacagtattcttggccatttctgaacatcctgtggacagagatggcctaaggatttacgtcctagcagtacagcagtcgctcccgaggggactacttccaagcaaataagacatctttgtaggtgttaatcatggaatgattattaaacttcaattagacaagtttgctaagcatccattagttttatagttatttctcatttaactgttatttctacattacaaatgaatcttattgcta

SEQ ID NO: 560575 - DNA, 871 bp, Homo sapiens
  misc_feature (514)..(514): n is a, c, g, or t
tctagccaaatgctatgttgcaaaagtggcatcgttagtttttatgtctggtcttcttgtttactatacctgggtaatttgtgttaccaaaaaaaaaaaaaaaaagggaagggtaggtcagacacacaagaaaagcaatcagggtggtaacgcttaaaggtacaactttcaagggtcattaccaaacaagcaggggtttgttttgtatactttaaaaacattatggctacatatcatgggccatttccatatttggggggtttgggctactcttatacaaggggaatcacttgggaaaatggtcatccagccactgaattggccattatatatatctaaaaaggtttctaagattgacaggttatcactatttgggtgtatatctccaggctggactttggaaagagggtactagtatccctctagccagatggttagttttcggtggggtaatcaaacaacggtggtactaagggaaagtaaaagctaggacctaaatcagaatcatagtggnctgcatatgtggtaccagggtcgtgtgcatgtgttcacagggatgagtgagaggttgagaagaacttattggacatttttctgtggttgaataagaaaacccctttcttggtcttcaggttaaggaaggagatactaagataggagtgttcatccctatctaaggtcgggggggaactaagaacgacagaagcgggggggcttggctttacagtgttctcccctaaaagtgatttggggacgtactatcactttaagctaacttggtggttgaactatttttacctagtaacaggttctttgggttaccatgtattgccacgcttgttttaagccaacttacgttagccaatgtctt

SEQ ID NO: 560576 - DNA, 517 bp, Homo sapiens
actgatactaggaaaaggctgtggcgacgccgggacgcatcggtggtgcagaacatcggtgcaccaaatcataacggccaggtgcttcgagtacttggaatctcctgggtgactgtagctggtgccatatctcctcatcaacccaaatcccgcttcccagatggacctggccattgtctaggatatacttgtccatgacaggcgcaggagcggggtaataggacgacgtatttgcttcctcactgaaagtgctccgcaactccggctcgggctcgaaacattctgactttactttttccagatcaatggcgggaccgctgccaagcctcaggagcagcacgtcctggagcctccggttaaggtcacggagctccttcatttcagacacaagtgccccgtactccttgagcttctgggccggtggtaccagctgcctacgagtccgctccagctcctgcgggaggtggcgcatctcttcctgttgctgctggtagttgcgcagcagctcctcatacag

SEQ ID NO: 560577 - DNA, 141 bp, Homo sapiens
gtactctagaggataccgttgtgctctaatgcagttgtgctctaatgcagttgtgctctaatgcagttgtgctctaatgcagtttgtgctctaatgcagtttgtgcctctaatgcagtttgttgcctctaatgcagtttgt

SEQ ID NO: 560578 - DNA, 446 bp, Homo sapiens
actcttgaggaatatccataaaatctttgactaccagtgtcctcatttgttttcctgtttacttctaatagcattatagtcactggtcttaggtttaagactttacttactaattagtgaagtatcttccatatatttggagatggacatttatgagtggcttccccatcattcatcttccttcttttaagggacagctacaatttttatatgaggatctactttctataactcttagtccaaggctgaaatcatcttcaccattagctattgccaatatattgccttttggtttaaggaaatttaggttggattccctgcaataatgcaaccataaccttccaacggctgaatttatcaaccatagggtcttggtcttcaataacttagttgggttttggcagacaagatcaaatttgggccaataatagttgctctcactttca

SEQ ID NO: 560579 - DNA, 418 bp, Homo sapiens
  misc_feature (72)..(72): n is a, c, g, or t
  misc_feature (136)..(136): n is a, c, g, or t
  misc_feature (288)..(288): n is a, c, g, or t
  misc_feature (314)..(314): n is a, c, g, or t
  misc_feature (377)..(377): n is a, c, g, or t
agctggtgttagagctgcttcatatttaaactagtccatcccatagtctaggtcaaaccagttttacagccncctggggggcgcttgacccaaactcttgtgtgttacattttgagaggtttcataccagaatgtnccaaaaagtgcacaaggtaaaggaatttacagccagaaacaaatatacatttgttcattcttgacttccctaagcagataagcagaaacttgttaacttcatactttgtttatgtgctacatatttttgactaaaagttatagaatgttatnctctggggaatcttttacaggtgagnatgggatagcagtattcctcagattaaactggatcaccataaacctgtaggccagggtgaatnagtagtcctttttatagttgaatacaattttttattcacca

SEQ ID NO: 560580 - DNA, 780 bp, Homo sapiens
  misc_feature (685)..(685): n is a, c, g, or t
  misc_feature (695)..(695): n is a, c, g, or t
  misc_feature (742)..(742): n is a, c, g, or t
  misc_feature (744)..(748): n is a, c, g, or t
  misc_feature (753)..(754): n is a, c, g, or t
  misc_feature (759)..(760): n is a, c, g, or t
  misc_feature (762)..(763): n is a, c, g, or t
gacttgtcttttttaagtttgaaacaatttcttagggagagtaggattgaaagagtagagaaacaggggagataaagacagagtagggtttgggcagattcctgttgtttttcttataagctctttgttagtaatttagtattgtatttctaccacatatgttttctaccctatgcaagcatgacaccttttaaacaagatagatataaactgtattaaaatttacaacacagcttgcatgccaacatagtcttccatgatttggtctctgcgagtgtttccagatttgcctcccacctctatcccttgctttctttattccagctgtgatgcacacatttcagcgtgaatgcggccctccttctcatttctacagattgttctgtgctcctgggtcattcctttcttccacctgtccttccctccacttcacaatagaatagagaagtttctgatgtttgggcttccttttgggtagaacaacaacaaaagtcaactagaaaaatgtccttttttagagttatattttcagagtgaggactcatttatcatttatatttatcataagaaattaaaacattttcactttttgttttttcctgttaaatctttaagtatctttaaccaggacttaattaaacttgaatggtctgcaatctttttcaaatgtgaataatttcaatgnatattttctncattagctaaatttggttagtgtttagtgtgtatttttaataaatcnannnnngcccnntgggnngnnaccactgagccaaccgg

SEQ ID NO: 560581 - DNA, 635 bp, Homo sapiens
cctggggtgcaaggagacttttcccggagggatttcgcctccccctgtaaaggggttaagttgtttcctttcttaaaaaaaaaaaaaatctccccggccggtcttttcttcacctggttgggagccccaagggtcctggggttacatttaatggacctgtctccgggcgttaagaaaaggcctttccttttggtcacaaccaattccagtctgggaattctttcccgcagtagtgctcccctttaaaatgaaaggggaattaagcgccctttctttttgaagtgccaacgaggtattagcagtcatttctttgggctcaggtttccacaaaaaagggccgttttatttccgtcaaaaatttgtctcctggatagcgagcaggcacaattttatatttttgcacatggaaaagtcaagccctagtgtccctgggtgcgggtggcccctatgttcttaagaatggtgtatatttttttaaagtttatcatccattcttgttgggcgggtgtgtcgtccccaaaaacaccataaaactgggcggttggttggccaccattggatggctgggctgtcaaaaataacaatgggttttgaacaaaagtcacatactacgtggctcccaaaaccaaaaaaaa

SEQ ID NO: 560582 - DNA, 355 bp, Homo sapiens
  misc_feature (75)..(75): n is a, c, g, or t
  misc_feature (330)..(330): n is a, c, g, or t
gactgaaaatagattctgcaatcaagggtgctgatattaaataaagatctctgaaaataagaagaggtattcttnggggcaggcgcggtggctcacgcctgttaatcccagcactttgggaggcgagcgggtggatcatctgaggtcggaagttcgagaccagcctggctaacatggcgaaaccccttctctactaaagatactaaagatgcagtggcacacacctgtagtcccagctactcgggaggctgaggcaggagaatcgcttgaactcgggaggcggaagttgcagtgagccgagatctcaccagtgcactccagcctgggcancagagtatggctttgtcgcgtcgac

SEQ ID NO: 560583 - DNA, 349 bp, Homo sapiens
  misc_feature (6)..(6): n is a, c, g, or t
attttnttgaagtttatttattacaattatttggttttttgaccattggaaaagttacttatttaataaaagttcatggaaaaaaatgagcaaagacagacttgtgaattagacaaaatctcactgaaatttaatatactcatctctcaaagagagaattattcattgggctgcatgaatgacaactgactgtattgacctgtctctaggagccagcacactcagggtttctccactctctttgtctccaagtctaaaagatagagtttattatgacaagtacctattacagtgtgctcttcatgcagttggccaaattcatctaggtctcgcccctttgggaaggagg

SEQ ID NO: 560584 - DNA, 555 bp, Homo sapiens
  misc_feature (8)..(8): n is a, c, g, or t
  misc_feature (49)..(49): n is a, c, g, or t
  misc_feature (73)..(73): n is a, c, g, or t
  misc_feature (79)..(79): n is a, c, g, or t
  misc_feature (109)..(109): n is a, c, g, or t
  misc_feature (124)..(124): n is a, c, g, or t
  misc_feature (507)..(507): n is a, c, g, or t
  misc_feature (549)..(549): n is a, c, g, or t
acctttanccatacagccccagttggcacacacacctcacggaacccgnaaccagtcctccacacccggcatnagtagncagataatggtaaaaggccccttggaaaanagataggggatcctnaggggcccatcaatttagtggaccttcctatcaaaattgagaagttttatccctgaaatagccttcccaatggaagttagaagtgggcctgacattgcattatttggtggaaaaaaccatcaaggtctgtgcagtaaagctgatgcagctctgtgaactagcaaatcctattagtacttagcctgatcacctgggaagatgaaattgtccttactgagatgtggaaggctgaaagtgaaacaggttgatctatatttattggagtattgctgggtagaaaatttgtcatcacgttatccccaatgcctagtatctaggtatctagtggcacttaataggtattcggtaaatatttgttgaatgaattccctgaattctaaaanggcttcaatctgagctatttttcacatcacctacctgaaaanatgaga

SEQ ID NO: 560585 - DNA, 792 bp, Homo sapiens
tatttgtaataattaaactttgatgttgagaaagtcaaaaaataaattgaaaaactaaagaaataaaaaacaagagaaaagaaataaaggacgggggcacccagaattcgccagagtgggagctccagaaccgtcactggcgccctgcagcctctttatcttggagaggtgctccccatagggctgcgaagctagaactggaattgggcccgctagtacatcaattccttagaccgtgaacactggagcctcactaccagtagatgaaggaactagcgacaacatgaaacgttgaggagagtggagaccattagggcgaaggatctgccgctcagattttcaagtctggacgtgtggactcatgactttgactttgaacctgggcggtacgagcccatcgaaaacattgggcctggcctatgtctaggaccttgagcctgacttttaaattagggatcattgttatagacgtgggacctccgaaatctggatgtctaaagattttctctggatcttgtacaatagacctggacataaccttggacctggaaccttgtacttagaactttgatccttgatccatactgtggacctgaatcctgaactttccctagatgttaaacacaaatttataattgtttcaacctgtactttggaactgaaccaatacctggatttggacctatttctaggatctttgaggtaaaccttgtaacttgctgctttaccttgggaatccaggcagtccagatctggaccttagacttgaaactggattacttttggatatgg

SEQ ID NO: 560586 - DNA, 143 bp, Homo sapiens
agcttctctttgtgcagtgttagtattcaccctggcagtgagtgccatgttttttgggtgagggcagatcccagcacctattgaataccatagagtaatgatgtaacagtgcaagatttttttttttaagtgacataattgtc

SEQ ID NO: 560587 - DNA, 377 bp, Homo sapiens
agctcgatcaaacggctaggttcgcgttttgctgacccactgcatctatccataatggggaacctacccaacaaccggctaagtgtcagatgcagagaagctgtttgatgtcatcatcgttcaacatgaaaaccggtgacgagccttcaactccagggcttcccataatggcgaggtcaacgtacatatcccttgtaagggcaaagccttgttgagaggttgggggggtgaagtcgcctttgaactgcaaacctgcacgctcatagaacgaaatcaaatcgtgattgcatagcaggcaagtgccttgcgaatagtccaatacaccattcagcaactgagtgccaatgccatgccccctatagggttagatcgagcta

SEQ ID NO: 560588 - DNA, 436 bp, Homo sapiens
gctccttaccccaagaacaagaaagcgacgagccgcaaagatgaagaattagaccccatggaccccagctcatactcagatgcaccccggggcacatggtcaacaggactccccaagaggaacgaggccaagacaggtgctgacaccacggcagctgggcccctcttccagcagcgcccttacccttccccgggcgctgtgctccgcgccaatgcagaagcctcccgaaccaaacagcaggactgactgaccccttgttccctgtagctttggcagtttgcgtttctgtgtttcttccttgtggctctgggacaggagccatggcttctatgtgctgcattattattccaccagtgagctacactcccggcccctttagtgttgtttgtaaacaacaagcccttgttgtttaataaaagctttttttgtggaacat

SEQ ID NO: 560589 - DNA, 212 bp, Homo sapiens
ctaattaaatcttttctaattttgggactttatcaggaaggttttaagtgtggcccataaaagctacagtgcatagttgtagacaaagtacattttggggaaacaacatttatatgtaccctttactgtttgataaaccaaattaaaaaaaaattgtatttcattacttatactgggaccccattcccaaaataataaaaatccctttcata

SEQ ID NO: 560590 - DNA, 1020 bp, Homo sapiens
tggaaaagcaacttttattgaaaaattgggagggaaggttccatattattttataattagtaaaaaatacataaagtaggaagtgtgtgtaaaaaaacgccggtggctgcagcggcagcggcagcgttgtggccaggaggcgtggaggggcccagggagtggccacccccacagggagttcagggagggccgtggggacgaacaaggcggaaagaggtataagcgtctcaaaagaggtcaaggtgcatacgcggggaagaagaatcactcgtgaagggggaaggccaccgcgggtggcgaacagtacaccaacgaaaccgtggtgacaccaaagcaggggacagggggaagggcatatgcgggtccacaaagaacttaaaaacccccaaacaggccacttgcgaccacaaccacctacactacacaaataacaaactataacaccctgggccccctacggctcccacaggggcgataaaccccagtggccccaatcccacaaaatcccgtgagacccaaaacccagggggccacaacacatcacgcaagaccgatccaaccaaaaagacacgaggacccttagagagcgctggggagagacaagcgatgtatggcgccctggcacaacacccccacagaggcaaaagagcgtagcagaggacccaagcacgtaaccactaagcagaagagatggacactacggcagtgcccaacacagcggattgacacctgcagggccccccggggcccccacaagagcaacgaacgacacgaaaacacagaggaaagacaagacccaacgcaccaacagagccgcacatgagcattgacaaaagaacataccacgggaggcacaaccacatgggggccagggaaaccctgcaccaggacccccccccagaacgccaacaaattacgcaacaaatcactgtacacaagactccatacacaacatatcccacaacaaacagcacacgccgagaaataggcaccaacaacgcacacacaaggaccacaaat

SEQ ID NO: 560591 - DNA, 1434 bp, Homo sapiens
acctcccattccgataaaatcaccatccaccccactggccctccttccagataccctctctctaattgggttctgcatgtaaaatactccacaataaataaataattgaacaaattaaaaaaaaaaaaaaaaaaaaaaaaaaaaaaaaaaaaaaaaaaaaaaaaaaaaaaaaaaaaaaaaaagagagagagacaagaaaaaaaaaaaaaaaaaagaaacaagaagaaaacaaagaggagaccccgtaagagggcggcacgcgaggaacacacgagaagcgcaagaaggcaagaggcagcagaacgcacgcacagggcagagcaacacgagacagcacaaagagagacaaaaaaaaggggaaaacacgcggaacgacgaccagcggacaagaaaagaacgacagaacacagaagagcgcgagaagaagagaacggagaaaaagcaccgccaagagaacacgaacaaagaaaaacacagacagaggaaagccaacggggagacaacgaaacaaagacgcaaacagcagaagaaaaaaagagaagcacagcgcaagagaacgagcacaacgacaaaaaaaaaaagaagaaacaaaaacgagacgacacacacaaaacataaagccagacaacacaaagaagacaccacgccacgacagaacagaaacagagaacacagaacagacaagaagcacagagcgcacaacgcgaggaggagcgagacaaaacaggaaaaagagaatgaaagagagagagagaagaacacgacagccgacaacggaacagaaacgagagagcaggaggacaaaccagcaaagcaacaagcgagcaagcgagcacaccaagagcaacacacgagacgaagacgagcaaaagaaggagagaggagagaggaagacagacagagaagagagggagacgagagaagcagaagaagaagagaaagcagcagggagaggaagggaggagaaggcagaaggaagggaaagaaacgagcggagaaaaagagaaagaggagaaagagagcggagagacagcagcaaagagaagagagagaagacaaagagaacaagacagagcagaagcacacggaaaagcgaggagaaagaggcggagagaaggcaaggagagaacagaagaagggaagggagaagagagcagcgagagagcaacacagagcagacagaggaaaaagagcaaaagagaggagagacgaaagcggggaacaggcaacagagacagacaggccaacacaagaaggaagagcaacgaagcaaaaaagcgagacagaagagaagacgaagaggacggagagaaggaagaaacaaaagagatgagaggaaagcaagtaaagaaaaagaaggaagggagtgagcgcgaagaacgccaagcaagagcgcgagacagaagagaaaccagacgagacagaccacagaag

SEQ ID NO: 560592 - DNA, 218 bp, Homo sapiens
gaaggcacggcgacaagagcacactgcaagatggtcttacaaaccacttactactatatccggaaaactcacggctcacactgcttaacacgtctcgatcagccatcctataaataagcctccactggtacgctctcacgcctgagcgaacagcttcttgctggcaaccggatcatagttacagacaagattcatcgcatccctcagtctcccctaca

SEQ ID NO: 560593 - DNA, 1938 bp, Homo sapiens
  misc_feature (516)..(516): n is a, c, g, or t
  misc_feature (692)..(692): n is a, c, g, or t
  misc_feature (719)..(719): n is a, c, g, or t
  misc_feature (757)..(757): n is a, c, g, or t
  misc_feature (769)..(769): n is a, c, g, or t
  misc_feature (852)..(852): n is a, c, g, or t
  misc_feature (898)..(898): n is a, c, g, or t
  misc_feature (902)..(902): n is a, c, g, or t
  misc_feature (1548)..(1548): n is a, c, g, or t
gcctgtccttttcgtcgtgctgtggtctacttctctcttcagtgtccgccctggctgagtgtgtcactctatgttttgtccggtgactgtggcgtgctgctcgttatggcagacgccagcgtgtgggtttggctgtctgcactggtgctacgtcctacgcctactgttggtgtggctactccgctcgtcagctcctagagagcggcttgtgtggggcagcctctataccactctgttgggtcgcgttctgctctctcgttgtcgcaagcactcttgttgcctgtgctttttgggagattttttcgcgtttttgtgcatgcccccagtgcgctcgttgtatactcttcgtgcgggtcgtgaccacagccgcggctgtggttgggaggggagatcgatgggtgtgcgccgacgaccgcccgagctggagtgtgggtggcgcgcaccaccatgtgtcggtgtggtagtcgtatgtgcgtccgccgcgtggtgtgagtcagcacctgttgaggtagtggntcactctagtggggcgctctcccggcgtggtcttgatataatatatcggcggtccccgtcagtgggtgcgcagtcacccacagccggcccgtcgtttctgattgggtctttcctcgcgttgcgcttggtacttaagttgccgttctggtgtccgccgcgctgtcctcgcccccgcncgtggcgtgcccgatgagggtgtagcngcctggcttgctgtggtaaggatgctggatgagatgtnacaccgaccgcngtctggtgtggaagatgaggcttctgtggatcagatgcagtgaccgcttcggcctgggtccctacgtacaaccgtactgtggngcgtgtaagggaaaaaaatggtttaatgaaatcgtgatggtgaggncccntgctgtgaatatattggttgtatatataaacttggttgggcccaccaccacacggcgggtgtttaataatgtgtttgttgtctcctaccacgtgttatagctgtaagcaccgttccgcctcccctgtggtccgcccccccacattattcgtcggtagggggtctttatagtaacaggggggacacctcctttgtggccaacaaatttccaacgcatatcacaccagcggaagaggaggtgttgagagaaaacaaagcgttaaacagttttaagggcgagaataatttttaataaggagacattatttgaggggagacacgactgtgcgccgcgcctctagaatactctagtgtgtgtgtttgtgagtagttgtccccgcgcttctcgacggagtattgtccccactgctgcgtgtgtgttgtcctgtgtgtcggctcgccccccactttgtttatggccccaccctggacttttgggacacactcttgagctcttctgtatgttgtcgctctttcacatagactgtcacacacagctgataaactgtctcggtgcactcaacacctctagagaggcctctcttacatcacagagagagagatagtccactgcagatagagagagactctgtgaaaagtgtgagatnaatttagtgttatactctggtccaccttatggagccacgctatagtgttgagagaaattaaggagagcacattttatatttagacaagggtttgtagaattatagcactataggcgtgtgataatcttatatggtttctaccacagcgtatccacaggagactatagaccacaggccaccggagaacacaacccaccactttctatggcccacaccttcttccactgaaacttgcacgatgagcctacccacaaatcacttttatataatgtgcttgccctttttctgtgttaaatcacgaattaatgcttatctgaacaagcgaaggttttctctcccattaaaaagccacgtgaaggcacttttccaaaattaaagaatgagggggga

SEQ ID NO: 560594 - DNA, 539 bp, Homo sapiens
cgatctagaggatcccagcggctgcctttttttttcgttgcggcgccgggcgggtgaggttgtctagtccatgctcggaggccatgcctgtccaaggtgcccgctgcagtctgtgcaggtcttcggacgcaagaagacagtgacagttgtggcgcactgcaaatgcggcaatggtctcatcaaggtgaatgggctggccctggatgatgattgagcctgcgcatgcttacagtacaatgcttgctggagccagttcgtgcttctcggcaaggagcgaatttgttggtgtagacatccgttgtccgtgtccagggtgggtggtcaatgtggcccagatttatgctaattccgtcagtccatcttccaaagccctggtggcctattaccaggacatatgttggatgcaggttccaaggacaggagcacaaaggacatcctcatccagtatgaccgtaccctgcttggtagctgacccctcgtcggctgcgaagtccaacaaatgtttgcaggccctgttgcccgtgctcggtaccagaaat

SEQ ID NO: 560595 - DNA, 859 bp, Homo sapiens
ggcggtttgcagacgccaccgcgaggaaaaccgtgtactattagccatggtcaaccccaccgtgtcttcgacattgccgtcgagggagcccttggccgcgtctccttttgagctgtttgcagacaaggtcccaaagacagcagaaaatttcgtgctctgagcattgagagaagggatgggttataagggtccctgtttcacagaattattccaggtttatgtgtcagggtggtgacttcacacgcaataagtggcatggtggaaagtccatctatggggagaaatttgaagatgagaattcatcctaaagcatacgggtcctggcatctttgtccatggcaaatgtggacccaacaaaatggttcccagtttttcatctgcacttgcaagactgaggtggttggatggcaagcatgtgggtgttgcacgttgaaagaaggcatgattattgtggaggccatggagcgcttgtgggtccaggaatggaaagaccagaagaagatcacattgtgatgtggacaatcgaataatgtttgactgtgtgtttatcttaccacagatattcctttgtagctcaggagagcacccctccacccaattgtgtcgagtatctagaatcttgtggtctcgctgcagttcctgtggttccatgttttcttgtccctccatgctaagtgattgcgacgttacgtattggttttgattaaacccatagaaaaaaaaaaaaaatttgggcgccgcgccgaaagtttacacctcgtgggcgcgccaagatcggagatgtctgtcaaagactggcagttggtccacaaaaccggagcggtacacacagggtttatagagtctataccgcgccaac

SEQ ID NO: 560596 - DNA, 265 bp, Homo sapiens
atcctgttcgacaacttccttagagacgatactacgaaatagtacacggagtaagctgcttcctgggctcctacctcgatttccaaggtttttacttggaaaagccctgggggttatagaagggatttgatctccaaggtcctcaactgatactgtgacattgaatctgggattagggagcccccacagtatgtactggagttgccagtcctctgcgtcagagaagtgataatacatctcaattttccagtgcttagcacaagca

SEQ ID NO: 560597 - DNA, 104 bp, Homo sapiens
tgtagcggctgggatgctgtctagagcggaagctttgaggctctagctgggggctgttgttgtttaacctttccgtcatatgacgaaaacggcatcttcatcgg

SEQ ID NO: 560598 - DNA, 367 bp, Homo sapiens
  misc_feature (25)..(25): n is a, c, g, or t
  misc_feature (231)..(231): n is a, c, g, or t
  misc_feature (235)..(235): n is a, c, g, or t
  misc_feature (347)..(347): n is a, c, g, or t
tgggggctctcgctcctccttctangtcagctccgcccgctgccgtctccttgggtagggggccctcgagactagagttcaacagcgcggcctcggtcagccccgagtcgtcatccatgctgatgaagatgcccggggtctcgcactcaggcccctcctcccggaaatccatggcttcctcagacgggggcgggcctggcccgggccgacggagagggagagggggagganaggnggggtgtgcccccaccccccccggcctcagcctcctgttccccccccagctgccgctttaaggccttctcctgggccagttgcagccgatgaggtccgaggggggccggggnggctggggccggcgcaaagg

SEQ ID NO: 560599 - DNA, 242 bp, Homo sapiens
catggatgtaatcccgaggtacttggggggctgaagcacgagaaatcgcttgaacccaggaagacaggcgtagcagtgagctagagatcatatccactgtactaccagcctgggcaacagagtaaaactctgtcaaaaaaaaaaaatcctaaattcaagtaatatgggttaagaaaaaaaaaatcagcaggaattaaaaaatactgaggctcagtaattctacgcatccatgatccacactt

SEQ ID NO: 560600 - DNA, 285 bp, Homo sapiens
agccccaggcatagcttcagggcacaggcgatgaatgccagagcctccagctggaactgagggggtatctccagctcctcctcctcagcctctatctggtgcttgagcttctggtgctataaaatacctgaatgatcacatctaccattgggtcagccatctcttacatcttcgccttaggaaccttcctcttcctccatctatgtagccgtctgactcctcccttatgatcagccggacatcggcgctcaccttgaagccgtggtccttcttcctgccccgacc

SEQ ID NO: 560601 - DNA, 114 bp, Homo sapiens
tttaatattatttgggaagaataaatgaagctctacttgtcttatgttactaatacgatgaataacgttcttcacaatatttacataaaacttctcagtcaaaaacgataatat

SEQ ID NO: 560602 - DNA, 448 bp, Homo sapiens
gcccacctcgtgcctttatccgccctgtcccttcctctctgcgcatctcacccgcccggctggccccacctcgactctgaatcccgggcgggaggaggaccccgcagcctccaggtgtagtggtctgctatgtgcgtcctggatggggaccttgtctcctctcctgttgtctggccggtacattgatgatgtagagcccgtccttgggctctggtccctgcgaagcaggctctcccgggcccacggggcggacgcagcaataccaaatttgccactaaaaccgctggtcccaggagacggagccccgaaggcctgccaatggcggctgtgtcacacggatgcgtggcagcactgacgtgacgggacacaaagggacaggctcaattcctgaccccaaacccaggacccaggacagagtcaggagccatgccacgggagacacacacaa

SEQ ID NO: 560603 - DNA, 102 bp, Homo sapiens
tgcaggatcttatggctgcgccggcaactagtcgggctcgcttttggcactgtcgggaggcatttgtgacctgaacctgaaaatcccagaaatcaacagcag

SEQ ID NO: 560604 - DNA, 911 bp, Homo sapiens
ggaaaaaaggcgggagaagccccggcgaaggtttgaagctgcttctgtcgagatatgcaattcattcatgaaacatcacctcggagctgggtaaccgagaggcgctaaccctgtctttagatttacaggccaatgcttcattcagccattttaagctctatcgccgcactgatgttcgccggaccgtgtgagctattctctacatatgccacaaagacattggaatccactatatcctataatacggactgcattgagcatggtagtcctagggcagcagactctgaaacgttgcttcctatattgctaaaggcccggagcgtggtgcctaacccacgtgacacatctctcctagggtaacgaatcacatctaccaacgtaatcgtgcacagcgccatgcgttaggtaataatcttcttcatagtaatacccatcataactcggaggctttggcaacttgaagtagttcccctaataatcggtgcccccgatatggtgttatccgacgtataaacgaacataatgcttcttgagtcgttacctaccctctctactactcctgctcgcatctggctatagtggaggccggagccggagcggttgaacaagtctaccctctcttagcaaggaaaatactcccaccatggagcttcgtagagctaacatcttctccttagactagcggggtctccttatcttaggggcatcagttcatcccaccaatatagttaaaccccggcatgccaatacaacgccctgtcgatgtcagcctatacaggagcgaacgagattttcaggctaggggatagatctgtaagagaccacacactttgacgcgagagaccgttaacagacaattgttggcaagaaacacagggaacccatgaacgacaggaacttgtaaggaagga

SEQ ID NO: 560605 - DNA, 1627 bp, Homo sapiens
  misc_feature (250)..(250): n is a, c, g, or t
  misc_feature (282)..(282): n is a, c, g, or t
  misc_feature (576)..(576): n is a, c, g, or t
tttataaagagatcatggtggccactgttgcagctattgaagaatgaggtgctggacttgaagcgagcttctttcgcctgcatcatgtaggtagcgtgcactgcacatagggaacaagaactattgcacctataaggaagtaaagaaaacgagaacgaaacacgtggcgctctgtggtcattcgatggctagtttagtactggagcatgcttaaactagagacagaaggtaagtaccgcagttgacctgncgcattatggactaggggatagaacgtgtaancatatgctgtgttcgctgcttgacgtgttacgcacacaattagtctcgtgtcctactgtggacttgaactgctggaatttatcttgtaaaaattggatggagtgtggctctcatttgttgttgcagatcattagcgcgaccatctaaagctaatcgtaaatcaggcccaagatattcagtgcagacaaccgcagtctataatcccatatactgtcgtgggtgagtaaaatttccgaatgatcgataacattggcaagtttcatctatatatggagacgtcgcgtgcatatttgncaatatgaatgtcacagctgtctgtataatattataattgcaaaaagatatccagacagaagagtatgcgaaccaggatgagatgtcatgacatatggtgcataaatgaagcccaacgtaagtagagtggaccacagcagtgctctcgattgacgaaagcacattggcgctatgtttgggcaccatatgcaccaggaattgagggaagtgtggcacctctgaaacccttgtgtttagaactaattctcgtaaaggtgatggccaatcggcgtcataggatggtctgagcctatggtcaagacacttcggcccatccagggatagtaggcaatgaacaacaatttcaggtaaccacttcaacagggatgttgaaaacgggagaaaaagggggaataatatcgtacagaagtttaaatttgagagacggcgaaagagggtaaaacaacaaatttggggacatataatgagaaagcgtaaaggaaagacccatatataacgctgaaatgagcgagacatgtgggaagagggataatcaggatacgattcagacactattatattgaccccgtaaaaaaattaaaaatttgtcttataaaaaagctcctgtaaaagtaattggcttgtctaggaagattaatataacgattgttaaaactaaaatagtgactaggagacataaagctattgggaacaaatacaaagacaaaagataactacttaagggaaaagttagatagaacagaccacaaacacacagatgaggccaccccgaaagaaagacaatagcgttcaacacgagaaatctgtatgcaacaaaagaacaagcagcaaactagcagacagaaggacgcaaagagaacaggatgagctaacgaagcaattcacaaagtcaacgaccacacagagggccagacaccagacgagaaagaaggagcacgaagacgaaacaacacaaaaacaaaaacatgagaagacacaagcaagagccacgcccagaaaacacagaagcaatacaaacacgaccgacacagacaacgaagacacacacaaa

SEQ ID NO: 560606 - DNA, 98 bp, Homo sapiens
ggttgtcgggggtaagatgccatattgattacaggccagcaaagaccagtaccaggatttacttgaccattccccttatttttcatctagaggaatct

SEQ ID NO: 560607 - DNA, 467 bp, Homo sapiens
taacgaatccactgtaaattgattacagattaaaactactcaatgttcgtcagtaatcgcattagcccctagtcatgttagagccgtatggtgagttgcctcgaccagcgtggtaaactggtgattttccggaatacctcccttacgcgtgattggaaagaagcaatgcatcgtgtcagtttaggataggcacgtggctcagtcaccaaatgcagtattttatacaccgtgtgatatgcttagctcttatactttgttgaaggcagctttcatggaatcttccttgaaagacccttggagatcaatgcacggatacctcttgggcttgccacgagaagaccatgatcccgggcctctttggctctatgtcgacaacaggtgatggttgccgtggcccttataagactcagcattttctaatgccagggcatgagactaaggtgccgtatcctctgtggagagttcta

SEQ ID NO: 560608 - DNA, 347 bp, Homo sapiens
  misc_feature (257)..(257): n is a, c, g, or t
  misc_feature (300)..(300): n is a, c, g, or t
tggaacatgtagaggagaaagatctcacaaagaaggtgacatcgtaccagggtcatagttgttaccttcttgctcatcctcagattattaagcgattattcacatttaattttaatagtttgcaagaaaaatcaacactggaaaattaaatactttaagtgaaaaaagtatataaaaagattaaaaatttctaaaataataataatctaaataggctacttacctactactttttggaaatggaaaaaggaaaaggnaaaaaacagctattaaatatatctttggggttaccctggaaangttttaaaagtttaaaatttttaatcccctatagcctatattgtttg

SEQ ID NO: 560609 - DNA, 302 bp, Homo sapiens
gaattccccccccccccccccccccttgtttgggttaagggggtttttaggtttgtttgtttgtttgtttgtttaggaaatggagtctggctctgaagcccaggtttttgtgaagtggaacaatctcggttcactgcaacctccgcctcccaggttcaagtgattgttctgactcagcctcccgagtagctgagactacaggtgactgccactatgcccagataattttaatatttatagaagagacggggtctcaccattttggccaggctggtctcaaactcctgactcgtgatcccccc

SEQ ID NO: 560610 - DNA, 1255 bp, Homo sapiens
tttcttacttggtgtttctgttgctgttttcgcctctggtcgtcgtcttttgttgtgtcggccgtgtcgtcattgtgccctctcctgcgtgtgttgggctactgtcttgcttccttgatatttgttgcaccatgcttttatttgctcttcataaggttttctcgctccatgttacgggccttttgacagggtccttcctccctcgtgggtctcggcgccccgcggtgtttctctctctggtgccatcttgctgcggctctccttgtggacctctcccggatttccccttggcctggagtcttcttgtgcccttcgggcctttcctcatggggctatccactcgggggtccccccgttgtgagccttttttttttccggatttctccccgttttggaattggatgtacccccgaagttctgcgttgggcgttggtttcacgggagctttcattctcgtccccttttccccaagactttggaagggccccggcttgtatcctgtcttgtgaagaatgaggtttcttctcttgggccccacgcggggtccaccgggcccccccctcatgggcctctctgcatcggtgttcttctccacttgcggccccatatttgggaggcgcccccccgtcccctagattatcccccatccctactacccacgccagaagggaatgtacggagaggatgtatgcaccatatggacccctgtttttggcccagatgtcaccaataggaggtagagtaggcaccaagagagagcctggcacacagcctttccggggaagaggaaccgggcttaccggcacagtatactcccggaggaaagaatgggctccacgaatgcccctgcaccctgtggtggcccaagtctcctccactccctgctttggaaatttcacaagcccttgggaatgaatgaagatccggaacactgggctcacgctggaggcctgtgttgcgcctttattccacgcctggaagcggctggttctggggggcttcccaacctggtgcccgctggggctatccggtattccgcgagagctacacgaattcacgtgtgtggtggaaggacgaccacggtggggacacgaacttgctggaggaaggaggatcaccccagtttgaaggaggcacacgtgcacagaggtgtcgaatatcgcacgctttccacaccagaattctgaagcctgaggtgtgtgtacgtgcgcgcgtgcgtgaggccctgtccccgatttaagcctgagaccggcca

SEQ ID NO: 560611 - DNA, 322 bp, Homo sapiens
actctgcagtgacctagatatccactgtggaattgggacttatgctactcttgttgtgggggggtgtcttagtgctgcacctggagggcactccttggttctggagggtgaccaccaatggacacaggacaggaagcccaggatggttagtgcaactcgggatgaagtgcaggtagaagcgggtgctctgcagtggccggataggtccagacgctgaggccgaggcgcttcctgttacgtgcgggcgttccgctctgtctctgccaggcactctctgactagggcccgggcatggatgatacctctcctcaggggtaccgag

SEQ ID NO: 560612 - DNA, 895 bp, Homo sapiens
  misc_feature (72)..(72): n is a, c, g, or t
  misc_feature (83)..(83): n is a, c, g, or t
  misc_feature (96)..(96): n is a, c, g, or t
  misc_feature (171)..(171): n is a, c, g, or t
  misc_feature (177)..(177): n is a, c, g, or t
  misc_feature (186)..(186): n is a, c, g, or t
  misc_feature (192)..(192): n is a, c, g, or t
  misc_feature (201)..(201): n is a, c, g, or t
  misc_feature (234)..(234): n is a, c, g, or t
  misc_feature (236)..(236): n is a, c, g, or t
  misc_feature (241)..(241): n is a, c, g, or t
  misc_feature (254)..(255): n is a, c, g, or t
  misc_feature (260)..(260): n is a, c, g, or t
  misc_feature (268)..(268): n is a, c, g, or t
  misc_feature (272)..(272): n is a, c, g, or t
  misc_feature (276)..(276): n is a, c, g, or t
  misc_feature (291)..(291): n is a, c, g, or t
  misc_feature (296)..(296): n is a, c, g, or t
  misc_feature (298)..(299): n is a, c, g, or t
  misc_feature (301)..(301): n is a, c, g, or t
  misc_feature (305)..(305): n is a, c, g, or t
  misc_feature (307)..(307): n is a, c, g, or t
  misc_feature (309)..(309): n is a, c, g, or t
  misc_feature (317)..(317): n is a, c, g, or t
cccctcaatctaatattttatttaaacaaaaagaacttcgttctgctttattcctattattatacaatgttnacatatagttnaaactctcaaganaacgtcctttaccagttgtatgtggtgtctaaatctttaacatgaaggactgaaaagagtggaaatccacactgnttgttntcctacagnttgtcntgagctgcncgtgtgccaatcagaaaggaatggaagtctcanangagcngcgtggcttacannccctnggctttantganttcnggcatgcgggatccntagtntnntntgtngnanaactcaanacaaaatatattagtgattgcacaaattctactttttacattggtagacaaaagaccacccggggacctattagttcaaagtattgcccctccacctccgagtgtgtttccaacaatgtcactcccccgaataatctatcataggaacctagtaagtaatctcaacctcctatgaggcgcggcttcttgacctaggctaagtaaaatttttatttttattttatagattataggtgggtaacgagacgacattacaagcgccaatataatgctttgccaggcgcgatctcggaagtaccaaggaccagttatagcacccatgcctagaataatgtgggaatgagggggagaatttgcaccgattgtaagatgcagcaagactattcgagatgaatggcgtcccgcccatataactgccagtggtataaatcaccttagggatattcttccctactacctccatcgttcgagtagattgttggtatctgatgattatatcaattttgaaaccgcggtggacctatcaacaggaaacattactactggtgcctagaatatcctgtgatttcatgcgctca

SEQ ID NO: 560613 - DNA, 677 bp, Homo sapiens
  misc_feature (72)..(72): n is a, c, g, or t
  misc_feature (83)..(83): n is a, c, g, or t
  misc_feature (96)..(96): n is a, c, g, or t
  misc_feature (171)..(171): n is a, c, g, or t
  misc_feature (177)..(177): n is a, c, g, or t
  misc_feature (186)..(186): n is a, c, g, or t
  misc_feature (192)..(192): n is a, c, g, or t
  misc_feature (201)..(201): n is a, c, g, or t
  misc_feature (234)..(234): n is a, c, g, or t
  misc_feature (236)..(236): n is a, c, g, or t
  misc_feature (241)..(241): n is a, c, g, or t
  misc_feature (254)..(255): n is a, c, g, or t
  misc_feature (260)..(260): n is a, c, g, or t
  misc_feature (268)..(268): n is a, c, g, or t
  misc_feature (272)..(272): n is a, c, g, or t
  misc_feature (276)..(276): n is a, c, g, or t
  misc_feature (291)..(291): n is a, c, g, or t
  misc_feature (296)..(296): n is a, c, g, or t
  misc_feature (298)..(299): n is a, c, g, or t
  misc_feature (301)..(301): n is a, c, g, or t
  misc_feature (305)..(305): n is a, c, g, or t
  misc_feature (307)..(307): n is a, c, g, or t
  misc_feature (309)..(309): n is a, c, g, or t
  misc_feature (317)..(317): n is a, c, g, or t
  misc_feature (343)..(343): n is a, c, g, or t
  misc_feature (355)..(355): n is a, c, g, or t
  misc_feature (361)..(362): n is a, c, g, or t
  misc_feature (364)..(365): n is a, c, g, or t
  misc_feature (377)..(380): n is a, c, g, or t
  misc_feature (390)..(391): n is a, c, g, or t
  misc_feature (396)..(396): n is a, c, g, or t
  misc_feature (468)..(468): n is a, c, g, or t
  misc_feature (488)..(488): n is a, c, g, or t
  misc_feature (499)..(499): n is a, c, g, or t
  misc_feature (511)..(511): n is a, c, g, or t
  misc_feature (675)..(675): n is a, c, g, or t
cccctcaatctaatattttatttaaacaaaaagaacttcgttctgctttattcctattattatacaatgttnacatatagttnaaactctcaaganaacgtcctttaccagttgtatgtggtgtctaaatctttaacatgaaggactgaaaagagtggaaatccacactgnttgttntcctacagnttgtcntgagctgcncgtgtgccaatcagaaaggaatggaagtctcanangagcngcgtggcttacannccctnggctttantganttcnggcatgcgggatccntagtntnntntgtngnanaactcaanacaaaatatattagtgttggccaganttctcccttgtnccatgnngnnccaaagcccccnnnnggcccttttnntcccngtcgcccccttccccccctgtttgtctttcccccttttcccttcctgttgactctttccttggccctttgcntggcccttctcctgctttcntgcggcttccnccgctgcctccnccccctgtgttgctttcctctctccccagtgtggccgcctccccccggggcttggcccttttgcccccggctcgccctgccctgggcttgcctttttgtctgtcttttcccccccccctgccctcgctggtttcttgtggttgtttctgtgcctgtggtccccntc

SEQ ID NO: 560614 - DNA, 543 bp, Homo sapiens
ggtccaccgtacggtggtggggggcaagtcagcgtcacctgagacgggcggtggtgggatggcaacagcctccggggggtcggacttgtctggctccggagcgcccccggccggtgtgggagctcaggcggcggcggccgctgaggaggaggagcgagaggtggtgcgggtccgagtcaagaaatgtgagagcttcttgctgtcagagttccgctcttttgctgtagatccccagatcacctcgctcgaggtgtagcagcacatcctcatccgagcctttgatttgagtgggaagaagaactttggcatcagctacctggggcgggaccggctaggacaggaagtttacctctcacttctatctgactgggacctcagcacagcctttgccactgcctcccaaaccttacctgcaattgcgtgtagatattcggccctcggaggacagcccattgctagaagactgggacataatcagccccaaagatgtcattggctccgacgtgtagctggctgggaaagggtcatcacgtgacgagtgct

SEQ ID NO: 560615 - DNA, 468 bp, Homo sapiens
  misc_feature (222)..(222): n is a, c, g, or t
  misc_feature (373)..(373): n is a, c, g, or t
ctgggtgctttctttcccctcccctccttgcaacctggatctgaggctgttgtaaacagcacagccctaaaatgggaatgtagatggggaagttctctgaagtacagccatgtgctggctgctttagcaagcatggaaataaaagcagaggtcccagaagagcccttcatccaccatctcagtcacaggaagaagctgctcaggagatcctcacttctaaanacttcgttcattccgcatttgataggcacagactcaccagcaggtaccagccaagttctggagttggaaaggaacagctaccctccagggcttcaggagccaggaggagaaatggtcaatgaatacataaataaatgactaaaatcactgnctaaaatgacttggagtcctgtggttgacacaagaagtagaatgtcccagtgaagagagcaggaggatgtccaagggggggggcctctagcaagc

SEQ ID NO: 560616 - DNA, 247 bp, Homo sapiens
gtgagtgtactgttgtcgagattgtacaggagtggtgattgtaacggagacgaggtagaagaatctggctggttgtagatgcaaagtagtgatcaacgagggaaagtttgtctgtaaaattcaaaggggcacatgggctttgtaagctggagaatgaggtgaggttaaagctgtgtgtcccttaccactgtgctgatcagtgcctggcacagtacctaacacatagtaggcacggttcaccaatata

SEQ ID NO: 560617 - DNA, 253 bp, Homo sapiens
  misc_feature (27)..(27): n is a, c, g, or t
tccctgggggggggttggacccccccngctttttttttttcctgccccccccccactctccctgtaatttatggaccccgcccccccgggggttgggggtatttcctggcccttttttcccaattttttgggggtgggaggggggggtttttcccttaaaaaggggggacccccaaagctttttttattttcaatcaatcagtccctgtgtccccaacattttcaataaacccaaattgggtcccccccccca

SEQ ID NO: 560618 - DNA, 1026 bp, Homo sapiens
ggagagaactagtttcgagtttatatgtgtttttttttttgcccctaaaggggttaaaggggttccaatgggttacataagaaccctattttcaaagaatttttaggggaattaatttctaggaacgagtggtgcattagaaacgtggtggattggcacctccacagaatttctcagaagcctatatgaccgtatagtataataccccgcggttcggtgttagcgcgtacaacaggtgctttgtgctttaacaactttccgggaaatggccactctgtgtatttacaagcccctaagtgtgtggggaaccagctcaatgaagtgtgccacaacacgttctggcgtagactgttaattctcataaatacgaaacagtgggggactcacaactcgggaacactacataatctgcgcatgtgttcaacaccgtctccaaggaggcgactttcacgaagagtctccgcacccgctgagcctacacctacgggacaaataaacagtgggggacgaaaagaacagtgacccagagacaatctccgacaacgccctctcagccccccgacgccagcgcacctccggcgtgataacaccccacacacaggcatcacgacaccaaccccaacaacgggggagcgagaccacccacatcgcgcacacccggcgaaggccaaaatctagggacgaggagtcaaattccgatcgtgccaacacgattcccccctctcgtattctcaaagtgcatccaaaaatagaaattagtcaggatacacgagacagcaattgcgaagctaaacgaccaagtcactcaccagcgccccacaagaactaatagcaatcagctcgacagcgatctgatacgaccactctccctcaatcaactgaatccgtgacttcgtacaacctcagtcaactcaagcaagccatattacgtttcgagacaagcaatgcgtaccgcagagaaacaataaccactctagaacacctcactcgcaatagagccagcccaacatgatccatactagtcag

SEQ ID NO: 560619 - DNA, 618 bp, Homo sapiens
agagactctcacagcactgtcaaccaatatgacctaattgacatttatagaacactccaaccaataagagcagaatacacattcttttcaagtggatatgaaacatttaccaagatagattatattttgggccagaaaacaagtcctcataaatttaaaaggattcaagtgatacaaagtatcactctaaccacaatgaaattaaacttagaaatcaataacaaaataatccttttaaactttccaaacgattagaaagtatattacttacatgtaaataacagatgggtcaaaaaagaaatcaaaaacaaaattagaaagtattattaactgaatgataatgaaaacacaatatatcagaatttgtggaatgtcactaaactactacataaggggaaatttgtagcattaatgcctatgttagaaaaaaagaatggtctaaaattgatgacatcaacttccactttcagaaactagaaaaagaagagcaaattaatcacagtaaacagaagaaaggatgtgaaaaagggcaaagcagggatcaatgaaaccgaaaatcaaggaaaaccaaaagctggtcaaaaaacaacaacaacaaccaaaaaaaacttaggagaa

SEQ ID NO: 560620 - DNA, 465 bp, Homo sapiens
  misc_feature (362)..(362): n is a, c, g, or t
  misc_feature (385)..(385): n is a, c, g, or t
  misc_feature (421)..(421): n is a, c, g, or t
caccacagcacaaggatgcctcctgcctctgtagactccacctctgggggcagggcatagctgaacaaaaggcagcagaaacttctgcagacttaaacgtccttgtccgacagctttgaagagagtagtggttctcccagcacagagtttgagatctgagaaaggacagactgcctcctcaagtgggtccctgaccctgagtagcctaactgggagaagcctcccagtaggggccgactgacacctcatacagcctgtgcccctctgagatgaagcttccagaggaagggatcgggcagcaacatttcgccattcttgcaatatttgctgttcggccacctcggctgggtgatacccagggnaaacagggtctttggagttggancttccaggcaaaacttccaacagacccagcagcttnaggggtcctgattttttaaaaagggaaaattaaggaaattagga

SEQ ID NO: 560621 - DNA, 1490 bp, Homo sapiens
  misc_feature (233)..(233): n is a, c, g, or t
cgccggtataaagtgtcgttaaaaaggcctttggttttgggttttaccgtgtttccgagaaatttgtggcttttagtggaatgtagccgcccacccagtgaaacccccaatcccgccagtgttgtggcttcaagtgtggtgcacagtcttattgggattctccagttcgttcttgtgggttgcaacatcaagttaccccatgaaggccaaaggttggaagtggtggtgcaatnaaactgctctcaaaagttcaagtgttagaggacgacgccattgaaagctcattaccagtagccaataatttttggctctccctattctcaaccagtgcacagtttgacacagtggcctcaggttcacagtgcaccatgtcactgtgctatcctacgaaatcatttgtttataagatgtgttcattcctggagtgacatgccaccccgaatggctcactttcgctgagcatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgcttttgcttgggataatggagtttttctttagaaacagtgccaagaatgacaagatattaaaaaaaaaaaagaaagaaaaaaaaaaaaacacctacttttaaagaaaatccctaacagaattttaaataatagtttaatcttcttaccactttctctttctctagtttctcttgattttctcaggtctcaggcgtgcattctctaacctcattccttggtgacaccacacagggtgtttttgtgattctcagaaattatttttgaaattcctgcattagtcttaatttggttcaaaaattaaagaaaattccttaacctttaaaaaaaaaaaaaaaaaaaaaaaaaaaaaaaaaaaaaaaaaacaaacaaaaaaaaaaaagaaaaaaaaaaaaaaaaccaaaaaaacaagaagaaaaaaaaatagaagagataacaaaaaaaacaaaagcaaagaacaagacaaaaacaacaaagaaagaaaaaacgaaaaaaagaaggaagaaagaggggggcgggaggaaacacacagcgcagaacaagcagagcggaacagagacacagacggggaggaagtcaaggggcgaacaatgagaaagaaccacagacagccatcggacagcgagcacaaaggacacgggcgaaagtgccgcagtaatgacaccacagacgcgaggagaccggaccggagcagccaagacagactagggaggaggagactaccaaggaagaagaaaacgcaccaccaagcgacgaaccgccagctcaaagacagaaaaagagagagagaacacaagaagagaacaagcgccaaaagaagaccggccccgtcgcacgcacacccacaccggccgaagcaaacaca

SEQ ID NO: 560622 - DNA, 992 bp, Homo sapiens
  misc_feature (367)..(367): n is a, c, g, or t
actttcgtgtgtctgtttcttgctggtgtctcgtgttctttttgtgtgtatagtagctatgtctcagcgcgcggcgcagacagcgagcaccgcccttgtaggtgttgcggtcgtttcttttagtggcccctttgtgcggtttttttcctccaaaaatttggggccagggcttctttccctttctgtctggtatggttggggattaaaaatgcgccctgggccactttgtgtaatctcgtgcccagatgtgcccttgatgggtcatacaggcgttcctgccccactctccgaggccttgttccgggagtccccccggcactgcgtcagaagccccattaccttttgagtggtgcacaggaataacatngctatggctttggaagttacttaccggggacgactgtatagatatataagggcagttaagaatccgcctggactatcataatatctgggccagaacctgatgcgtcgaaagggaccaggacaccatgataaattgggtggagaagcacctggggccaagcatctccacacaccagccgggaaaggaggaccattgcccagtgccattgcggagccttaagctgctggccaagaaggctccagcaccagcccgttaatgtagaacagtgatctatccccattgagacagctagagaacacgttgagctgagctataaattgggaactagtctatttgaccaagtctcttctcgtgcttggtgtctactgaagttatagtttaccctctcctagaagaatgagaaaggttgtgttcatatagtgagagagacgagaattcttctatcggccacgtcagatgttttctcatcctttcttgctctgcctcttgagttgttccgtgatcacttttgaataagccggttgccctttattaaaacttgctgcctgaatataagattaaccggttatagtttaaatttgtaattaattttaccctccttgccataaagtgaccattggatgga

SEQ ID NO: 560623 - DNA, 621 bp, Homo sapiens
agaatacactgcaccctatttgtagtcttttatccctcacccccttcccagcctttccccgtgagtccccaaagtccattgtgtcattcttatgcctttcatcctcatagcttagctcccacttacgagtgagaacatatggtgtaggttatccattcctgagttacttcacttagaatagtaagtctccaagtctcaatccagatcactggcaaatgccattcagttcattcccttttaatggcgtggagtagtattcccattcatatcatatcactatattcataagaaagacttatattcactaatatggcatatatccaaaacaccagagataacatataattccaacttcggtggacatgccatgggcgccattcggggcagcggtgaccactttgactggccctttgtaaaaacctaacccgagattaaacgtggctgggccccaattcaaaggaaagaagctcacattttccacgtgtgtcaccacgaccccccactaacggtcatgtgacacgatgtcaacaggacctgggaacccacagctattatcaccacacaccacttttcccacgacgaaatggggaaaccccacacaccgtctccaccggacggaat

SEQ ID NO: 560624 - DNA, 103 bp, Homo sapiens
cccccacacttcgatcgcggtataaggaaatgaaaagaaaagaaaaaggaaaacaaccaccaccaatgaaggttaagattctccgggtaccgatgctcgtaat

SEQ ID NO: 560625 - DNA, 145 bp, Homo sapiens
gaagaggcggacatgacccagcaagacgagaagaccctatggagctattaataatattactgcacggcagtacctaacacacccacaggtcctaagactaccaaatcctgcattaaaaatttcaggttcggggcgacctcgagag

SEQ ID NO: 560626 - DNA, 296 bp, Homo sapiens
tactggcattatcagacttatctgtaatgtcttctaaaaataaagattcctggtcacacctcaaacctgcagaatcagaatttctgagacaggggactggaaaccttttttttttttttttttgggaaaggagtcctttggcccccgggttaaagcaatttttctggcttaagcccccttaatgaagcgggattaatgggcaccccgtgaaaaatggcccacgtgtaattttttgggaattttcacaagaaaaagcggggttttcacccattgtgtggggccaaggcgtgggtgtg

SEQ ID NO: 560627 - DNA, 658 bp, Homo sapiens
agtcacagtacagtttgcacgacatctttgttcatacatagctcagtgcttctggcaccaaagcaagatatgggttaggttggtgtatgcagagacaacctatgaggagggcccataaagcaccctccactttagtcctgaggagatacgaaagcagaaatacatggcatctgtcacttggtggcactagagagggtttcagaggatcctatgtgaaacactagtttaaagatgacgagtggggagaagtgacgaggaaataaggaaatctaggtccgactggttttctggtactgcaccattgattcaatggagactggcgggaggaaatggaagactagggttggagatgggatgggtggggcaagggatggaaaggaaaaggcagacaactaatgcgttccatttataacaagtaatatatatcaaagacttaaaggagattaaagaccaatcagaataatttggcaactttaattcttaggaagatcaaagttccctccaaacctaatttgatgttttattactaaaagcaaagaccagtatggtacagtattactccagagaaattagaggaaaatccttagggcggcttcacccacattcattttatgagtggatacctcccctacgtcaaatgctttagggaggtactgct

SEQ ID NO: 560628 - DNA, 110 bp, Homo sapiens
cacataaatagtatggcttcgaagaaggcgtggctacagatgtgcaggaatgctaggcgtagcatgtggatgagactatttatacccaaggagggatgagcagggtaccg

SEQ ID NO: 560629 - DNA, 381 bp, Homo sapiens
atctacggagtgtatagagagcacaatgtggcatctctttctgttttagcttgcagtggtacttctagtgcggttggtgctctctcctggtgcctggtggatggaagggagcagtgcagtgaggggtggggcaggccctgcctacagagcctgtcagtagtggaaccagtgagtcaccagaagtccaatcactcagtccagctcctggatgctgttggatcacgggatctgtctgagcatcagtttccttttctgaaacagtagggatgataacagcctaggatggtgggtgactcagtgaggtaatgcagatggaacaatgcatagtaaatagttttatgccagagttgggtgagatcgataaaaaagggtaccgagctc

SEQ ID NO: 560630 - DNA, 507 bp, Homo sapiens
cagtgataaaaatgtcctaaaattgactgtagcgatggtcacacaactctgaatatgcttaagaccattgaattacacactttacgttggtgaattgtatggtatgtaaattatagttcaataacatagttaaaaaagataatcaaaagcatgaaagcactgttgatgtggtttggatctgtgtcctcaccgagtctcatgttgaaatgtaagccccctggtgggaggcgatgggattatggggcagagtcctcacaaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctccctagaagcaaaagctgctgtgcttcctgtaccatctacaggaccgtgagccaattaaacctcttttctttataaaaa

SEQ ID NO: 560631 - DNA, 392 bp, Homo sapiens
  misc_feature (55)..(55): n is a, c, g, or t
  misc_feature (250)..(250): n is a, c, g, or t
  misc_feature (296)..(296): n is a, c, g, or t
  misc_feature (375)..(375): n is a, c, g, or t
gcggtggggacaggaaacaggatgggaagaggacctgttgtgacaggttctaaanggtatagtttagaagcaggtttccaaatgccttgagccacatgtgttcagcagcatgaagatggtttgtggcagatatatttctagattttcaggagagtaagtctagagtaaatacccatctctcttccttgctgtttcctctagcctagagttgtgaggtcacaattgcaagtgactttacggtcccctattngagttaaagatgggagaaggaaaaaggccttttgagccaatggctnaaacatttatttcaggtccagtccatattaggtgaaatgtactagtttggggagattctttagttattttggggcttanccaaatttaccccgttt

SEQ ID NO: 560632 - DNA, 194 bp, Homo sapiens
  misc_feature (7)..(7): n is a, c, g, or t
  misc_feature (27)..(27): n is a, c, g, or t
  misc_feature (32)..(32): n is a, c, g, or t
  misc_feature (35)..(35): n is a, c, g, or t
  misc_feature (43)..(43): n is a, c, g, or t
  misc_feature (70)..(70): n is a, c, g, or t
  misc_feature (89)..(89): n is a, c, g, or t
  misc_feature (137)..(137): n is a, c, g, or t
  misc_feature (142)..(145): n is a, c, g, or t
  misc_feature (165)..(165): n is a, c, g, or t
  misc_feature (173)..(173): n is a, c, g, or t
cgggagnacccccatggagggagcctngcctngtnaccaaacnaaagggaagaaagtttgcctccaaacnaaaccggggaacaaaagtngggaaggcccgaagatccgcccgcccaaacatcccaaggctagaactnacttnnnnatccggtgaacgccccaacncagccctncagcccctagctgcccaattt

SEQ ID NO: 560633 - DNA, 379 bp, Homo sapiens
ggggttccccccgggaatgccccgggggccggttgggttccaaaagttttaaaaggggtggttaccttcccggttccttttttgccggtttttaccaataatccagggccttttttttgggacccctttggtttttatttttttgggttcccggctttggccctttttttgcccctttaaattttaagggccttaatggtttggggcttggtgatggttttgggccttttgggtccctaccttttggattttaattaaatccgggggtatggtttttggccgcctggtttgggggggatttttatggtccttaagggaattaatttttgtgccggaagggctgggttaaattttggttattccaatgtggttttcctga

SEQ ID NO: 560634 - DNA, 428 bp, Homo sapiens
  misc_feature (357)..(357): n is a, c, g, or t
tgatcttccgctctccaggcctttgctcaggccatgccctccgcccagcacatctgctcctccacctgcacctgactccctggccctcgtgaagccactcccatactcctagacagggctgctgcgccctccacttctgggctcctgaccagctctggtatgtcagtttctgcattcattcctgtctctattagttataaggcaagttctgtgggatgggaactacatctcccttttacagaggggaaaccaaggcccagcacaaaacctgagaccacaaagcatcttgcctcaaaaaatccctcttggctcggcgcggtggctcatgcctgtaatcccagcactttgagcactttnggaggtcgagacgggtggatcatctgaagtcggaattcaagacagcctggccaacatggtgaacgccatct

SEQ ID NO: 560635 - DNA, 251 bp, Homo sapiens
gatccgcgctacaacgccaaggcgatccgcacatgccgtccggtcgaacgcggcgggtaaaacccttcttgaggtcctgttcacagccgcgagtagtccccacggccatctttcatccgaatcgcggcatgcagatggtcggggagcacgacgtaagcaaggacggcatgcggaacacgttcgcgcgccgcgcgccatgcggcaaaaagcgaatcgatttcacggaccagaagatcgccttggcgttgtag

SEQ ID NO: 560636 - DNA, 477 bp, Homo sapiens
  misc_feature (3)..(3): n is a, c, g, or t
  misc_feature (119)..(119): n is a, c, g, or t
  misc_feature (125)..(125): n is a, c, g, or t
  misc_feature (134)..(134): n is a, c, g, or t
  misc_feature (149)..(149): n is a, c, g, or t
  misc_feature (151)..(151): n is a, c, g, or t
  misc_feature (168)..(168): n is a, c, g, or t
  misc_feature (221)..(221): n is a, c, g, or t
  misc_feature (228)..(228): n is a, c, g, or t
  misc_feature (237)..(237): n is a, c, g, or t
  misc_feature (246)..(246): n is a, c, g, or t
  misc_feature (261)..(261): n is a, c, g, or t
  misc_feature (265)..(265): n is a, c, g, or t
  misc_feature (284)..(284): n is a, c, g, or t
  misc_feature (300)..(300): n is a, c, g, or t
  misc_feature (305)..(305): n is a, c, g, or t
  misc_feature (311)..(312): n is a, c, g, or t
  misc_feature (319)..(319): n is a, c, g, or t
  misc_feature (341)..(341): n is a, c, g, or t
  misc_feature (365)..(365): n is a, c, g, or t
  misc_feature (369)..(369): n is a, c, g, or t
  misc_feature (450)..(450): n is a, c, g, or t
tcnctgggatgggactcaggggggacagacgccccctcctcaggcagctggctcagaacttaggtagcagggtcagagggactggaaataggaggaaggggacccggacggccctgganatgtanctggccacnaggcacatcggccgnanatggggaaatggcatgntccagcaggcgcagggctgcgcaggtagacacctgccgggctcctcgggctcncaaatgnaccagagangccgggaanaggttcgcctgaaantttntctgcttttggtcatccangactgttttttgaggngtgangaaaanntaaaatnacagctcggggttccccaggtngctcctcacaaagtctcgcaagtncccnactgtctcgctggggcggaagaagacctgtaggaagtagcggtcggggaacaggaccctcagagccacctttgggtagcgntcaagcttctcctttatctgcgcctag

SEQ ID NO: 560637 - DNA, 776 bp, Homo sapiens
ctcctctcctaacctcgctctcgcgggctacctttacccgcccgcctgctcggcgaccagcggggatcctcccccaggcgcaggtccacgatgaaatgcagatgaatgaggaaacttactgaaggacacacgagacagctcatgactctcctccgggtgtcgcgctgcctaagctgtcgtctcgtgctttctgtctgcactacgtcgtgttgaatctgtccagggtgagtacgatctcggatggtcacagagttaaagaccgtgtaaccgctagctcatcctttgcctcttgtctcgagtgagcgaacctctcgcctgtggggcgcttggcacttgcggtggtcgttgatcaccctctgtttcgatcacgatttcggcacgcatcattcgcgctaggaaagattgcctttcccttgtggttgcgttttgtggcaaccgccaggggctttaatgtaatgcccttctttgggacgcaacactacggtcacgggggtaaacgccattgggtaccggacccagtcaagatcagtgggccgccaaagctttcctccatacaccgatcacggactggaaactgccacaagagcatggtcggcttttgcaacactaataagcaacggtgtggagacccaaatataccccccccgtttgaaaaccacccgtggaaatgttaaacccttgcgcctttattggcaccgcattatacaacaccacgttggggctcgagagcccgtaggcggcacgaaaaaatctcaagaccccgatgttttcccaca

SEQ ID NO: 560638 - DNA, 234 bp, Homo sapiens
tgtatcgcaagaagacgggtagtatggaatgtgtcgagactaactgcagatacaagaggatgctggccattgagatatgcaagcattttgaactgggaggagataagaagagaaagggccaagtgatccagttctaaactttgggatatttttcttcaattttgaagagaaaatggtgaagctatagaaaagttacccgagggaaaataaatacagtgatagggtggtatagct

SEQ ID NO: 560639 - DNA, 548 bp, Homo sapiens
gggcggccggctagctaggacgcctgtggaaatgaggccctcgccaggtgatggcagggccatgggtggcctggggcacccagtcggaatgtgcttatgtatttggtcaccatgccgtcatcctgggtcttttcctacgtgtgtcttgttactaaggcctctagtcaaatccacagcaacatctctctccttccttgccacctgtcgagcttctctggcttctgaagataatgcaaccgatttgtgtaacaccaactacttcaatcttcagcaaagcactatgctattgatgtggtgtagatcaagacccgatgctttcagatgacctacttacatcttcaatgtggataacgataaagaacaaaacacatgcatctaggaactgctgggctagattccagtttgacttttaagactgtatagaagtggaattccaaacagcttgaagcacattcagctatatgactagcaagagtaacatctatggatagtggtattgtcgtgaatgactctttgtaaactacaaacgaaataccttacgtaaagag

SEQ ID NO: 560640 - DNA, 860 bp, Homo sapiens
agcggactgggctctgacccagacccggctgacccaccctacccgcgatcctgcccatggctgacgggctctattcggcgcagtaccctggggtctcgagcagattcgcccggagccgagtccgaatggcctgtttgacaagcctcccccggaagaccctccctgctgccctgcgggcccaggtcaggacgtcggcacagatgggccaagaaggctggtcaggcgcgcagaggcacgggaagggcagcaaagaaagagaatgcaggaaggggagaagcacagagggcaaaagggctgaggcaatatggaatatatatgaatgatagaaaaaaacaggacacggcagtacgagaacgcacactgatgaacagcaaggacatgttcaaatgtgccgatggacaaaggtatatacgcagaggcctatatggcagcaggagagcgcaaaagtcagaaacggaaggataagttaggactaaatgaggaagaaatacaagcaagacaagggcgaggaccgcggacacagaacaaacacgaagagtgagcgaagagaacgcacaacaacaagcggcgccacaaacacagaagcaaagagaggaagtagccagccaaaagagacaagcgagcaaacgaagcacccccacggcgaaacacaacaaagggcaaagagcagcaccagtgtatagaccagcagaaaaaccaaccaggaaagacaacaaacagaaagagaagaacgaaggggacatcaaagaacacaaaaaacggagacactgcgaaataatgcgaacgataacggatgagcaccacaaaccatgaggaaaaacgaaaaaagagcaaaaacgaccaccaagacggtgaaaaca

SEQ ID NO: 560641 - DNA, 127 bp, Homo sapiens
ctgccttggctcccaaagtgttgggatacggtaaacccaaccacacctggcaataagcttataacctctctaacacctcagttttctttcttgtaaagtcagggaagataatagggttatcgtctgg

SEQ ID NO: 560642 - DNA, 361 bp, Homo sapiens
gagtgtcttttcttatgtgattttttttaattgctatttgatatggtttggctatatgtccccacccaaatctcatcttgaattataatccccatgtgtcaagggagggacctgacgggaggtgattggatcacgggggcagttgtccccatgctgttcttgggatagtgagttagttctcatgagatctgatggttttataagtgtttgacaattcctcctttacacacactctctctctcatctgctgccatgtaagacttgcctgcttccccttctgccatgattgtaagtttcctgaggcctcctcagccatgtggaactgtgaatctattaaacctcttttctttataaatgaaaa

SEQ ID NO: 560643 - DNA, 637 bp, Homo sapiens
accgatgacgcatgcctgatttaggcaagattggacataatctaccaattaccggaaccaagatggagtgcttgggcaaggacatgaagatcaagatactcttggagcatctgtatctgatcagtgactaagaaggaattagcgaccattgctagcattatagtcgactctataaagcttagccgactattgatactgccagagcagactcagacacgagtctttacgttgaataagatcatactattagttgatagcggcgtcaacattgttcacgttatactaggtagacaaaggctgaaacataagtacgaataatttgctacacataacatggtcatgggttatattgatttgcacgcatagatatcttagattcagatcggcttcccgccagaggcttgagggtgcaggccttacggatctgcgagcacgattatcatgtatcaaagtataagaattgttctacaatggcctcaaatgctatcataatgtatgtacagagtctgattacttacatataggactgacatgattgtaggcatggcaacttgaacctgctatactactgtacacacctagctgtacagcagatcagtaatattttggatactatcacgagattcttcacccctcg

SEQ ID NO: 560644 - DNA, 1039 bp, Homo sapiens
  misc_feature (506)..(506): n is a, c, g, or t
tggcgcccccccattgtggggaagacttcgggccagatgagagcgtgtccaaaaaaaaccctcccaaaatcacgggcccccacagggagaggttatccacccgcaggaaaggccttcctccgcacgggaattggcctgaaaagagtctccacaacgcgtggtttttgtgaaaatgaccgggttggggcctttcagagatgcccctccccgtgtattcctaatgtttatattggggaggggcttcttcgttggaacttggggggccaaacccgttggcaaaagggaggccttggggcccaagagcccacagcgccctggtatatatgtgggaaatggcctttcccctcgtgtttgcgagtagtgctgctgttctcccctctaaatgcgccccgcgacatttcccgtgggagacactgcacgtcacaattgccccacaccacacattgagggccccccacatcccacgtatgttctcctaatacccccttgcactcggccacaaggcnacagcggagcttatatcgcacggccccacagagatggcccaccgctaaccttgcccctctcttcccctcgcactatatagcctttctctgaataggtgtttacatatctagcttccctcttcctcgtggccctctcatatccacaacgcgtgatatctttccctctttactcgtgttgaaatatcttaccaccccgctaaatgtgttgggagccacggccacaatccctttgtccacacttaactaataaatggcttggagaactataaacgtcacccacaaggtggctttatccctctggctgtaagaagaatggaaagggcgctggtgggaatttgctccctcgggttccctacggccctagtgagggcacgaaagaggaaaccactcctttccctttttaacacccctgagggcccaagattcccctcacgaaggcacaggagagtgctgccctcctcccctggtgcccgtgcctttttgctgtgtatgtggaccacccctgtgagggaataaacctggcaactaaggga

SEQ ID NO: 560645 - DNA, 197 bp, Homo sapiens
ccggatatgagcggtctcaggcacatggtcgcagaggcatttagaactatcagcctcatgtgtgtatgagggatgaactaaagatttctgttccagatgtttgtattggaccttagcatatattaaatagcattctaatttgctttaatttaaattaacggagttcccgtcgtggcgcagtggttaacgaatccgac

SEQ ID NO: 560646 - DNA, 1064 bp, Homo sapiens
cggctaggtagcgaggcctgggtggtgcaggtgtgatccagtgagaacgcgttcaggcccgaggtgcgttggtccccatccggctggacatggagaatcgatgggcagaagctgcgagacgccttcacctggaacatgaatgagaagttgatgacgcctggagatgttgtcagagaaatcctctgtgcacgatctggattgtgaagcccgctgcacgtttgtgccagccatcgcctctggcatcatacagcagatcgagtgctaccccacggatcaggcatcctgggagggacccacgtcagaccatgcgcgtcatccatctagagctgaacatccatgtgggtacacagcatttccgctggctgggagccgagtttgaagtgggcacgatgtcagagcaaggagtacactcaaccgagaggaagtttgccctgtaagctgtggctccagagcttggggttggggctggggcagttgtgtcgaccgaacgcatcgcattactacgcatccggtggcacgagctgaagctgtgcatcgaggagaagaccatatcgcccttcaggcagagaagcgccatctggccacgacggtggaagatgcgtccattctcggtagagcagcggcgcgaatgcggatcccagatgggtgcccactggcgtgtgagtactctgaacatgatgctgagaatgtgagagagatgggatccgcgagctaggacaggaagcatcgaggcggtgtgaggcgtcttgccaagggccggcccggggcgtggtaaccagtgcattagcacatcggcgtcccagcggagcatctcagatagatggtgcccgctcgtcctccagtcttctggcaggggctgaggcgatgggacaggccaggccatccttgaggatcggcggtgggggtggtcgtgggggttccgggtggcccttggccggccacttcctttggttgggcccgggtttgcccccaggtgtcccggcccgccttttcgtggaaggggtcccttgcgtggcggcgtggccggcccttgccggggcctattgggcttcgggcccgggtcc

SEQ ID NO: 560647 - DNA, 148 bp, Homo sapiens
tgactgctccctcttcatgacttccatattgaaactgacaggtcatggggcactcctccaagaagcttacttgagcaccaatctagagaagcttgtcttgtcccgaagtcctcaatataccaaagcctggtgtattaccctcacatag

SEQ ID NO: 560648 - DNA, 111 bp, Homo sapiens
agggcggcccgtgcacgcgctttcaagaaaatgttctcggaacactcggtcttctctattgaaagacattttctcattggttttgccgtaaaatcctgtggaacttcgcaa

SEQ ID NO: 560649 - DNA, 557 bp, Homo sapiens
gttctttctttcctgtattccatttttaaactagtaacagcaggccttttgcgtttacaatggaacacaatcaccaagaaattagtcagggtcgaaaagaaaaaaataatactattaataagaaaccaacaaacaagaacctctctttctagggatttctaaatatattgactgttccttagaatgtttaacttaagaattatttcagtttgtctgggccacactggggcagaggggggagggcaggatactgacatggctgcagatttctcagatcttcactaagggatatccaaagtgaatcagcaagtgaacgggcaggatggttggatctgtcggtcaaggtgtacatcagccctaacgtcagccagttaaaccacgacgatgattggaactcttgatagttggcgattgcctatgactaactgggaattgatcatgccggtatgtctcgcagaatacgtgagcgtgtggagaggagcacaccaaacaggcgggagtactaactcctaattcactgaggggactctgtgggcacctttcataccttatcgggc

SEQ ID NO: 560650 - DNA, 1826 bp, Homo sapiens
  misc_feature (1)..(1): n is a, c, g, or t
  misc_feature (1564)..(1564): n is a, c, g, or t
  misc_feature (1596)..(1596): n is a, c, g, or t
ntgtgtctgctcgcctttgttttcacgctgtctgttgcgctggatacctagatgctttcttctttggtggctgtgccatctgttcttgccgcctcccgctcttcgttgttcgcctctccctgcgcctcgtggttaaataggtggtcttctcgcccccgggctgtctctccctcgtgggggtgctttatgataaagcgccacgaccgcccgcgtggcgtctgtacagagcgtgataagcttggtggtcttccgggcgcccccctgctgtcatcaatattgtggggcggccccgcccgccttgttgtagctagcctttgggtggcgggatataaaattctcctcggttgttcctgattaatatttaataagtagggatgtggaagtgaaaatttcgtaaagacgcttctgctggaaggagttaataatttgtggggataatcatgccggggttgttgcgccccccctcgtggaagggggttgggtgttaacacccaccaagggggggttgtcccgaccccacggagaaagataattagtggtttaacaaaaacctgttgtgtcgcttcgcttttgaatctggcgatacgcaatactgtgattttggtcgcgcgcatgttgggatatcttggatcgttgtgtaacaatgatgcggacttttgaatgtggtagctggaaaacggaagttgtgtactgtgcgacttgatactgtgaactatcgaaatcttttttggaaacttagtactggaaggcgaagactctcttgtataacggtgatatatatgtgccgtccccccccgtgtgtgataaggtataaatttctttattttttccggaagagatattattctgtctccccgcgtccccttactaaaaagttgcggcgcctcactaatatggcttcctcaacaatctccacaggaagaagttggggaaataaaaaggaggcgctcctttgttaagcccgccacgttcgtacgatcttgatccccccccccaatgagcttctcaaaagaaggggacccacacaggaatgtccccctcttctcacagggaggagaccacacggggagaaattaaaaaggtcttctcccttttagaaacgcacggccctcacaaagggggacgaccccttatagttgtgtctcgttatagaaagagacacactttataaacgcgctcacataaaatgggcacacgccacacggtatatatgagagaataaggttggggtgtcttctttgtctcccccaaaggtgggagaagcccagagaattctatttcactaatatatatgtgtgagaagagaattggcgcttctccgggagatgacgctctgagcccacacagagaggcgctatatctcacacagagatctctcttggcgccacacgtgtgagaaggagaagttctctccttgtaaagagaaaattatggtgtgtataacccacacatgtgtgggttataaagaaatgtgttctcgctgcttaatgttcacatgttgcgtgggaaccacgcgtgtgagataattctgggctggtcctcgtgttgtagataaatgccacgnaggtgaggagaactttgttccgctgaccgctngtttggataaaatagtgtgtgccacggtgtctcattggccacagaattagtggtggtgcccaaatagcctcgtttagtgttttaaagatgggactcccacccctcttgcttgggtgtttaagtatagtatggaatagttatgataggacatagtagtagcggtggtccagacctggaaatggtggggagcaccaaaaataaaccatgtgaaattaaactccagtatttta

SEQ ID NO: 560651 - DNA, 338 bp, Homo sapiens
  misc_feature (282)..(282): n is a, c, g, or t
  misc_feature (317)..(317): n is a, c, g, or t
cccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagaggggttccaatttctgcggcattcttgccaacactagttnatttatctggactttctgggttataaatcattctnaatggaggtgtggaagtaggc

SEQ ID NO: 560652 - DNA, 325 bp, Homo sapiens
agcatgaggtgaatgggcttttctctgactctatcagctcccactgatatacctactttcgaccaattttgtgatgatagtaactgaagccattctctggcttatctccacacaaaatgaaaaggtattatccattttgtaggtgatatgtttttgagagggttacttgtcccaacgtgtcacaggtattaagcagttaatagtgggcttttttggcatttctcccctcccttattcctgtgcgtatttcaagcgttaaaaaatgcaaaacaaaactatttaaataccttaaagggttgtacatgtctacatatcatatatcctg

SEQ ID NO: 560653 - DNA, 197 bp, Homo sapiens
aacgatggtcctcagcttggtaactcgctggtggtccgggagggttcaggcttggtgtgccttcttcggttggtctgactttgggctcctatggttcatctccggcccggcccaccacagaaaaggatgctgctgcacagcttctccaaggtaccagtcatggaggccagcgcgcagcactttggggtaccgagctc

SEQ ID NO: 560654 - DNA, 134 bp, Homo sapiens
gtttaactgttagtcaagaggacagctcttggcactaggaaaacttgtagagagagtaaaaatttacaccatagtaggcctaaagcagccacaattcagaatgcgttcaagctcaacaccactactaaaatcca

SEQ ID NO: 560655 - DNA, 602 bp, Homo sapiens
gcaggctgtacggtcccaatcctttagatgcacggccgtgtgcagcgctttgtggtaggggatctctatgcccttctgatccacagcagacgggcagcctgcaccatgatcatcaactcagcgtttggcatgtggcttgactgaagaggatgagggggagctgtgtgcgtgccgtgctttctcgtctcctggctgaggactttgggcaggcactggagcaactgatgatagttcactcccaggccgttggatcccccaagataccctcagtgtactgacatgatgtgggttggactgccaggaggtgaagaaggagatccctggataccattcagtttcccccttggagcaccctgaggctactgagcctgggactgagacgctcatgccttctgatccatgggctccctgtgcaacggcaagagccttctgtccaacgcagtagccactgattgcatccttaccttcctcaacgtgaagggtccagaactcattaacatgtatgtggtccaaattgaggataatgtgcgggaagtgtaatgccaggccaggctgcagctccatgcattatctaactttgatgaactggactctttggccca

SEQ ID NO: 560656 - DNA, 478 bp, Homo sapiens
  misc_feature (6)..(8): n is a, c, g, or t
gccggnnnttatataaataactttgcctccccctatgttctgggtttacaatcaagcccagtggttttaggacgatgtcatacagcgcaagagggagctgttgccacctgaaaagcttcaagagatagagtaattcaaaaagaggttacgtaagcggcgttaggaaaagctccttagagactcccagtaaaacttctgaggcctccaagtaagagtcctagacccttccctgatgaaatatacatatactcagtttcttgtaaaaaaaaaacaaacaaaaaagcaaaaaaacataaaaaaaccttttcagcccgtttagccacagtcgaatttacatttaaacaagcttattaatgcggccgaaattaagcttaatttgccaatttccccaaaaggaagtttattaaaataaattgcccctttttaacaaaacggtaatttgaaaaaccttggtttaccaaactaaatcccttttaaa

SEQ ID NO: 560657 - DNA, 1182 bp, Homo sapiens
agcggagtgtgtggcccccagcaccctataccttgtccccctcttccctgggccatcattgcacgccccttcaccttctgtcgtattctgctagagtggcgagaatgtgaagagccatacacgggcaacaagacggagaacctttcgataatcagatcatccgcggctagcatggctagcgcaaagggagttgacgcctcaaacattcaagtaggttcatcatccaggagttcagcccgagacagattgaccacgccaaggagcttatcgaggaggagatcgagggtccatctcatgtgccaggtccggagcatggcccaggtggtccacagtgcaactagtctggtccaattgggggccctgtcacctccatggggaacccttacaaatcgaggggtccagccacgtgaggactttcgaaccgcactattagcgagtgcggagtgctcactccattccatcaagcaagattagcacgatctgaatggacatggttggcaagtatcacttgacagctggataaggtgagtcagagtccacgcacgcggttgacgtctcattgcaatgtgacctttcaagcgcgattagacctggttcttgacatggcttggacccacgtccgggtatcacacacccaataacgggctctgctgtttaggtgtcacacgcgcataatcatatacgtacaaagaactttaacgttagacaaagcgaggacgaccacggcggggccataaaattggcggtccacgcaaaaacgggattccttacgccttattgaaaaagggacagtcttggggaacaagtcctttcataagaggctaacaattagctggtttccccaattgtcaaatgcggccccaacagggcaacaccacccaggatagaccaagggccccaatcggggaccccatatgcatacggctggaggcgtatagaaacatggacaggggttaagcaacacacaggctcacgtcgcatgtgccaactcactgacattggaaacaggaaaccaacatcaccgactacccaacaagtcgacacaatataccaccagcttaaaaaacaacagggcactcaaagctggacatttatgagacaaacaagcacgcatggacgccaaacagcgcaacacagaggacaatgtacaacacaaagcacaaaacggaagagggaaacacc

SEQ ID NO: 560658 - DNA, 80 bp, Homo sapiens
gagtggggggcgggctcccgcggtcctgctcggcggagtggcctctctgctcctgtcttttgtttggatgccggcgctgc

SEQ ID NO: 560659 - DNA, 102 bp, Homo sapiens
tactatggtacatagaccccccccccaagatatagggcaactgatatttggacaaactgagcaaaggtaatacacgaaagacaacgatagtgtcttctaaca

SEQ ID NO: 560660 - DNA, 324 bp, Homo sapiens
tggtacttttagtaaagagggggctccaccgggccagccaggagggtctcgatctcccgacctcagcgatccacccacctcagcctcccagaagggcggggattacaggcatgagccatgggtgcctgtggccgaatgtgagtttcatttctataacacttatggaaagtgataaaattatagaaaaagagaatagattagtcatgtgtcagggttaggggggtggccagcgtggaggggtggcatgaggaatccaggtggtaagggaaacgttcacgtcacgtgtcagtatctgggtggtgacagcccactttcaggggtgag

SEQ ID NO: 560661 - DNA, 154 bp, Homo sapiens
gcgatatagtatacacgctcacaaacaggcgctaccttgaaaagtgcattgcttattgcagagagccatgatcaggcatttggttgggggataagtcgctggcatttaggtgatggatgccgaaatgtatcaacatgagtgtcctgacgtcttt

SEQ ID NO: 560662 - DNA, 763 bp, Homo sapiens
atagggatcgtccaacccgagaacatacaacctcctcttcagatgtcaaaaaagccacggttagaccagattcctgccgccaaccttgatgcagatgaccctctaacagatgaggaagatgaaattcagacagactactcaggatgtccctgaagaggttcgtaaccgggacttcaggagagagttggaagaaagagagagagctgctgcaagacgacgaaaaataggcgatcgtccaacccgagaacatacaactctcctcttcagtgtcaaaaaagatgacaactatgcagccgaggccaaccttgttgaaccgtgccagaggtggaaggggagaaggagaaggtgattggaggccaacgtgtcaaagcagtattcatagctagagacctaccctctcatgcaaagataacatacagacatgactactcaggatgcccctgtaagaggttcgtaaagccgtgacttgctggagagagtcggaagaaagagagagagctgactgcaagagagaaaaggtagggtatcggtccaaaccgagtaacatacaagctcctctttcagacagctctgggcgcagaggtttctgggagccaagagtggtacatggcgtctgtatgatcttcggagcctgctgcatcggacctcggcagtcataaaagatgacacagcagccaggcaactttgaacctgccagaggttgaagggacggcagagtggttgagccatttcaagcagtattcaagagagacctacctctata

SEQ ID NO: 560663 - DNA, 141 bp, Homo sapiens
tgactctagaggattttcaccaggcgcttgttggggaaatgcattgttagaaaattgcctgtgttctacctgtactgatggaggttggagttgctggtcctcttggagcccctgtgtccaagggaagaaaacaagcgcctg

SEQ ID NO: 560664 - DNA, 196 bp, Homo sapiens
cacgatacttctaggagccctgcgctctcgggacgcctgcgagtcggtctccgagtacgggggcggcgcgggcgggtacgtaggcctcttcctcctcctccttgatggggtatccatccatctcctccgaccacatatcttccatcacagcactcctcccagtagccgcccactcataaggggaccggtcccctgg

SEQ ID NO: 560665 - DNA, 293 bp, Homo sapiens
ccaatgggggggggggggggggggggggggggtttttttaacccggctttttttttttccccttcgttttgtttggggccccccccccctttttttttcccccctttgaaaccccgggggcggttccccccccgggttttttttttggcccggggggggggttctttttttctcccgggacacgtttttcccctttgggcttttttgggggccctttttaaccgttttttttcaaaaaaggggggggggccggggcgggttttcccgggttttttttccccccggggtcccga

SEQ ID NO: 560666 - DNA, 863 bp, Homo sapiens
  misc_feature (223)..(223): n is a, c, g, or t
  misc_feature (251)..(251): n is a, c, g, or t
  misc_feature (372)..(372): n is a, c, g, or t
gaccgctttccctctctgggcctaacccggatgaagtttaaccacgggcattttaaacgcttttcttgggcccaatgttaaaggtgggacctaacgagttctattcttggagcaccccggctattcctcccgcgggcctctttttgagggacattcgggcctccgacactcggggtcccttgtttataacccctcccgcccgccggatacacccgggcccttncccacggaaagggcggatgaccgacgtnttctcctccacatcttttggccacggcccccatcttgaagaatcctttgaaagagtacttcctccacgtgtaggctcctcctttccacatgaaaggttgaatgattatagctgcctgtganaacggcgctgggcccacattgccttctgggtggccccaccgactagagaacatggtggcatcttagcaggatggccattttacaggatgctgccctcgtactgcaaggttgcccggcgacagcagcttgccccctggtgtggggcccaatgctcacccacatgcgttctccacaatagccattgcaatcctcaagtgcctgcacagcaccagccaggggctacaccagccactcgcccccattgtggccccccggaatgtgaacttcaaggactgaggcccgacctggctctcgctggaggggcatcctgagactccttcctcatgctggccccgactggctgctggggacagcgcccctgagctgccaacaaaggtggaaaacagggctggaactgcctttctttgtgcaactccctaatgtgacaactttaatcccaataaggtgaaacctccttcaactactccaattcttagaaaaaagaaaaataa

SEQ ID NO: 560667 - DNA, 586 bp, Homo sapiens
tggaaatggagtttggctcttcttgcccaggctggattgcaatgggcgatcttggtcatgcaacctctgcctcccgggttaagtgattctcctgcctcagcctcccgagtatttggaattacaggcgcctgccaccatgcccggttaatttgcttttaataaaaacggggtttctccatgtgggtcaggtgggtctctaactcctgacctcaggtgatccatccgcctcagcctcccaaagttctgggataacaggcgtgagccaccacacttggccatagtgtgtcttactatatggtggataaatctgcatgtgtccctaaagaactcagaattactgttgatgcttcaaaagggtgtgtgtgcagtgtgtgtgtgtccagcaaatccaaaaattcctcccaggaaattcagaacgaccccgaggaggagtggggcaacaaaactcttctatctgctagagggcacaacaaaatctctcatgaaacgccaccgatgaacctccaaacatcgatgtgctccaccaggccggtccttagctttgatccaaagccccaaccttgacacttctctgcttgaacgcact

SEQ ID NO: 560668 - DNA, 234 bp, Homo sapiens
ctgactgagcatggcggttacgtgatcgtcccgtgtgccgcttgactctcattaccggcgatcggcgtctgagtgtgtcacgttgtgcgaccttggcgcgtcatggctggattgcgtgactcgttgtggcgagactcgcggctctcaccgtgatcctacgtcgtcgagaccgtcatgcgtgcactatccctgaatgaaatatctgtgcgcggaccatcgtagcagatgattgac

SEQ ID NO: 560669 - DNA, 288 bp, Homo sapiens
tcgaccggcgtccaagtatttagctgactcgcacactccacggaaggcgctatgacatgatctgctgcagtgctctgagcccctaggattcatcctttcttttcagccgtgaggtgtcctgagctggcattgtattatgcgaactcatcactagacattgtactacatgacacgtactacgttgtaacccacttccactatgtcctatcaataggagctgtatttgccatcataggaggcttcattcactgatttcccctatcctcaggcacccccctgaccaaagct

SEQ ID NO: 560670 - DNA, 872 bp, Homo sapiens
cacccacaggaagtcaactgcgaggagaagggaagaagacgacgactttatttaccaacgtgttagtctagggtcttcaagggaactttgtgcgatttgcctgttacccgcaatacaagatgtcaaattttaaaacgtgcccactaaaacatgtttcgcaacattggggggtttcacacaggtatctggtcccggccgttggccccgaaaatctggttaagagcacgcggaccaccatcgtgtaaaactcgttccccccctggaaaaatcaaaatggatgttttaaccaaacatacagactttttgtttcattgtgcatggcacaccccgtttatccacgccaatacaaaccgtcgttttcccctatgttctggcacttttcgtgcccacaatccactggtcgccccatgtcataaggaactcacaagagttgtcttgacccccccccaaaaaggcagtaattatttttttgccaaaccaaaaaacacacgcgcgtcaacacttctttgtgggcgacccacaaagaaaatgttcaccttggttcaactacccgcctctgatatttctgtccccgctagaaggtgccagtaacaggctaacactcttcaccctgtagtagcacccggcagtatttagacgagtgcctccacgaggtctacccgtgtgctgcggacaagcgacccaaaaagcaggtggtgtatgagggcctctccaccttgggaggaggaatgtgacaaaccctcggcttcaagatcaacatatgttttctccgaggaaaaatctttaggtaaaaattcaaggtgagataaaaaatgtcaatcatgttagggggttcttaaacccattaaagtaagccaccagcacaatagaca

SEQ ID NO: 560671 - DNA, 174 bp, Homo sapiens
gcctgagatgtgttctgtgcgcgcagatgacctcgtggtagaaccaccagatcatatggtccctctttgttagcatcttcaaggcgggcatcaggacaaatgagcagatcacggctacactgtactgggtcttttccagccaggactgcaacggtgaccttaatcccagctcgc

SEQ ID NO: 560672 - DNA, 630 bp, Homo sapiens
  misc_feature (9)..(9): n is a, c, g, or t
  misc_feature (61)..(61): n is a, c, g, or t
  misc_feature (70)..(70): n is a, c, g, or t
  misc_feature (98)..(98): n is a, c, g, or t
  misc_feature (107)..(110): n is a, c, g, or t
  misc_feature (150)..(151): n is a, c, g, or t
  misc_feature (155)..(155): n is a, c, g, or t
  misc_feature (161)..(161): n is a, c, g, or t
  misc_feature (165)..(165): n is a, c, g, or t
  misc_feature (184)..(185): n is a, c, g, or t
  misc_feature (187)..(187): n is a, c, g, or t
  misc_feature (192)..(193): n is a, c, g, or t
  misc_feature (196)..(196): n is a, c, g, or t
  misc_feature (205)..(206): n is a, c, g, or t
  misc_feature (209)..(209): n is a, c, g, or t
  misc_feature (213)..(214): n is a, c, g, or t
  misc_feature (216)..(217): n is a, c, g, or t
  misc_feature (220)..(220): n is a, c, g, or t
  misc_feature (222)..(223): n is a, c, g, or t
  misc_feature (228)..(228): n is a, c, g, or t
  misc_feature (231)..(235): n is a, c, g, or t
  misc_feature (238)..(238): n is a, c, g, or t
  misc_feature (240)..(240): n is a, c, g, or t
  misc_feature (246)..(246): n is a, c, g, or t
  misc_feature (250)..(250): n is a, c, g, or t
  misc_feature (312)..(312): n is a, c, g, or t
  misc_feature (345)..(345): n is a, c, g, or t
  misc_feature (405)..(405): n is a, c, g, or t
  misc_feature (414)..(414): n is a, c, g, or t
  misc_feature (447)..(447): n is a, c, g, or t
  misc_feature (486)..(486): n is a, c, g, or t
  misc_feature (568)..(568): n is a, c, g, or t
  misc_feature (572)..(572): n is a, c, g, or t
aattgtttnataaattatacttgatattcattgttgggtttctttaggtcattctgctgtnctctcagtntcccagtgtgttttgtgttttttacttntcagaggannnngtaagcgtcatagtgcgtccgaacataaaatcaccgtaannaaantagttntttnttttttacatataattggnntngtatnnaantagtatatnngangaanngnncangnnaaatntannnnntgntnatatcnaaanttactccgggtgctcccctttccgtgcatagcagagccattgttgatatgttatctactaangtggctgttaaaccgccgtggagagtgcctatngcattggtatgctcttcttctactttcatttcacaaatcactttcccaggagcagcaganacaagagtnatctttcccaaaactcttttaaaattgcgagcnttggtcatggcctttatcacctcccgcagagactgagtnatgctggtcatcgtggacggttttccagcctttgggctttgcgcaagaacgaacttcggaagagctggaaagtccagaagtnagtnaaagaaggacaaaaagggcgaagagcccgcatcccttcttcgcccctaggagcgcaag

SEQ ID NO: 560673 - DNA, 279 bp, Homo sapiens
agcgcaataccgcccattggtggaaaccatattccatgccttcagtaagaagccaaagttcatgggctgcttctcgtgtgaagccaagtgccttgagcatctttttttgtatatccatagcgatgattatggattgaccctgaacctaattcgtaccatttaagaccaatcgtaactttgtgcatgggcttggtgcggatcttcaccctcatcaagatagtgcaaatctgcctaatttggcattgtaaatggatggtgcgcggcaattccagcgatcaa

SEQ ID NO: 560674 - DNA, 408 bp, Homo sapiens
  misc_feature (91)..(91): n is a, c, g, or t
ccctgggggtgttcgcggggggccttgtcgctgcgctcggggctcccctttggccctctgtgtctccctttccgtggcgcctggtgctctncgtctcttgcttcccttgtcctccgtctcggcctgctcgtccttttctcgctgtgctggcttttctcggccttttgtgtccttttggccgccttgctgcttgttgcccctctgtggcccctgctctggcttgctcgttgcgtgtgggcctcttgtgcgcctggtgcggctggttgtcttcctccgtctggttcggctttccttgcctgtgtcgtcccctctctttggggtccctgttgccctgttgctcttgtgctcctgccgttgtccctttctcgcgcgcttgtctcctcgttccttctttccttcctttgggcc

SEQ ID NO: 560675 - DNA, 246 bp, Homo sapiens
attagatgcaccaaaaacaatttcaagtgactgtggggcattgtctttcgtgagaatgatcaagagtcctgatatgacttgttgttcatatcctaaacagtgaaaacttcatccaccaaatatttaggaatagagggagacagaaagatgtgttctgaaggtatcccatatgtagagtattggtcacatatacttaatgttggttttaacatatagttattcaataaacttccgcgtcaattctta

SEQ ID NO: 560676 - DNA, 464 bp, Homo sapiens
gcggcgttccttcccccgggtgtggggcagggccccttcagaaatgtgggtcttgtgacccacagtcagacaaggtaggtcagagaatttatggccagctccacgacagaaaggctgggggtggttagagtcccttgttagtcttatggcctgccttggggaaaaaataacaagagctgtgagagttttgagccaggaactgtagatgaaaaccagtatgtatgtataatatcacaattggatattatgcaagtggacttgtcagattttgtaggaaagccctcatgttcctaccaacaactgtttgccctgcagcgcagacctgctccctgtatcgtaatccctcctagcttcatctgctttccttacacagcacatggtgattaaataggtgtgcgactgcttgatcagtaacagtcttctgccagactgtgtcttccgtgagggtaacagagaccatgtct

SEQ ID NO: 560677 - DNA, 353 bp, Homo sapiens
accgaatgttgatcatagagggcatgcaggcaagcctatctaccaaatgtcgaagtggtgggcacgacgtcgctccagtgtgttccgctctatgttgatagcggcggcaacgaaggctccggaagacaaatcgcatgccgcccgactcgtgtgggacaactactacgccaaccatcagaagaaaggcacattcaagcacctgaaaggtggcggacatcttcatgggtggcgggaccacactagttggaaggctctcgcctcggtatgcagactggtcggcaacgacctcaatacgggtagcgtggttcggggtcaagcaagaactggcttgacgtacgatcctccggagatgt

SEQ ID NO: 560678 - DNA, 260 bp, Homo sapiens
  misc_feature (197)..(197): n is a, c, g, or t
ccggccctgccctccctccggtggacttcccctcacgcagacttaagctgaggtcgttggatctctggcggggtgcagaacttaagcccaggccacagtaccctattcacgctctgtgctttccaagggggcaatggcggcttcctctgttctactccacactgggcagaagatgcctctaattggtctgggtaccncggaggagtgagcctcggtcaggtaaaaccacctttaagtatgccctcagcgtgggctacccc

SEQ ID NO: 560679 - DNA, 155 bp, Homo sapiens
gactgtattcagatgagattgcatggggacacaggaccaaagcatatcggtcttccaggtttattcattgtgtgcagatgacagaatttccctctcttaatgctgaataatattccattgtatatatataccaccttttctttattcattcatct

SEQ ID NO: 560680 - DNA, 581 bp, Homo sapiens
ttcggcacgagtagacccccaaagttacataatttgctctttttcttttttgcaagatcctttctgttttgataagtcctgtcttatgacaccgagttagggacattttcggtatctggttttgtaagatgttgacccatactttctccaaaaagacgaaacagagagtagacaaaaagagcctgtaatctaagcgactgactagggataaaataacgattgtaccatcttatccgatcaatgatttctattgtattggaattgttccagaacttgtgctgctgtcgcggattttccgatgctactattagggtaaatgataaacgatataggattcaacgactacttggagaaggtggaatgtcctttgtgtatttggtacgactgtcaaagaattctctgattatagacaacggcatcgcaacaccagaattatacgcactaaagaagattatttgtcctagtgtggaaagtatatccaatggtatgcgagaaattgaaaattacaaacggtttcaaagtccttatgttataaaaagtatcgactcacaagtaatgcaggaaaaagatggatcaaaaac

SEQ ID NO: 560681 - DNA, 136 bp, Homo sapiens
  misc_feature (41)..(41): n is a, c, g, or t
atagtataagtgtgattctacgtacgatatagcgtattgantctttaaactaaaactttcttactcgccggaaaatccttggattcgagtatggatcagctgagaacactgaaacagctgatgacttgtgaaagtg

SEQ ID NO: 560682 - DNA, 891 bp, Homo sapiens
  misc_feature (53)..(53): n is a, c, g, or t
  misc_feature (105)..(105): n is a, c, g, or t
  misc_feature (110)..(110): n is a, c, g, or t
  misc_feature (136)..(136): n is a, c, g, or t
  misc_feature (138)..(138): n is a, c, g, or t
  misc_feature (147)..(147): n is a, c, g, or t
  misc_feature (154)..(154): n is a, c, g, or t
  misc_feature (159)..(159): n is a, c, g, or t
  misc_feature (174)..(174): n is a, c, g, or t
  misc_feature (184)..(184): n is a, c, g, or t
  misc_feature (210)..(210): n is a, c, g, or t
  misc_feature (286)..(286): n is a, c, g, or t
  misc_feature (293)..(293): n is a, c, g, or t
  misc_feature (301)..(301): n is a, c, g, or t
  misc_feature (306)..(306): n is a, c, g, or t
  misc_feature (310)..(310): n is a, c, g, or t
  misc_feature (317)..(317): n is a, c, g, or t
  misc_feature (325)..(326): n is a, c, g, or t
  misc_feature (356)..(356): n is a, c, g, or t
  misc_feature (371)..(371): n is a, c, g, or t
  misc_feature (374)..(374): n is a, c, g, or t
  misc_feature (385)..(385): n is a, c, g, or t
  misc_feature (397)..(397): n is a, c, g, or t
  misc_feature (415)..(415): n is a, c, g, or t
  misc_feature (419)..(419): n is a, c, g, or t
  misc_feature (438)..(438): n is a, c, g, or t
  misc_feature (470)..(470): n is a, c, g, or t
  misc_feature (485)..(485): n is a, c, g, or t
  misc_feature (490)..(490): n is a, c, g, or t
  misc_feature (505)..(505): n is a, c, g, or t
  misc_feature (508)..(508): n is a, c, g, or t
  misc_feature (516)..(516): n is a, c, g, or t
  misc_feature (526)..(526): n is a, c, g, or t
  misc_feature (549)..(549): n is a, c, g, or t
  misc_feature (597)..(598): n is a, c, g, or t
  misc_feature (600)..(600): n is a, c, g, or t
  misc_feature (623)..(623): n is a, c, g, or t
  misc_feature (649)..(649): n is a, c, g, or t
gcgggtcagcgtatctggttgcgctggttctcttggttaatgggccacttggnggtctggctggcggcaagaagactgtcaatcagttgttcagtgttccttccngaggngggatactccataaccttggattcanantaagaattnaaaaagncagtncctagaactcccacntcccgggtgncctgtggctccgtggtgtgatgccgntggagtgtgctgcagtcagagccagggtgctatcaggcggtgtgtttcactctcatctgaccgcctggcgcggcgncgcggcnggccaggnttgcntggngggtgtnctgttttnngggggtcagggcagcctctcttccagtggnaccctccatcctgcngtnggcacattggntccatccaaggntgggtgtgttcggttagntggnctcctgagagtcctagggncaccctgggaggggggatgggttgggggggcnaggggcggtgctgtnttggncagtgtcctcttctnagntgcgatcngtgtgctgtncgtgattgaaaaccttaaaagcngcctctgccaaagtcaacagcagggtctggggtctggcctccaaattnncngtaatttccttctaatgtccggngctgactgaaggataaaatgcatggnacgcgatgcttcccctctgctgcctctgggtctgcatgggtgcatttcccaagggcctcagggactcgattgaggaagactactgggatctccttctttctctgggtaattttcttgaccctgtcatagtgtacaggttttactatacatttccttcttccttcagtcaggcaggtgacaaagtggctcattctagctttttctaggttttctccatagtctcactcacgtggagactatgc

SEQ ID NO: 560683 - DNA, 538 bp, Homo sapiens
tgattacaggatccttaagaggacaagggaggggatggactgggtgatttcatggtggcccgggataggtgaggtcctgggcttgagtcaaggggatgtttctcgagcttggggtcacttctttcttgcaatcactatgcatgcctaccatagtgtctgaggacgtaggatctagccctggtatgaggccctaggtctgttagtatctggggaggaaggatctggtacaggtatgaggacctgggtctgtccatgtctgaggaggtgggattgggccatagggtggggctgcaagctgcaatcccttatagcctgtactgcctttatccctccagaaaagcaagcgtgtatctagtcgggggtggcctcttgggactacatggccctcttctcccttgggatctccagagccccccgagaggcttagcaggccctctcctagtcacatcatgtcccagaaagcttttccacaccggtccctgcttttttgtcgggaccaagatctaactcggttcccaaggctgcattgcagggcccc

SEQ ID NO: 560684 - DNA, 85 bp, Homo sapiens
gcggccgcctactactactactgctcgaattcaagcttctaacgatgtacggggacatgggaataaattaattttctcaatgtag

SEQ ID NO: 560685 - DNA, 183 bp, Homo sapiens
agtatccccttacaccccacgatcaccacaggtgccaggagggggttagttgtggcaataaaacatgattaaggatactagtataagagatcaggttcgtcctataattgttgtgtatggctatcattttgtttcgaggttattgcgattagtcatcgttgggtggtgatcgtggggttgtaa

SEQ ID NO: 560686 - DNA, 473 bp, Homo sapiens
aaggtaaagatctgtctttgtaaccagcgatcatttttacgaaatcaacatggggaactattaaatcagggataattttaaaagatataggggacatccaatgaaccttactacgacattttaaaccccaaatacagaaaatctgttgactatgaaaatacccaaaaaattgccaactattacaactgtcgaacaaaataatactcattacacacttaacccgtagccaaacttaaaagtgacccgagtctctggtcaccatttcctcacaacttcatcagtctcttacccaaatacatcttgccattaataatgtcttccatttagggctaaccgttgaatatattatccaccatcctactaccaacgggatgaaccactctacccaaatgtcctctccaaacacgagttctaatctgacaattgcgagacataaatatcacttgccaaatatctatcctatcataactcag

SEQ ID NO: 560687 - DNA, 467 bp, Homo sapiens
  misc_feature (396)..(396): n is a, c, g, or t
accgtctgtgaagataacaatcagctctcttcaacggcaaactacacctatgctgtcagggtgtctccgacgatttgaatttcctaaaggacacacatatggtgagttcccaagagataagctggcactgggcaatcccctgtgcagaaggttgctttgggcaagtggtcattgcctactccctggtaattgacgatagaccagcccatgtaggcggttaccgtggccgtgaagatcttgaaagatgatgccacagagaaagacctttctgatctggtttcacagatggagatcatgaagatgattgggaaacacaagaatatcataaatcttcttggagcctgcacacaggatgggcctctctatgtcatagttgagtatgcctctaaaagcaanctccgagaatacctccgagcccggaggccacccgagatggagtactcctatgacattaaccgtgttcctga

SEQ ID NO: 560688 - DNA, 436 bp, Homo sapiens
gccttaagcctctcatctgtgtgtgggagcttagtgtggattgccgttttgcaagtacccgatcatatagggattcttcctctgttccatttagcactttgtctggaggggaggatgtagcgcgtaagtatactcatctggggatcctttgtgccggttaggtaccatttgctctttatccacctccttctgaagttgtaatgccaataacctgtcctgtacttcttgttgatgtctctcaaacagtatatgctccaaatctatcagtacgcgcgtaaagtttatttctgtatcctctgtgatctggggaagattcgggggacacttttcttcttttcgcagaaaagcattgatccttgactgcttcaaaggaagattcttggttttctctttgggaaatctccttactgatcagtaggcacgactcttcattttc

SEQ ID NO: 560689 - DNA, 322 bp, Homo sapiens
aaaatttaattcttaaaaaggggccggcccacctttggttccggataaaattcctcccgccgggctttggggggaaaaaaaagattttgaaccccccctgggttggccggggacccccccccccccccccccccctttttccaaaaaggttaaaaccgggtttccgggctggttttaaccggttttttttttgggaaaaaattcccttttttgcccccagggttgaaaacccggttaacccccggccagggtttggttttttttcccttaacccatttttttttatggacggggcccaattaatttaaaaattaaaaaggga

SEQ ID NO: 560690 - DNA, 523 bp, Homo sapiens
accggggaagtggaccccaaggtgatcctgtagggggtgcaaaccccaccgctatggaccagtcaaataaaagccttcaggcccctcgaaaaaaaaaaaaacaaaacaacagaaaaaaccttctgtaggagcacgccacgagcctccgcaagaagcccctaacaaacacgtacgattaggaccagctggcacatgaaactgaaaagaacacagttgctccagcagacgggtccgactaagaagacaaagcgggaaacgaaaagagggggggggcaactacacaccgaattataataaaacacccgggtggagaaacacgaacgactggtctacagcaacacaagctccaccaaaggaaggagtggatgcgaacaactaaccagtgcgaaataaaacacaacgagaggggagctcagacacgaggatggacctgcaactctatcatgcatattccagccctgcacctcgaggtggacagatccgaagtactaacctctaacaccaacgcacatctacactctac

SEQ ID NO: 560691 - DNA, 709 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (590)..(590): n is a, c, g, or t
  misc_feature (592)..(592): n is a, c, g, or t
  misc_feature (598)..(599): n is a, c, g, or t
  misc_feature (606)..(607): n is a, c, g, or t
  misc_feature (609)..(609): n is a, c, g, or t
  misc_feature (613)..(613): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtctacgctggaatggaattgtccacggttggctactagtccacggttggctactagtccacggttggctactagtccacggttggctactagtccacggttggctactagtccacggttggctactagtccacggttggctactagtccacggttggctactagtccacggttggctactagtccacggttggctccacggttggctactagtccacggttggctgtgcntnccgctnncagtggnngnccanttgatggcttcagaaagctttgagtggacagaggcctggtcgctttctacgcacatcctgcatattttggagaagcctaccaaccgtgatggtgtg

SEQ ID NO: 560692 - DNA, 337 bp, Homo sapiens
gaggtaatcagaaactcaaaagaatacagccatttgtcccttacatacctaagaccgggaagccccctccccgctttgagtcttaccacctttgctttgagttgtcctgtctttccagaccgaaccaatgttcatcctacatatgttgattgatgtctcatgtctccctaaaatgtataaagccaaactgtgccctgaccaccttgggcatatgtcatcagaacctcctcaggctgtgtcaacgggcacgtatccacgaccgtgacaaaatacactttctaaattaactgagacctgtctcagaattgtgggttcacaattcagagttctgtctcct

SEQ ID NO: 560693 - DNA, 617 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtctacgctggaatggaattgtccacggttggctactagtccacggttggctactagtccacggttggctactagtccacggttggctactagtccacggttggctactagtccacggttggctactagtccacggttggctactagtccacggttggctactagtccacggttggctactagtccacggttggctacagtccacggttgctcaagctggtgtgcagtgacacaatcaccataacctcaaactgctga

SEQ ID NO: 560694 - DNA, 611 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtctacgctggaatggaattgtccacggttggctactagtccacggttggctactagtccacggttggctactagtccacggttggctactagtccacggttggctactagtccacggttggctactagtccacggttggctactagtccacggttggctactagtccacggttggctactagtccacggttggctaactccaccaggtaactagccaaccgcgactagtgggatcctcagagcaacgagag

SEQ ID NO: 560695 - DNA, 622 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (533)..(533): n is a, c, g, or t
  misc_feature (616)..(617): n is a, c, g, or t
  misc_feature (620)..(620): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtctacgctggaatggaattgagccaaccgtggactagtagccaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 560696 - DNA, 653 bp, Homo sapiens
cctccgagccaggtgcgtggatatattctcgtggtgcgccgttttttaagcccgtctggaaaggcgcagtatttgggtaggagtgacccgattttccaggtgccgtccgtcacccctttctttgactcagaaagggaactccctgaccccttgcgcttcccaagtgaggcaatgcctcgccctgcttcggctcgcgcatggtgctcgctcccactgacctgcgcccactgtctggcactccctagtgagatgaacccggtacctcagctggaaatgcagaaatcacccgtcttctgcgtcgctcacgctgggagctgtagaccggagctgtagacaggagctgttcctatacgggcatctcggctcctccttgaccaagcttgaaggtgagcacctcgaagggctacttatcatgtcgaaaggcacgggtttgcatggcggttcatcacaggtcaataccccagtctgcacgacagtccactgtggggcacggcaccgcgagacttcaacaagccctggcaacaccaaagaatggaaccaccctccgctgacttcgaccatctggcctggctgatgcggcctgactcccagacccataccgccgcttttgcagctgcccacactgcactacgctacaacgcattcaaccatgg

SEQ ID NO: 560697 - DNA, 331 bp, Homo sapiens
  misc_feature (12)..(12): n is a, c, g, or t
aaaggggggggncccccccccccccttcctggggtggggggggggggttttttttttttaacggttttttccccccccccccaaatttttggggggggttttttttttttggggtccggggggccgtttttttttttttttttttcccccccgcctttttttcccccgggggttttttgtcctgcttttttttgggtttttcttcagtaaatttgttgtgggtggtgtgattgataaaaataaaataataataaaaaaatatatgaaaagaaaaaaatttgaaaaaaaaaatttgaattatatgaataaattggtaatgtataaaaaaaaa

SEQ ID NO: 560698 - DNA, 580 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (345)..(345): n is a, c, g, or t
  misc_feature (374)..(374): n is a, c, g, or t
  misc_feature (491)..(491): n is a, c, g, or t
  misc_feature (574)..(575): n is a, c, g, or t
  misc_feature (578)..(578): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagcacggttggctactagtccacggttggctactagtccacggttggctactagtccacggttggctactagtccacggttggctactagtccacggttggctactagtctacgctggaatggaattgagccgaccgtggagccaaccntggactagtagccaaccctggactagtanagccaaccgtggactagtagccaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 560699 - DNA, 751 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (307)..(307): n is a, c, g, or t
  misc_feature (342)..(342): n is a, c, g, or t
  misc_feature (358)..(358): n is a, c, g, or t
  misc_feature (516)..(516): n is a, c, g, or t
  misc_feature (545)..(545): n is a, c, g, or t
  misc_feature (662)..(662): n is a, c, g, or t
  misc_feature (745)..(746): n is a, c, g, or t
  misc_feature (749)..(749): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctaggctntggtctcgaactcctgacctcaggtgatctgcccncctcggcctcctaaantgctgggattacaggcatgagccaccgtgcacggttggctactagtccacggttggctactagtccacggttggctactagtccacggttggctactagtccacggttggctactagtctacgctggaatggaattgagccgaccgtggagccaaccntggactagtagccaaccctggactagtanagccaaccgtggactagtagccaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 560700 - DNA, 144 bp, Homo sapiens
agcgggctaagggacaaagccccaggcgatgaggaggtggcttggacagctggtgctcacacacacacacacacacagcctgtctcccagagcctggcgcccaatctccactcggtcaaccccatccctccagctccgcgagcg

SEQ ID NO: 560701 - DNA, 354 bp, Homo sapiens
gctcgagcggtgtagcatacagccctgctacatggaatacagtgcgtacacttcgggatgcattaaccagtgctgcagtgaatccactgcattcagtgatgctgcatggaatgcactaccttcaatcgagatgctttgggccatgctgcataaaatccactgcatttaatcgggatgcattgggccacgctccatggaatcaactgcattcaatcaagctgcatggaatccactgcattcaatcgggatgcattttaccacgctgtatggggtatactgtattcaatcacgctgcatggaattcactgcattcaattcggatccattgtgccaaaatgcatggaatccactgag

SEQ ID NO: 560702 - DNA, 160 bp, Homo sapiens
cttaatagctagaagaacctccataatacctggatgttcttcatactattaggactcatcgcttcgaatgtaacggcgtgtcagagtcatgaaaatatattaatattactgctgtaagagaaatgaatgagcctagcagatgataggatgtttcatgtgg

SEQ ID NO: 560703 - DNA, 348 bp, Homo sapiens
atttttaaaagacagggtctcactctcttacccaggctagagtgcagtggtgtgatcatagttcatcataactttgaatctctgggcttaagcaatcctcccatgttagcttcccaagtagctaggactacagggttgtgctaccacgcctgtaatcccagcactttgggaggccgaggcgagcggatcacgaggtcaggagatcgagaccgcggtgaaaccccgtctctactaaaaatacgaaaaaaaaattagccgggcgcagtgcaggcgcctgtagtcccagctacttgggaggctgcggcaggagaatggtgtgaacctgggaggcggagcttgcagtgagcc

SEQ ID NO: 560704 - DNA, 589 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (354)..(354): n is a, c, g, or t
  misc_feature (383)..(383): n is a, c, g, or t
  misc_feature (500)..(500): n is a, c, g, or t
  misc_feature (583)..(584): n is a, c, g, or t
  misc_feature (587)..(587): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtcactagtccacggttggctactagtccacggttggctactagtccacggttggctactagtctacgctggaatggaattgagccgaccgtggagccaaccntggactagtagccaaccctggactagtanagccaaccgtggactagtagccaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 560705 - DNA, 654 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (419)..(419): n is a, c, g, or t
  misc_feature (448)..(448): n is a, c, g, or t
  misc_feature (565)..(565): n is a, c, g, or t
  misc_feature (648)..(649): n is a, c, g, or t
  misc_feature (652)..(652): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtctacgctggaatggaattgagccgaccgtggagccaaccntggactagtagccaaccctggactagtanagccaaccgtggactagtagccaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 560706 - DNA, 1762 bp, Homo sapiens
  misc_feature (921)..(921): n is a, c, g, or t
  misc_feature (977)..(977): n is a, c, g, or t
  misc_feature (1280)..(1280): n is a, c, g, or t
  misc_feature (1497)..(1497): n is a, c, g, or t
ttgtgtgtttatggtcgtgtgttacttgtagtgtatagtgttgtttcgtagttttgggcttttcgtattgtggtagtgattagtttagttttgtcgtgatagtttgttgttattagtacttcttagttgtgtgtttcgtctgtgtgtgtgtgttctcttgtgtttctgtgctgtgtttgctcgttacatcttgtgatagtacctcacattatcaccccttggggtgtcacccacccccgtgggtgggcactcccttttgacctctgggagggcccccccagaggtgtgccccaagaaacaccgcggtgttttgttttaacacgcccgcctccgttctttttacccggtgctctttataggtgtaccgcagcccctctggggtgggcgaaattattcctgggcctaccagagaggccctgtgtttcatcctcgccgcccctaattggctcccctccggcgatgtagcccctcctctcaaaggagtactcctgcgtctccgtggtgcttacatgagagacccccccggggtgtttggtcgccggccctacgaccccccccaacggctgttggagacaacacacggtggtttttccggtcgacaccacgagaaatatctgtggcccaacgtgtgtgggtggggaatttgctcggtgtttctcccggggacctcttgtggtaggaaccaacgcgggtgttttctccaccgccccacggggctcttcttcatcccatctctcatacatatggcccccacaacattggtggtgcgcgcgcaacatccacgaccgctcggtgtatattattcgccgcttgtgtaatggataccctccctcttctcctcgcttttatatgcgctctcatatccacgcatgtttttcgcggcgattgtaataagagatagagcgcccgccgcatgagagnctttatagtgtccgcacacgacactggcgggtgttcttatcgcgcccacgcgtgtnttcacacgccggagatgttattatactagagagatgtcacctgtatatctcgcgcgatatatctttatagagaaatatatatcctctctcttggtgtgctctgctcgcccgacagaccccacgagagtgttgtacacacacagagagcgccccctgcgtgtctacagagattatccttatcacatatagtgtttttttgggggagagacccaccacagagatctcgagagagagatgtttatatctccccgcgcaccgcgcccatcacgatacgcaccgcgctgccctgagagagaaatactntcacacacagtgttcacacagagggtgagaaagactctgtggtctctcacacacacacactctcacacagagaatacacacacaccacagagactcccacacacgcgcgacaccacagagaggagagagagtggagaagagaggagaagagaggtgtcgagtgtgagaacacacagcgtggtgatagagaagtgtaaagagagcacatatgagaatntgtggtcacatggtcacacacacagcacaacatgtggtcgaggagcgccacaaggcacactctcgaggcccctgtgaaggaccaccaccgtataatgagagatattggtaaatgcgagatttatgggaattacccacaggaaccacttatgggaagccacacatttttttggggtttccaagagggttaacccccccctgggttgtgaaattggaccggttttatccataaaaaaaattatggctttttgttggggaggaaaaat

SEQ ID NO: 560707 - DNA, 776 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (307)..(307): n is a, c, g, or t
  misc_feature (342)..(342): n is a, c, g, or t
  misc_feature (358)..(358): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctaggctntggtctcgaactcctgacctcaggtgatctgcccncctcggcctcctaaantgctgggattacaggcatgagccaccgtgcacggttggctactagtccacggttggctactagtccacggttggctactagtccacggttggctactagtccacggttggctactagtctacgctggaatggaattgtccacggttggctactagtccacggttggctactagtccacggttggctactagtccacggttggctactagtccacggttggctactagtccacggttggctactagtccacggttggctactagtccacggttggctactagtccacggttggctactagtccacggttggctagtcaagtcgcaagcagtgggagtggagaaggaacaaagcaatctgtacctggttcgcgatcattagttgtaacaccactgcactcggaccagccacccgtggact

SEQ ID NO: 560708 - DNA, 670 bp, Homo sapiens
  misc_feature (270)..(270): n is a, c, g, or t
ggccggtaccttcaacatctcattccgtcagagaaatgcaatcaaaaccacaatgagataccatctcaccccagttagaatggcaatcattaaaaagtcaggaaacaacaggtgctggagaggatgtggagaaataggaacacttttacactgtgggtgggactgtaaactagttcaaccattgtggaagtcagtgtggcaattcctcagggatctagaactagaaataccatttgacccagccatcccattactgggtatctacccaanggtctataaatcatgctgctataaagacacatgcacacgtatgtttattgaggcactattcacaatagcaaagacttggaatcaacccaaatgtccaacaatgatagactggattaagaaaatgtggcacatatacaccatggaatagtatgcagccataaaaacatgaaaaaatgctcaccatcactggccatcagagaaatgcaaatcaaaaccacaatgagataccatctcacctacagaatggcactctcccaccagagccttatgagatgctccatgctaaatgcatggcatagagtaagcatgccagcagtccagaccgttattcccagcatgcgtgctcacagtagatgctctccatcctcaggaggagatacaaagatggccatgagatggg

SEQ ID NO: 560709 - DNA, 769 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctcatgcctgtaatcccagcacactgggaggcttagatgggaggattgtttgagcccatgagtttgagaccagcctgggcaacatggccaaatcctatccttaccaaaaaaaaatttattttaattagctgggtatgttggtatgcatctgtggtcccagctactcaggaggctgaggcaagagggtcagttgagcctgagtggtgatgctgcaggcagccatgctcatgccactgcactccaggcaataagacaagaaaaggaaataaaagatataaagattgggaaggaataaataaaagcttctttgttaaccaatggcatggttgtctatgtagaaaatccacaagaattgacccaaaagaactcttggaactaataagtggttagagagagaatgcaggaaattttaaaagtcaattgttttcttacatatcatcactgcatagtagagccaaccgtggactagt

SEQ ID NO: 560710 - DNA, 165 bp, Homo sapiens
caatttaaatttagaattaaaagtaaatggtataagaaaaatattttttcagtcccagtagccccatttcagggcttgctagttacatgggtttgtgtttaatggccagtactccagtgactatcatataattggggcccaataaataaaacttaatgaatccga

SEQ ID NO: 560711 - DNA, 263 bp, Homo sapiens
tgcctcaaaaaaaaaaaaaaaaagataattgatcgcaatcttaattgtgggcttcattcctgctctgctctttgtccaaacagatttttctgaatgtcaggggtgaagttcaagttctagcacccagtgagcattctgccttcccctgctgcagggcttgatgtatcggctcatcttcccctagtgatgccagccataccctgttccccttacccttcctaccagtgtttctcttggtgcgaggtagctcctgaatggatgca

SEQ ID NO: 560712 - DNA, 823 bp, Homo sapiens
  misc_feature (630)..(630): n is a, c, g, or t
  misc_feature (782)..(782): n is a, c, g, or t
  misc_feature (819)..(819): n is a, c, g, or t
attgctggttcaaatggtagttctgttttaacttctttgagaaatctccaaactgctttcacagtggctgaactaatttgcatttccatcagtgtaggcgcattctacactgcactggcttctacagtgttgaagcattccgtttttcccacagcctcaccagcatctgttatttttttgactttttgataatagccattctgactggtgtgagattgtaactcattgtggttttgatttgcatttatctgattagtaatgttgagcattttttcatgtttgttaaccgcttgtatgttgtcttttgagaagtgtctgttcaagtcttttggcatttttttaatgggtttttgtttgtgtgtgtgtatttttgtttttgtttttgttttgagatggagtttcactgttgtcacccaggctagagtgcaatggcaccatctcagctcactgcaacctccacctcccgggttcaagcgattctcctgccccagcctcctgagttgctgggattacaggtgcctgccaccaagcgtggctaattttggtacttttagtagagacagggtttcaccatgttggccagcctggtctcgaattcctgacctcaggtgatccacccatctcagcctnccaaagtgctgggattacaggagtgagccaccacacctggcccgagttacttggttttcgtttctgaattggtttaattccttatagattttggacattagacctttttcagatgcccagtttgggaatatctctccatctgtaggtgctgntactggattgaagtccttttgcgggcaaaactcttanttga

SEQ ID NO: 560713 - DNA, 209 bp, Homo sapiens
ccccctgctgaaggcttttacgtgttatgcctaatctcagctgggctctatattgtccaactacactcgctcaggaagccctctgttttgaaaactggtgtgtgcgttttttatgacagacttgctacccctaccccatgggagaggaaagagggctcatgacccgaagggctagccaaatattgtgggtgcataaaggtggtctgcca

SEQ ID NO: 560714 - DNA, 842 bp, Homo sapiens
  misc_feature (369)..(369): n is a, c, g, or t
  misc_feature (393)..(394): n is a, c, g, or t
  misc_feature (412)..(412): n is a, c, g, or t
  misc_feature (416)..(417): n is a, c, g, or t
  misc_feature (426)..(426): n is a, c, g, or t
  misc_feature (429)..(430): n is a, c, g, or t
  misc_feature (448)..(448): n is a, c, g, or t
  misc_feature (468)..(468): n is a, c, g, or t
  misc_feature (470)..(472): n is a, c, g, or t
  misc_feature (482)..(482): n is a, c, g, or t
  misc_feature (508)..(508): n is a, c, g, or t
  misc_feature (510)..(510): n is a, c, g, or t
  misc_feature (531)..(531): n is a, c, g, or t
  misc_feature (534)..(535): n is a, c, g, or t
  misc_feature (558)..(558): n is a, c, g, or t
  misc_feature (563)..(563): n is a, c, g, or t
  misc_feature (570)..(570): n is a, c, g, or t
  misc_feature (585)..(585): n is a, c, g, or t
  misc_feature (589)..(589): n is a, c, g, or t
ggatctgtggctggaagcgaggaggctccacacgggcgttgcagctaccgcagccaggatctgggcatcaggcacggcatgacccctccgaggctcttctgggtgtggctgctggttgcaggaacccaaggcgtgaaccgatgggttaacattgcgggtggcggttgggggcgggccaaccaaacccaagggcccggggttggggttctttcttactggagggccaggtggggcacctgttggtgttgacaatgctggttgggaccctggaccttgattgcccagggtccggtcttgccggtgcccctgggggcctttcgaggaaacgcccacccagggccttctggggcgggaggcttgccctttcgnggccaggatcaggccccatcatgnntggacgaggtccagtgcncggnnaaccgaggnctnnactggccgactgcaagtncctgggctggctgaagagcnannntgcaggcacngagagagacgctggtgtggtctgcangnaatgataacaggagcaccaanccnntggacctctccagggagctctcngaggnccttggncagatctttgacagncagnggggcttggactgtccatcagcgtgaatgtgcagggcgaggacgccctgggcttctgtggggcacacggtcatcctgactgcaacctggaggcccaggccctgttgggaaggagccgggcagcagtgtcccactgagtgtggatgctgagtgtgtgcccatgggtcggggccttctcaggtaccttctactccccggagggatttgcttctccctgtttgtcgtcattgttccccaagctggctctggccatt

SEQ ID NO: 560715 - DNA, 194 bp, Homo sapiens
cgacgtgttccccccagcgcagccagcaggactggggggatactggcagttgaccttgacctgggtttcactttttcttttgtaatatgatcgtggttgccgtggagttttaatggcttctgataattctgtgcattattttcgggacgtgtccaaaagaaggctggtgtgggtggtttcagagaccatagcca

SEQ ID NO: 560716 - DNA, 809 bp, Homo sapiens
  misc_feature (336)..(336): n is a, c, g, or t
  misc_feature (360)..(361): n is a, c, g, or t
  misc_feature (379)..(379): n is a, c, g, or t
  misc_feature (383)..(384): n is a, c, g, or t
  misc_feature (393)..(393): n is a, c, g, or t
  misc_feature (396)..(397): n is a, c, g, or t
  misc_feature (415)..(415): n is a, c, g, or t
  misc_feature (435)..(435): n is a, c, g, or t
  misc_feature (437)..(439): n is a, c, g, or t
  misc_feature (449)..(449): n is a, c, g, or t
  misc_feature (475)..(475): n is a, c, g, or t
  misc_feature (477)..(477): n is a, c, g, or t
  misc_feature (498)..(498): n is a, c, g, or t
  misc_feature (501)..(502): n is a, c, g, or t
  misc_feature (525)..(525): n is a, c, g, or t
  misc_feature (530)..(530): n is a, c, g, or t
  misc_feature (537)..(537): n is a, c, g, or t
  misc_feature (552)..(552): n is a, c, g, or t
  misc_feature (556)..(556): n is a, c, g, or t
ggatctgtggctggaagcgaggaggctccacacgggcgttgcagctaccgcagccaggatctgggcatcaggcacggcatgacccctccgaggctcttctgggtgtggctgctggttgcaggaacccaaggcgtgaagatgtatggtgacatggcggctggtcgcatgggggcgccaactagaccagggatcgcgtggtagatcttctacgagaaggccagtggggcactgtgtgtgataacctgtggtgacctgactgatgccagggtcgctctgcacgggccctgggcttcgagaagtgctcgaccagggtctgggcaatgagcatgccttcgnggccaggatcaggccccatcatgnntggacgaggtccagtgcncggnnaaccgaggnctnnactggccgactgcaagtncctgggctggctgaagagcnannntgcaggcacngagagagacgctggtgtggtctgcangnaatgataacaggagcaccaanccnntggacctctccagggagctctcngaggnccttggncagatctttgacagncagnggggcttggactgtccatcagcgtgaatgtgcagggcgaggacgccctgggcttctgtggggcacacggtcatcctgactgcaacctggaggcccaggccctgttgggaaggagccgggcagcagtgtcccactgagtgtggatgctgagtgtgtgcccatgggtcggggccttctcaggtaccttctactccccggagggatttgcttctccctgtttgtcgtcattgttccccaagctggctctggccatt

SEQ ID NO: 560717 - DNA, 162 bp, Homo sapiens
  misc_feature (151)..(151): n is a, c, g, or t
ccctctttgctgatcttctgccccatcctgttggtttctatgttgggccctgtgttctggctccccacagtaggggggcatgcttctgtttgcccatctgtgagctgggggcatggtccctggctcctcggctagcctgcacacctggggncactgcaggtt

SEQ ID NO: 560718 - DNA, 264 bp, Homo sapiens
ctctagaggacccccgatttattcaacgtggtaaacggggaaagccacgtgtcaggaaccaccacgctcacggactgcctgcgacgattcaccagaccagagcacttggcagcagcgccaagtatcaagctgcagcggcttgccatatgctaccagtgagtccactacagcagctcactatgaagagaactgcccactcgtagcctgattttcatctcgctacgaatttgaacatctctgccatagcttgcgcgcggaaggatc

SEQ ID NO: 560719 - DNA, 242 bp, Homo sapiens
caacgatggtcctcagtacttgtgaggctgaggcaagagaatcacttgaaccctggaggcggaggttgcagtagccaaggccacgacattgcactccagccagggcaacaagagcaaaactcagtatcaaaaaacaacaacaagaacaaaaacatattgcaaactcagctcccttctgttgtaattccacccccatcatgttgacacagttatccacagaagggagctgaggaccatcgttg

SEQ ID NO: 560720 - DNA, 263 bp, Homo sapiens
  misc_feature (33)..(33): n is a, c, g, or t
cccttccctcggctcccagccctacagacttgntgtgtgacctcaggccagtgtgccgacctctttgggcctcagtttttccagctatgaaaacagctatctcccaaagttgtgtgaagcagaaaagaaaagctggaggaaggccgtgggccaatgggaaagctcttgtttttattaatattgttgccgctgttggggtgttgttattaattaatattcatattattttttttatacttacataaaaattttgttccagtgga

SEQ ID NO: 560721 - DNA, 159 bp, Homo sapiens
tcttcctatgaaatctgggaggaagctaccctcatcttttgcattctgcatctctgaaaaacctatcgttgtgtggatgattgctgccagcttgaggagtagctgtgtatccatagatcatggcttcagggaactctgagagcgttgaagaatcactgg

SEQ ID NO: 560722 - DNA, 216 bp, Homo sapiens
cactgttgttatctcagataatcatttcttatccgaagtagtttttccacactatcttacaacattaaggacaaagaaaaaatattgctgagaatatatagactttttaaagttcagtgtttaaactccttatggaaaagaacatgagatattacttttccactttctatttcctgttcgggacttggaaaacccctggcgcctggggtatcgagc

SEQ ID NO: 560723 - DNA, 429 bp, Homo sapiens
ctccccagtcatatcaaaagtactcttcaatatttatacgatccatgtttatagcaacacttttctcaaatagctaagatgtagaacagacccatgtccatcagcggatgaatgaataggccaaatgtggtatatccatacaagagattaccattcagccttgaaaagaaggaaattctacaatatgctacaacattgaagaacccacgcacattgtactagatgaaactaagccagtcacgaaaaggcaaacactatgattccttttatatgaggtacttggtcaaagtcatagagacaaaaagtagaatggtggttaccaggggctgcggagggaggaatgcggaattattgtttaatgggtatacaatttcagttttacaagatgaaaagagttatgaggatggataatagtaatggttggacaac

SEQ ID NO: 560724 - DNA, 589 bp, Homo sapiens
ataccagagtggtacgttgtcacacatgatgaacctctatgacacattatcatccaaagtccatagtttagattggagttcactgcttggtgttgtacattctatgggtatgtgatacaaatgtgataatgacatctatctatgttatagtgtcacgacagaacatagtttgcactgccctaaaaatcgtctgttctctgcctattcatctctttcacttccccgactccaacccctaataaccactgatctttgtactatctccacagtttagcctttcctagaatgccacatagttggaatcatacagattggcttctttcagttagtaatatgcatttaaggttcttccatgttttttcatggcttgatagctcatttctttttagtgctgaataattttccattgtctgaatgtaccacagtttatttatccattcatctactgaagaacatcttgttgcttctgagttctgggcaattatgaataaagctgctataataaatatcagtgtgcaggttttgtgtggacatgagttctcccttcatttgggtaaataccaaagaatgtgatcggattgtacggtaa

SEQ ID NO: 560725 - DNA, 316 bp, Homo sapiens
gctaagcgtgactgactctcttatttaccaccgctacagactccaactccttcagttttggaactcggatgggctttctttgctccacaacctgtagatggcctattgcggaaccttgttattgtgatgaggtctggtttagcagagatacggttcctataaagtagagtgaaaaagaagaaaggatttggaagctgaaagacaacaagttaaaaattgatggagtttgtacatcttgctgcttttttattggtttactttttttacaaagtcgataaagacaacataataaaataaacaagacaataaacaacga

SEQ ID NO: 560726 - DNA, 95 bp, Homo sapiens
tactcaacttcttttttttattataaaaggtacacttcgtgttttatattttaaacaacaaagaaaaaagcattcttacacactttaaaaaaaaa

SEQ ID NO: 560727 - DNA, 200 bp, Homo sapiens
ggtcgcccagcttccggcgctgacgggtgtggaccgcggacgtcgctgggacaaccccttcccgctgctcggcggcggcaacttggccgggccgttcttcggttgtggtttggcctccgcctcttggacttgggcttggggttataatgagcgcatacttcatatccagtgtcccggcgagagagcgcgttgggttatat

SEQ ID NO: 560728 - DNA, 735 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (307)..(307): n is a, c, g, or t
  misc_feature (342)..(342): n is a, c, g, or t
  misc_feature (358)..(358): n is a, c, g, or t
  misc_feature (494)..(494): n is a, c, g, or t
  misc_feature (526)..(526): n is a, c, g, or t
  misc_feature (611)..(611): n is a, c, g, or t
  misc_feature (620)..(620): n is a, c, g, or t
  misc_feature (631)..(631): n is a, c, g, or t
  misc_feature (634)..(636): n is a, c, g, or t
  misc_feature (638)..(639): n is a, c, g, or t
  misc_feature (644)..(644): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctaggctntggtctcgaactcctgacctcaggtgatctgcccncctcggcctcctaaantgctgggattacaggcatgagccaccgtgcccagccttattttttttttcttttttcttgagacagggtctcactttgtcacccaggctgcagtgcagtggagtggtcgtggctgcactgcagcctccacctcccnggctcaagcgattctcctgcctcagcctcccnagtagctggaattacaggcacatgccaccacgcctggctaatttttgtatttttagtggagacggggtttcaccatgttggccangctggtctngaactcctganctnnngnnatccncatgcctaagcttcccaaaatgctgggattacaggcatgagccactgtgcccagtcagtctgtagtgtttttacatctgatcttcacacag

SEQ ID NO: 560729 - DNA, 543 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (454)..(454): n is a, c, g, or t
  misc_feature (537)..(538): n is a, c, g, or t
  misc_feature (541)..(541): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctagccaaccgtggactagtagccaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 560730 - DNA, 553 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (464)..(464): n is a, c, g, or t
  misc_feature (547)..(548): n is a, c, g, or t
  misc_feature (551)..(551): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctgggggtcctttcccacttactactctatgacttcagacaaactacacatctctctgtttcagcctagcaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 560731 - DNA, 474 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtcactagtccacggttggctactagtccacggttggctactagtccacggttggctactagtctacgctggaatggaattgcaacggttgtgatactagctgcacagttccaatactagacgacggcaggtagattgtacacgattgccaactacttcacggttcacgattagttcatcggttagctactaggacacgtttgacaatctagtacacagcttg

SEQ ID NO: 560732 - DNA, 583 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (464)..(464): n is a, c, g, or t
  misc_feature (466)..(466): n is a, c, g, or t
  misc_feature (472)..(473): n is a, c, g, or t
  misc_feature (480)..(481): n is a, c, g, or t
  misc_feature (483)..(483): n is a, c, g, or t
  misc_feature (487)..(487): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtctccacggttggctactagtccacggttggctactagtccacggttggctactagtccacggttggctactagtccacggttggctactagtccacggttggctactagtccacggttggctactagtccacggttggctactagtccacggttggctactagtccacggttggctccacggttggctactagtccacggttggctgtgcntnccgctnncagtggnngnccanttgatggcttcagaaagctttgagtggacagaggcctggtcgctttctacgcacatcctgcatattttggagaagcctaccaaccgtgatggtgtg

SEQ ID NO: 560733 - DNA, 533 bp, Homo sapiens
  misc_feature (110)..(110): n is a, c, g, or t
  misc_feature (114)..(116): n is a, c, g, or t
  misc_feature (118)..(118): n is a, c, g, or t
  misc_feature (122)..(122): n is a, c, g, or t
  misc_feature (130)..(130): n is a, c, g, or t
  misc_feature (135)..(137): n is a, c, g, or t
  misc_feature (141)..(142): n is a, c, g, or t
  misc_feature (145)..(145): n is a, c, g, or t
  misc_feature (147)..(147): n is a, c, g, or t
  misc_feature (150)..(150): n is a, c, g, or t
  misc_feature (414)..(414): n is a, c, g, or t
  misc_feature (416)..(416): n is a, c, g, or t
  misc_feature (422)..(423): n is a, c, g, or t
  misc_feature (430)..(431): n is a, c, g, or t
  misc_feature (433)..(433): n is a, c, g, or t
  misc_feature (437)..(437): n is a, c, g, or t
ctgttccttgtgtgtcccccggttggctactagtcacggttggctctagtccacggttgtctactattccacggttggctactagtccacggttggctactagttccacngttnnntnctgncacggttngctcnnntccnnggntngcnactagtccacggttgtcgtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctccacggttggctactagtccacggttggctgtgcntnccgctnncagtggnngnccanttgatggcttcagaaagctttgagtggacagaggcctggtcgctttctacgcacatcctgcatattttggagaagcctaccaaccgtgatggtgtg

SEQ ID NO: 560734 - DNA, 413 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtcactagtccacggttggctactagtccacggttggctactagtccacggttggctactagtctacgctggaatggaattgcacggcttggctatttctccagcattcatctcccatcatgctcccatgtgcttcttgtgctccggctaataaaaactgct

SEQ ID NO: 560735 - DNA, 411 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtcactagtccacggttggctactagtccacggttggctactagtccacggttggctactagtctacgctggaatggaattggttggctgatgacacaggagctctggctgtgcggccatgaaaccctgtctttggaccaacagccaaccgtggactagt

SEQ ID NO: 560736 - DNA, 477 bp, Homo sapiens
  misc_feature (14)..(14): n is a, c, g, or t
  misc_feature (42)..(42): n is a, c, g, or t
  misc_feature (158)..(158): n is a, c, g, or t
  misc_feature (433)..(433): n is a, c, g, or t
  misc_feature (458)..(458): n is a, c, g, or t
tacgctgcaaggantagagtttggctcaggctgggggcagcngggagggcaaccgcttccattaccggccgggagccttgggaagtaggacctggaactgagtgtctgtcaatcatggatcaggacgacccagccgaagcgttgactgagctacgcangaagcgctgggcttgctggagatagtgcaagcggcggcaggctcgggattggccgtctatactatatgggcgctgctgctgcaccgggcttccgccgggtgcctctgaggctgcaggtgccctacgttggcgcgagtgcccggcaggttgagaacgtgctgtcactgttgcgaggccgccctggaaaaatggtggatctaggctctggtgatggcaggatcgtgctggcggcccaccaatgtggtctccgtccagctatgggatatgagctgaanccgtgcttgttggacttgcacgctncatgctggagagccggttg

SEQ ID NO: 560737 - DNA, 366 bp, Homo sapiens
  misc_feature (163)..(163): n is a, c, g, or t
  misc_feature (269)..(269): n is a, c, g, or t
  misc_feature (292)..(292): n is a, c, g, or t
  misc_feature (311)..(311): n is a, c, g, or t
gataggtcgggtcggcggtgtcaccgctttcgcttctgcttgagggcataaggaaatggtggcaggcacttcctcctaacaagaagaaaaaaaaaaaaaaaaaaaaaaaaaagcggccgctcgaattgtcgaccggccgcgaattcgcgccgcgttcgactanggctgcgagaagacgacagaaggggctttttccaagcggctgccgaaatggcggaggtgcaagtcctggtgcttgatggtcgaggccattcctgggccgcctgggngccattcgtggctaaacagtatnctggggcccgaaagtggtngtctacgctgtgaaggcatcaacattctggcaattctacagcaattggtcctggg

SEQ ID NO: 560738 - DNA, 518 bp, Homo sapiens
  misc_feature (399)..(399): n is a, c, g, or t
  misc_feature (401)..(401): n is a, c, g, or t
  misc_feature (407)..(408): n is a, c, g, or t
  misc_feature (415)..(416): n is a, c, g, or t
  misc_feature (418)..(418): n is a, c, g, or t
  misc_feature (422)..(422): n is a, c, g, or t
agatcgagctgttacgtccacggttggctactagtccacggttggctcccagtgaggtaagagtgtatatggtatgggaaggcaaactcagtgtttgaagacctttcagtcaccttgcgccagccaaccgactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctccacggttggctactagtccacggttggctgtgcntnccgctnncagtggnngnccanttgatggcttcagaaagctttgagtggacagaggcctggtcgctttctacgcacatcctgcatattttggagaagcctaccaaccgtgatggtgtg

SEQ ID NO: 560739 - DNA, 93 bp, Homo sapiens
agttccgggatccccacttagaggtggaaggggaaggatcgcttcagccggggaattcaaccagccgggggaacatcatagagactccccctc

SEQ ID NO: 560740 - DNA, 160 bp, Homo sapiens
  misc_feature (89)..(89): n is a, c, g, or t
  misc_feature (121)..(121): n is a, c, g, or t
  misc_feature (148)..(148): n is a, c, g, or t
caggctggatgagggccctgaagctgtcctttgggcaggggtgcaggcaggggaccaacagagcgccaagtataaagctggttggggtngggcttaaggatgggaggagtggacttaggangtagaagagtgctttgggtgtaggccnagggaaggttcc

SEQ ID NO: 560741 - DNA, 352 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (302)..(302): n is a, c, g, or t
  misc_feature (341)..(341): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctngactacgaccagtacgcgctgctgtacagccaactgganctagtagccaa

SEQ ID NO: 560742 - DNA, 107 bp, Homo sapiens
ccgaattctttacaatactctggggcttctgtggcaagccccaccctttctggtcatggtacccgttacagcgttgatggccgcacaggggacacgaaagccgggga

SEQ ID NO: 560743 - DNA, 158 bp, Homo sapiens
cagcatgctctattaaatcttttgcagaagactgcatgattagccaaaagtgactttttttttatttttggaatagggtgtctccctgtgtggccagggtggggtttatagggggggattcttctaaagagtggccgtgcggtattgaaggttggaaa

SEQ ID NO: 560744 - DNA, 173 bp, Homo sapiens
  misc_feature (15)..(15): n is a, c, g, or t
  misc_feature (68)..(68): n is a, c, g, or t
  misc_feature (143)..(143): n is a, c, g, or t
gctgttttatcagcnacgcaccaggagaacaacatgcgcatctcatgaacgtcgaatccgcacgagcncttcaacacctacgtcgcgatggctccatcgccgagttgatcccgcgtgtgatggcggcgatcaaacccgaagcngcttacttcacggaacaagctggtacacgc

SEQ ID NO: 560745 - DNA, 710 bp, Homo sapiens
agcggttaccggtggggccgggccgggcgggagtgccaggtgacgtgatgggcgcaagggccgggacatggggcccgccagacccgctgctcgcaggtctaagtcagccgcaccgggccagccgccgctgccgctgctgctgctcacatatttgactgcttgacttctgcagcgtctgctagcccgcgcgatcggcgagccgtgagccgtgttgggagcacacctggtcagctgtgccgagggcctccgtgtggtcaggaccactagtggtgtgacttggtacttatttcgcgggcggcgctaacgcgctttcatcccggcgactcttgctgcactcggtgcctgtcgttggggaatccacgagcgcccacagtctgcatctcgaacgactagttctccacagagtgatccctgacagcctgcagttgtcttggaagatagcttgcaatgagtcagaattgttagcccctggaatgctagcacagaatttgccatcggttgttgagatgccatggactaaacgtcacgagccaattctcgccaatgggagccgactggattgcggggggttacccgagagcgggcaggcatgtcggcacacagccctcaaccatgcaggttgtgcccttccgtctgtgctgtcctgtgtgaatttcgctgagtgaggcctctgtctggtgcctgaaggctgccgtgttcttggcatccag

SEQ ID NO: 560746 - DNA, 252 bp, Homo sapiens
tgtccatcccccttcactctcattaccacacaaccttgccacatatcctacctgctcatcttctgaattcaaattcctgcccacatcctgctcctccataaataccccccacactatattcctacattcctttttattccttctttttcatccttcttctgatccagcctcactcttgcacccctgctctcccactctatgactatctctactcacttctccctctctctcctggtctcaaacaattctcat

SEQ ID NO: 560747 - DNA, 349 bp, Homo sapiens
gtttgagatatggactgttctgtcgctgaggcttatacccctctttgtgtgtacatgtggagttacccagaaataagaacatatgggttcttaaaaagtagcattccaacacaccaactttgatgcccacttccttcttcgatgctcaactttggcctcagctataggagaaccgagaacagtgactattccaagactacctgacttccttcttggtacattctaattcttctcaacagcaccactgagtaacaaggacgctgtctaaggtaagtaagggtcctcaatttcccccaaggttactagcacatgcattattattaacaccatgaatgggaggatgaccggt

SEQ ID NO: 560748 - DNA, 583 bp, Homo sapiens
taggaagactcggctctaccttgttctcaactgcaaagaggcgtccctatcctctatactaatcctcctcagcacagaccctttacgagtgtcgggctgagtgccatatctcaggctatcacatggggagaaaccttggacaatacctggctttcctaggcagaggaccctgcggccttccgcagtgtatgtgtcccatgggtacttgagattagggagtggtgatgactcttaacgagcctgctgccttcaagcatctgtttaacaaagcacatcttgcacctgcccttaatccatttaaccctgagtggacacagcacatgtttcagagagcgcagggttgggggtacggtcatagatcaacagcatcccaaggcagacgaatttttcttagtaacagaacaaaatggagtctcctatgtctacttctttccacacagacacatgttaacaatctgatctctctttcttttccccacgattccgcccttttctatactacaaatccaccattgtcatcatggcccgtactcagtgagctgttgggtacactcacagacggggtggcggacgggagaggggc

SEQ ID NO: 560749 - DNA, 1053 bp, Homo sapiens
ttgggtaacccctgtgatacaaaccttgttgttgaagtctttcttgaatgcgccaagtgctgggccccacaggaggagaaaaagttgtatttgggtcccaccgggcgacacgggcgtttctttgtaaacaccaccgggattgggtactatttttttctgcccacacctaggtgtgttcaaaaaacatttggagggggtcctccatgtgtgttgtgtgagtgccccctgtctgtgtttaaaatttttacccctttgctggttggaaggacccccaaacggggggagactctccttgcgtaaaaagagcggtttgggggggccccccccccgccccctctctttagggcgaaaatctcgtttttacgggagactttcccccacactctctcttttgagacttcgcagatatataaagggcgccctctttgggggttctccacactaaactttgagcccacatgttttcccacaccccctcctgtgaggaaaacgctttcccccacacaccttgtgtgcaagcacatagaataccactgtttatgcacgcgcactcacggtattcacacacacccaatatcacctctggtgccacatatagcaacacgagatacaggctttttctttgttgtattgtttgttggggctcggggttgcactcgtgagggaaacaccacgtataccacaaaggggcacaaccctctccacactcttctgggaaatacaattgcggtagcaccccccttttcttctggggctctgaacacacctcggttctctgatataagaagtgggaattagagctggccatgtaatagtgcccttcttcttagggtctattgggacccacgattggtgttctccgcgccccaaacttccgtcttataagatgtgaagaggaaaatagtttcatagttgccataatagtcactctgtgtttcctgtacgagattacctctttgtgggttttggtaaactcttatttttttttttttccaccaaagggaacactgaaggctccaataaattattagagatttttttcttccacaaata

SEQ ID NO: 560750 - DNA, 104 bp, Homo sapiens
tgtgcatttggcgaggcagtctcggcgcttggtcactggcctgaaggtcaggatcatggggcccaactataaccctggggaatatggaggacctcttaccttga

SEQ ID NO: 560751 - DNA, 717 bp, Homo sapiens
  misc_feature (32)..(32): n is a, c, g, or t
  misc_feature (140)..(140): n is a, c, g, or t
  misc_feature (152)..(152): n is a, c, g, or t
  misc_feature (171)..(171): n is a, c, g, or t
  misc_feature (176)..(177): n is a, c, g, or t
  misc_feature (194)..(194): n is a, c, g, or t
  misc_feature (207)..(207): n is a, c, g, or t
  misc_feature (211)..(211): n is a, c, g, or t
  misc_feature (213)..(213): n is a, c, g, or t
  misc_feature (223)..(223): n is a, c, g, or t
  misc_feature (227)..(227): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (278)..(278): n is a, c, g, or t
  misc_feature (281)..(281): n is a, c, g, or t
  misc_feature (287)..(287): n is a, c, g, or t
  misc_feature (290)..(290): n is a, c, g, or t
  misc_feature (296)..(296): n is a, c, g, or t
  misc_feature (317)..(317): n is a, c, g, or t
  misc_feature (326)..(326): n is a, c, g, or t
  misc_feature (341)..(341): n is a, c, g, or t
  misc_feature (349)..(350): n is a, c, g, or t
  misc_feature (359)..(359): n is a, c, g, or t
  misc_feature (382)..(382): n is a, c, g, or t
  misc_feature (386)..(387): n is a, c, g, or t
  misc_feature (389)..(389): n is a, c, g, or t
  misc_feature (398)..(398): n is a, c, g, or t
  misc_feature (409)..(410): n is a, c, g, or t
  misc_feature (412)..(412): n is a, c, g, or t
  misc_feature (416)..(416): n is a, c, g, or t
  misc_feature (432)..(432): n is a, c, g, or t
  misc_feature (508)..(508): n is a, c, g, or t
  misc_feature (511)..(511): n is a, c, g, or t
  misc_feature (514)..(514): n is a, c, g, or t
  misc_feature (525)..(525): n is a, c, g, or t
  misc_feature (547)..(547): n is a, c, g, or t
  misc_feature (550)..(551): n is a, c, g, or t
  misc_feature (565)..(565): n is a, c, g, or t
  misc_feature (568)..(568): n is a, c, g, or t
  misc_feature (580)..(580): n is a, c, g, or t
  misc_feature (604)..(604): n is a, c, g, or t
  misc_feature (612)..(612): n is a, c, g, or t
  misc_feature (640)..(640): n is a, c, g, or t
  misc_feature (687)..(687): n is a, c, g, or t
gcctcctcaccgaaatcctcctcctcttctgnggtggcatcctggtactgctgatactcagagacgaggtcagttcatgttgctctcagcctcaggtgaactcacatactcgtccatgccctcgcctgtagtaccagttntggaaggccttncggcggaaaatgagcagtnaaatnntccgaaatgacgacttnaagagctcctggntggntnttctatttcnaatnaaggtgactgccatcttgaggccacgaggtgggatntnacanacggctntnttnacattnttngggatncattccacaaagtagctgctnttctttttnttcacgttaagcatnttctcatnnacctccttnatggacatccgaccacggaaganagcnncnacggtgagntatcggccgtnntngggnattaaaagcagccatnatattctttgcatcgaagacctgctgggttatttccggcacttttagatctcgatactgctggcttccacggctgnggngangggcaaaccangcataaaaaaatggagacgttntanngggacatgttgacngcnacttgcggaggncagcattgagctggccagggaaanggaggcangtggtaacacactcatggtggctgaganaagtggttcagatcccgtagttggtgtggtcacttcaagtgcggaanagatatcatagagggctcgttgtcatgcat

SEQ ID NO: 560752 - DNA, 93 bp, Homo sapiens
tggcagttcggctagatttttgttttgtttgtttttttgttttgtttaatgtatatttttattataattattaaatatgaattccattaaaca

SEQ ID NO: 560753 - DNA, 1248 bp, Homo sapiens
  misc_feature (355)..(355): n is a, c, g, or t
  misc_feature (827)..(827): n is a, c, g, or t
agcggagtctcactctgtcctgccgcaaggcccggcaccgaagctcagatcgcggcgcacggcgttgccctagaggctctctgtgcgtgtgctagctggtgtccgctggttgggtggtccggtccttgcgtatctgggctatggttgcgagccggcgcgccgcgctgtggcatgcgatcttacggaccgtaccttgcccgatgtttccgtggcggcgtccgggcccgcgcggacggctgaccctgggccatggaaatcacagtgtggcatgttctgcacgtcgggtgtcgacgggcgctcttacggacgaatcaaatgacacaatcaggatgttcggcacggaccgtaattaggnttgttgttggaccagatcaggccgcgtcatccgtgcagcggacatagtcctgcgccaaagtcgcctttgggccctgtgggccctggaacggtctggctgcgggtgggcttggtcgccattttgctcccgggcgtatgggccacgtttgaggggaacttcgggagcacggcagagaccgtttacggctggaaggcacactccgggggtctcgcagggggtagtctgcacattcttcctcgggggaagaaagcaagcgaatcgttaacgccgggtctccggccctcgtagcggccacttgggctggcaatttctctggctcaagcccccccgggtttggcgctcaccggacaaaagcgcatatgcacacaacgtccgcgaaaccgagagaaacaaaattgtggctccattaaatggttgaattccggttacatttcccaattccactttcgacgcgaacgggatttggtgcacncgagggaattgccaattgcgacattccgaattccgaaggcctaaaggttctcgccgttttttaattggccttgaagcacttgtttctgtgagcccccctttgggtaacgggggactttagcggaacggtgttgaattccgcaaaacgaccgcaacacgttaacagcagcagcaggaacagtaaggcgcattttacatttttccagggttggtgccccttgtggccttggtggaacaagttctggaccattcgcattggcgcgcacttaatgacaataggcggtctcccaacttgcagagggagtatacgccgaacctagagggtttggaacttttgactccccctgttggcacaaggggcgttactttttctgggagctttaggcgattccaaaactccaaaacgagttaaaaccctttgg

SEQ ID NO: 560754 - DNA, 380 bp, Homo sapiens
tcacatctgtaatcccaatgctttgagaggccaaggtgggaggatcacttgaggccgggagtttgagaccggcctgggcaatgttgcaatacttcatctctacaaaaattaaaaatcggctggctgtggtggcatgcatttgtagtctcagctactccggaggctgaggctggaggattactcgtgctcaggagttcaaggatgcaacgagcagtgattacactgtcacacttcatgcttggtgacagagcaagaccctgtgtcaaacacagaacattcaaatatgtatcgcttgagtttactactcaataatgataattatatctgatagtaaactgcctatataaacctgttgggtatgaaccccctttattatcatt

SEQ ID NO: 560755 - DNA, 847 bp, Homo sapiens
  misc_feature (203)..(203): n is a, c, g, or t
  misc_feature (245)..(245): n is a, c, g, or t
  misc_feature (296)..(296): n is a, c, g, or t
  misc_feature (299)..(299): n is a, c, g, or t
  misc_feature (303)..(303): n is a, c, g, or t
  misc_feature (325)..(325): n is a, c, g, or t
  misc_feature (371)..(371): n is a, c, g, or t
  misc_feature (392)..(392): n is a, c, g, or t
  misc_feature (412)..(412): n is a, c, g, or t
  misc_feature (414)..(414): n is a, c, g, or t
  misc_feature (439)..(439): n is a, c, g, or t
  misc_feature (443)..(443): n is a, c, g, or t
ggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccaggctttttttttttttgggggtgatgtaaanccaattccctgccaccaaattatttaaaatagtcccttggtnatcttaataaggataactcacttcttaattatttgtccatactctaagttntcnaaantcttccaatttatcagtgctcncctgaaagaggtatgcctcttagagaatacagtttctagctttaancaattaaccagggggagaaantaaacctcagggagtgaaanantcaggaggtgtaataaattgttccntcgntttcccccccgttttttttttttttttgggatttgcccttggaaaaacccaaagttcccgatttttctaaacattctccttttaaacaacacgtgttccccttggcgtgacagacgcctttttgtgtcttaccacttggggcaatttttgtttgctcccttaagaaaaattatttcgtgggagacctggtttcccaaccctttcttccacaatactctcgcgggggaagctccatatttttaaaggttgacaaaatatgggcttatcaacatttgcggcctatcccgttggcgccgtaatacacactttttatcaaaaccgcgtgggacaactgcttgaccacaccttgccgcctagatttgttacggcgttccgacacggcaaattgccaaaaaaaaatggcc

SEQ ID NO: 560756 - DNA, 685 bp, Homo sapiens
atttcctttcattattttgccacacacactttgtcattttcatcacgcgtgcaagcattacagtaccttgctactcgttgatacttccctaactggctgctcgtcccgcgatcctcggctccaccccgctcacccccgccctcctctcctccctctcccctaccactcccctctcccctccctacctcccctctcccctcccccccctcctccaccccactcccgtcccccatcccccccctccccccctctcccccccccgcccttccccccccccacctccccctcctcgcccctcctcctgcctccccccacctctcctcacccctctcctccctctccaccttcctcctcctctcccctatcctaccccctcccctctccctcccccctccccccccccctcctcccaccctctctaccacttccactcctctcccacccccttcccacccctccctccctacccacccctccaccccctcccactcccgtcccctctcccctctcccatccccatctccgctctccaccctccccattcacctcccccacactccccccccaccgtcccgccctcaccttccactcgcccctcctctctcctcctctcactcctctccttccaccctgccctacctccccccaccactctactaccatcaccatcaccctcccccactcc

SEQ ID NO: 560757 - DNA, 241 bp, Homo sapiens
gcaagttcacaaggccagagcccccactagaattgctgatgaagtaacatgtcccactgtgcatgcattgtcattaataaacatcttaacaggaaacagggttcaaaagcagagaaccggtctgactagaattcaccaggctggaatttcctaatcctagcaagcctggggattctgcaggagaccagggcatgtttcatccctatctacaactgcataaggcagacactcccagagcggc

SEQ ID NO: 560758 - DNA, 103 bp, Homo sapiens
ctagatacagtcggtaccctgtcatgtcatgttacagaaggcttggctgggaactgctctgccccggccggacgtggtgttccaccgtgggccactggtaaat

SEQ ID NO: 560759 - DNA, 102 bp, Homo sapiens
  misc_feature (1)..(1): n is a, c, g, or t
nttctgcggtgactctagtaggatccctccctatttgccctgggtccccacggaggtatgttattaagcttcaggtatctgtcgctgttcttcttgaggcca

SEQ ID NO: 560760 - DNA, 397 bp, Homo sapiens
ggtcaggtgctgcagctcacgcctgtaatcccagctctttgggaggcctaggcaggagaatcacttgagaccaggagttgaggagcagcctggacaacatagcaagaccccatctctacaaaaaaaaaaagattttaaattagccaggtgtggtggtatgtgcctgtagcccaagctacttaggaggctgaggcaggaagatcacttgaacccagaaatttgaggctgcaggtgagctatgatcacaccatagcactccagcctggataacagggtaaaaccctgtctcttaaaacaaacaaacaaacaaaaaacacaccaaaatcctttatgtatctgggtactataagttgtctttctcattttacatttgacactgagagacagagaggttgag

SEQ ID NO: 560761 - DNA, 610 bp, Homo sapiens
gtgggaggtcgtctagaggatcccgtagctcgatcaacctctattgcatttttttttccaacacagagtcttgtcctgtcacccagtctggagtgcagtggtgctgatcttggttcactgcaacctccgcctcctgagttcaagtgattctcctgctttagccacccaagtagctgagattacaggtgtccaccaccacgcccagctaattttggtagttttagttgagacagggtttcgccgtggtggccaggccgatcttgaactcctgacctcaggtgatctgcccaccttggtcttccaaagtggtgggatttacaggcaggagccactgcgcccagcccgtctatagcatagatgtatatttttcgagacggagcttcactcttgttgcccaggctgtagtgcaagggcatgatctaggctcaccacaacctccgcctccccaggttcaagtgattctcctacctcagcctccccagtagctgggattacaggcatgtgccactacacctggctaattttgtatattaagtagagatggggtttctccatgttggtcaggctggtcttgaactcccggtctcaggcgactctgccgcctcagcct

SEQ ID NO: 560762 - DNA, 1020 bp, Homo sapiens
tggtcgctactaggtggagcacatcgctgggtgcaatctcagtttggttcgtctggccctgtgcgttgctctcgggtgttgccgcgtctgtttttctccgctggagtgtctagtttctaactcggatgtcctcttgtgagttggtttgctttcacctcctcgctgcgtttgggtgagtctactccctaagaggtagcctccttgtggctaagtaatcacctagtcgcgtctttcttcctttctgcggtcaacatggtatctttctttatcgtgggcggttgttttttttcttgggaagctcttgtcctttgttcttcacacggttgggaaatggttgttctctctactaagtgacaccgcacatggtcttgtttgtgtcgccgcagagactgttcctgtggctatgcggcgtttctgctactccacaagggagggaccccacgtggtgacacccgcccctcaatctcctcctgtgtagcgcggggaaatattctagggcgtgggttttgtacacaccaaacccgcaattgcgccgacatgctctcagcagagatatatacacagggggttataccacgcgccctcttactctagacccccgaggagtgttctcggggcgcctctgttactgattttatcaccaggcgcctcgataatcccccgcgatggagactcgggacactcggttcacgccgcggggagaaacaatacctcgtgagggttggatcctcgggaagagggaagagaataggcttgcgtgtgactgttggagaggaacacggctatacgtggcgtctcgtgcactggtgtcctacactggagaaactttgtaggaagggcacaggagcccattctggacacatgccactgcccaatggaacccaaccaatggcgaccccagccactgtctcccaaccacttgatagggccccagtaaccacagcgtgttcccccgccccgagagggaagcctgttgtttccccgggaataaaagagtgcacttttgttttcccctggtga

SEQ ID NO: 560763 - DNA, 453 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctggctcctagtccacggttggctaccgtttgagagtcatcaggagtcttgctctgtcacccaggctggagtgcagtggcatgatctcggcttacagcacccatcacagtcctggttcaagcagttcttctgcctcagccaaccgtggactagt

SEQ ID NO: 560764 - DNA, 354 bp, Homo sapiens
ggcatgaacctgcagcctgagcctcttggaccagtatctgatggaattcaatgcctgccgatgtagggccttggcattgcatcagaatgggagtgacccactcgctgcggagggcatcgcatgcctgacatggatgcacagatgcgcgcctgggatagcatggggtgctggctgatgaggcgaaaccgaacgaaagacagaatggagacgcaagatgacacgatgaggaagcgtgggaaggtggcctcggagccatccgtggtcatgttatcgccatgacgcatggcaatccaaggcatatagggaggataagatgcacgtgtagacaaactcccaggcacctccacgacatgg

SEQ ID NO: 560765 - DNA, 399 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (362)..(362): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctaaggaggggtgaaccggcccaggtcaggaaacggagcaggtcaaaactcccggcatacagnagttaacgacgcgccaggaaagccaaccgttaccggg

SEQ ID NO: 560766 - DNA, 317 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtctacgctggaatggaatgatgaatggaatggaatgaatgaatgaatgaatgagtgggtacgagc

SEQ ID NO: 560767 - DNA, 324 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (235)..(235): n is a, c, g, or t
  misc_feature (318)..(319): n is a, c, g, or t
  misc_feature (322)..(322): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactcaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 560768 - DNA, 458 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (369)..(369): n is a, c, g, or t
  misc_feature (452)..(453): n is a, c, g, or t
  misc_feature (456)..(456): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagcacggttggctactagtccacggttggctactagtccacggttggctcccaaattagatcaaacacaactgaactcaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 560769 - DNA, 323 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggactagtcctgggaaaaaaagatgtctctaattactggcttcaataaacacgaatccagactgct

SEQ ID NO: 560770 - DNA, 552 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (311)..(311): n is a, c, g, or t
  misc_feature (343)..(343): n is a, c, g, or t
  misc_feature (428)..(428): n is a, c, g, or t
  misc_feature (437)..(437): n is a, c, g, or t
  misc_feature (448)..(448): n is a, c, g, or t
  misc_feature (451)..(453): n is a, c, g, or t
  misc_feature (455)..(456): n is a, c, g, or t
  misc_feature (461)..(461): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccactgcagcctccacctcccnggctcaagcgattctcctgcctcagcctcccnagtagctggaattacaggcacatgccaccacgcctggctaatttttgtatttttagtggagacggggtttcaccatgttggccangctggtctngaactcctganctnnngnnatccncatgcctaagcttcccaaaatgctgggattacaggcatgagccactgtgcccagtcagtctgtagtgtttttacatctgatcttcacacag

SEQ ID NO: 560771 - DNA, 507 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (266)..(266): n is a, c, g, or t
  misc_feature (298)..(298): n is a, c, g, or t
  misc_feature (383)..(383): n is a, c, g, or t
  misc_feature (392)..(392): n is a, c, g, or t
  misc_feature (403)..(403): n is a, c, g, or t
  misc_feature (406)..(408): n is a, c, g, or t
  misc_feature (410)..(411): n is a, c, g, or t
  misc_feature (416)..(416): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagcacggttggctactagtccacggttggctactagtccacggttggctcactgcagcctccacctcccnggctcaagcgattctcctgcctcagcctcccnagtagctggaattacaggcacatgccaccacgcctggctaatttttgtatttttagtggagacggggtttcaccatgttggccangctggtctngaactcctganctnnngnnatccncatgcctaagcttcccaaaatgctgggattacaggcatgagccactgtgcccagtcagtctgtagtgtttttacatctgatcttcacacag

SEQ ID NO: 560772 - DNA, 405 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctctttctgtgttattctgttctgctcctcaattccattccagctgaactagcctaccgtggactagtgt

SEQ ID NO: 560773 - DNA, 1541 bp, Homo sapiens
  misc_feature (972)..(972): n is a, c, g, or t
cctccaggcgccttgtaggtgaccttagaatcagacctcccaacctgctgctggatgttctttgagcgcacgtagtatgactggaaggactgtgcgtggaacgtgagtgagtgccattcgtacagcttggaggacgtagatatcaaggaccccgctgagcatcagggcaagggtgtggcccttaagttctgtcacagccttcttcaacgttggctccgtgaaagactagtagcgaggagtcatgaacacacatacttgagaggcatggctggtggctcgggggactctggcagtccccaatggacaacgacagtgatgagaccacggacttagtccgttcctggactgcaagggagtggcttggccagactggcagtgcggatttggcttagtgcggtcgctcttcgtagagatagtgcattgtggtcttcgaacgtaaataaatagctggcgtcgatagcatgtgctagttgattgggcattggagggctctgccctgggtgccgcgccgctcctgaggcatcgccagcccgaggcttgttcctcgttcgtccgttccgctcctgtggggggcacctaggaagacttcctattttgcatagtagtcacatcggttcctttggacagcgtttaagcggttggtcgatcctatgggaggtttggcggggaggggcgtgtcttcgcgaaagcggactccttgatccgcgtggggcgttcccatttggtcgcttctgaatttttgtacctttgaccttagttcgacctcccttcctgtgggaacctatgcaccggtgcccctgctggctttggcttcgcggggtgccattttgtgccccctcaaggtcccgcttggtgacccagcccccctttggactttggttcgtcctcggggggccaggtggcgcggacagtggcggggcggccaccagttgtgggccctggttcctttttggtttacaaaccattgcagcntttttcccatttacggatacagccctgacaacacaggcccgagcggggccgttccactaagaaagaatttcccctgtgccagggggacctgcaacgatcatatagtcgattatcgcacactttctatggtttcccaccgtgtcggcccccttaatattggaccatcccatttccatgagaccaagaccagttggccccttggttatatccacacgcgttgtaacgtgcggaccaacccgtgcctcccttgcccaacatcatttgtcacaggcagacccctaaacttctcgggggctgaccccacactattggtagcacactctctcacacgagatctctacaagcgccataagtgggatcctaatacatctcagcgcgatatttggtggagcccaccacggcatcaatagatgcgaccaactaagctttcgtctgtcactttattacatagcgtgcacgccaagaaaataacacacggggtgtagcaagaccataccagcctgttatcgtcacatatgcgactcaatcgatcacattactgacgagcaaactccaatcagtaatcagtc

SEQ ID NO: 560774 - DNA, 807 bp, Homo sapiens
tcaatgatcatcatgcaatgcctacctgcaccaccaactgctatagcacccctgtgccacaggtcataccatagacaacttatgtgtatctgtggaacggactcactgaccacatgtccaatgccattcacttgccacaccatgaatgacttgtgtgattgtgccccataccgtggaacacttgtagtgctgtgaattgtgcctgctgtgtgtgctactccacagcacacattcatacaccattgacccatctaacttgtgactgacttgcacaaagtgccttgttgtgtgcctaatgggtaccatacaccctagccagcccttgaaactgtgtgcacatgcatacaacatatgttcaaattgtgaccgatatcacatgtaagttctcacacaaaacttttggccacacaacgtgataggatcccaaagtagtagcttgtgaacacaatttgcaccccatatgccaccttgactcgctcacaggcacaccacagaaccctttaggcgcagaaaatgacttacattggcaatttggcaccctattcgcaaaatgccaccatgtgctagcggttaggcaacaatgccgcaagtggcccggttctagtcggaaggtaggtgccccccagcaaccctttcctcaccctggcggcatgcccaaaagtaacccgaattggatggtagccgatttaatacacaacaccgatttgggaatcggtccgcaacccccaacatggctggcattggcggggattccgatgtatccccattattacccggttgggtgcaacaacattattcgcaaaaagt

SEQ ID NO: 560775 - DNA, 317 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagcacggttggctactagtccacggttggctactagtccacggttggctggctgggagtgggagtccataaggttcaggccactctcaggctgtgtgacctggagccaaccgtggactagt

SEQ ID NO: 560776 - DNA, 355 bp, Homo sapiens
actctagaggatacacagagtcttgcactgtcacctaggctgagtacagtggtgcaatctcagctcactgcaacctccacctcccaggttcaagcaattctcctgcctcagcctcctgagtagctgggatgacaggtgtgtgccaccatgcccggctaatttttttgtatttttggtagagacgggatttcactacgttggccaggctggtctcaaactcctgacctcatgatctgcctaccttggcctctcaaagtgctgggaatacaggtgtgagccaccacacccagccagcaagttctttacttagattctggataatgtagatgtcaggatttaccacggtgctataacg

SEQ ID NO: 560777 - DNA, 1230 bp, Homo sapiens
tggcttcagttgtggtttattggacatacaggtaggtctctatagcaaaaggcctggaggtgcgtgcagatagtgtgggggaaaatgtggaagggtggaggggtggagtgtggttgtgcgtgcaggaacagccgtgagtgtggagggtgtggggacaggtgtgcaaagcgtggaagaggcctataaagaagcttaaatgaaacgcagagttagagtggccgagggccccagagagtctcggcttctcaaagtggaacaacacacagaggcccagagtgtgcgccttagaggcgccccttaacactctctgtgtgcttgtgggtgtgtgttctctgtgtgtagccccacaaggccacacagggtgtgtggaagagagtctcctctctgttgggacatctcacaacttttattctctataagagagagacaagctgtggacacacagacagtataaacaacacacagcagagacaagcgagacacgctgtgtgtcaccctctctctttgtggcacactctgctgggctctcccagcggtgggccctctcacaggtctcacagagacatgtctcctctctcctttcatttcgcccttgtgcaagtgtggggcgttgggcgacgccccaccacatgtgtcatgtgcgcgccagagacccagaggagctcctctgtgagagccttgttgtgtcccccacactcttaagacaagccgagagtctgtgcccacacaaccccacagacgacccacagtgtgttcccacaagtgtggagagaggccagtcgtgcgacactccttttctattatcccgctgttgggggtgtgtccccaaaaacacttataacacagaattgtggccccacaggggtttaatcaccagaggccccccagagaaaagcggtggagaaggagtctctataaccaaacaaacggcccggtgctagacgccgtggtagccgcccccccatcaccaagtggcgacacgttcgggcggccccgtcagcgggcagccgccgcaaccaacggcggccggcaggggcagccggcggaagcacacacaagcccgggggcgccggccttttggcagcacctcgccgcaccggcggaggggggccacctacccacggtgaggaggggggggccctccccccaaacgattaccacaaacgggggggggcacgacaccaccaatggggaggaacacaccccaacaacaccacacacgcagcggag

SEQ ID NO: 560778 - DNA, 231 bp, Homo sapiens
ggtcgaccacatggtggttcaaacacaggctggctaacaagctgtgacgtgacttaccaacccaccccaacaacaaaaacccttgaacttctgctttcaacttccacctcatgctagactacccggtccaatcctcctggtctaacacctggctacatataacaaccaccatctgctcgaatgtgttcgaaaggtgatgattaatctgccaggctgatatattaaataaaa

SEQ ID NO: 560779 - DNA, 583 bp, Homo sapiens
ccctcacggattacctcaacaataagaaaacaaagaacctgactttaggaacaggacaatgaccttaacggacacctcactaaagaagatataaagatggcgagtatgcatatgaaaaaaagtcacataatcaggaaaatgcaaattaaaacaataccactacacacctattagaatggccaaaacccattaacagtgacaatatcaaatgctggtgagaatgtgaacagaaactcccattcattactggtgggaatataaaatggtaccatcactttgaaagacagtttagaggtttcttgcaaaactaaaggtattcttaccatatgatccagcaactgtgttccttgctatttacccaaacgaactgaaaacttatgtccacacaaaagacacgcacacagatgtttgatgtttatagcagctttattcacgattgccaaaactagggagcaaccaagatgtccttcagtaagtaaatggacaaataaacccgggtatatccagataatagaatagtcaagtgcaaaagaaaaaaaaagctgtcaaaccgtgaaaagccattcgagtaataccgtatggg

SEQ ID NO: 560780 - DNA, 290 bp, Homo sapiens
cttaaattttttttgccccccttttgtcccctttggggggcccttaaaaggggaaaacccgttggggtttccgggaacccgggccccccgtttttttttttggggaaacccccgggggggggggaaattttccttttgttcccggggttggttaaaacccccggggggggggttggggggggccttttggggggtggggggaattttggggggttttttttttctcccttttgggtcccccctgggccccgtttttttccaggggggcccctttagggggttccccctta

SEQ ID NO: 560781 - DNA, 141 bp, Homo sapiens
  misc_feature (63)..(63): n is a, c, g, or t
taagctctgtctgctcgcacacgggccgctcccacttgcgctgggtatctgagccgcggtgtncgccgcggtccaggagctcagtgctcgttcagggcgatgtaatccttgccgtcgtagctaactggttatacccgcgga

SEQ ID NO: 560782 - DNA, 870 bp, Homo sapiens
tcgcttcccaacagagctgctggccaacaatttttttggtttatcaaacagtgctgaaacaaacaggatcagcatttacttaagatgtacgactgaggacttttaatcagccgaaccaagatatggttacctgtatgcattcccaaagtctagatgctcagtatgtcagtcatatctttcagaatcagtgaaccgattttttttggggtatcatctacatctggccaacctagttcacctgggttggtggtctgctgtagaagggacccataactggttaacccggaggcttcactcatggtatcacatgctgtgaccattgtatttgtgcaacgttcaaaggtatccaatgtggtaaggctaatacattacactttataccacttcactcacttgggtcacaggtgccaagcaagacaccttcaaattccagatttaatatgtgcagttcatgggagggcaaaacgcaatatatttgtaccagactgtctacacatatttgggatacacaccaggctcatatctcatacaaacacttgactttataccttaacagtttgtacctcaaaaaagtctcaaaccataccttggttgcaccttttttatacacttcttcaacaagatccggctagtggttatcatacctcctttagggggttgctttttaccaaaccaattacgttttccacttggcgtggaagtacagaagcgagaggcgggctggcatcaatctttgccccaaaacaatgcgatatgggtgcctcacagttacaacactacactcttagcctcgtgtgacgctgtgagggcatttataccccagcatttccacggtttataccaatcttggcacatatacacagggcacta

SEQ ID NO: 560783 - DNA, 184 bp, Homo sapiens
cacactatagcattttttttttattatgagaccagacattcttttgaacccctcaatatgttaggcactgactggagtggttaacaatcctagctacttagtgcgaagactgccttttctttcttctttttctttttctttttttttaaattaagatggagtttagctcttattgcccaggctg

SEQ ID NO: 560784 - DNA, 211 bp, Homo sapiens
cctcctcctctagaaatctgggatcccaagagaagctgaggcaacagtcatttcctccggatgaaacgttaattttccccatctgcaaaaaaaaaaggtggaggttacccttcctggttgtttctcgtccttctttgcccctggttcacaagtctaaatattccccacctgagactggaagctatctcatcttgtctgaaggacctgttgt

SEQ ID NO: 560785 - DNA, 737 bp, Homo sapiens
agctccattttacctctctttctcttcccctttccttcgcgcccaagagcgcctcccaggctcgtatggtggtcacggagcccctgtgcctattccttgcttcgggtcctgcgtcgacgcctgccccgccatgaatgagagagtacagactgtgatcgtgctagggcaccggcctgacggaatgtatccttgtcaggtatcagtgtcagtgacatggcgaagaaacgttcttcatatgggatcgacacacccgttactacggaggacgagagtgcatctataacaccattggaagatttatacgacagatttcaaataccaggatcaccacccgagtcaatggggagaggaagagactggaatgtcgacttgtattccccaatggttccttatggctaatggtcgagcgtgcttaagatgctgcgtttatacagacggtaactcgctatctggattttagagtgactgaagggagctggtgtctatacagggtggacacaaatctacaaggttccttccactgaagcagaagccctgggatctagcctaatgggacttgtcctgaaagcacgtcgcttcaggagattcctagtgtatgttgccaacttcgatgaaaaagatcaagcacttttgaccggcgttgatcctaaagtaagacctacgtttgcgacgatgtgtgtaagaaatgtgatttgggtcaagacgttatagattgtactgggtcatgctcttgcctt

SEQ ID NO: 560786 - DNA, 1340 bp, Homo sapiens
  misc_feature (1340)..(1340): n is a, c, g, or t
gagtctgctgggggaacggttaggtcatgcagtgactggtcaatactgagtggcacggaactgatcgagcaggcgggctgcagtacaccaacgcggtgcgcgactgggagctggacctccgggggtataaaattcgccgtcattgagaatctaggtgcgtaacgttagaccgagtttgatgctattagataatatctgacgaatgagatcaggaaactgtgatggtttcctttgttgagaagactgaaaacattgttagtagaacaacaacagaatatgccgtataggtgagggacttgatcaggctctgccctgtctgacaagaaactcatatctcaccaataatagtactcgtggaactgggtgatctggaccctactggacatctctcaaatcgctgactatacctaagtatcctaaagaaaatccggtaaaacaataaagaagcataaacaagatagtcatagtagatataatcacacgttcccgcaaggtacacgagctactggcattatccagacaagctgcacactacacacattataaatccagagtgctagcgtatgccaactgacaacacagcaccacgtgggaccatctccagggcgatgtaaaaagcaaactcaaagaatgccataagcaaacaatagcatcaaaactactggactagaaagctggaacacagcctgcacaacggggatggtaggcaacgactgggagccaagaatacccagaggccacgagaacccgaccagatcacagggacccacctgaactgcataggatgaacgacacaacttggaacgaagaaacaagcacacgcaaaaggggacccagacacaccatagaagcagcaaatgataaacaagtagcgccaccacagagacaaacaaggcaatgcaacacgacgaacacagagaaaaaacaagaccacgacaacgacgcaacgaccagccgatagaaaacaaacaagacactggagaaacaagacacagcacacagacagagaacaaaaggacagaacaaaaagaccaaagacaacaagggcgggggtagaaacacaccagaagcaccaccgcaccacccagcaacacagccaagaaaaaagaagcggggcgaggagccacgacaaccccagaggccgccgcgacggcaccagcacgtcgaccgacacgaaacaagcgtgcgacacacaaacgagccccacgagaacggcgaagagcaacgccagcacgaccaccgaccggacgagaagaacagacaacggagacgacagctaccacgcacgcggaccagaagaagctaaaaagacgagagacggggagcaaagaacgatacan

SEQ ID NO: 560787 - DNA, 116 bp, Homo sapiens
ttctatgaggatcccactggctatcgaggccaaccgaggcttgcgacgccggtgaccgttgtattcgctcttcgcggtggcgttatcactggagctaaggaacattaattgggtat

SEQ ID NO: 560788 - DNA, 294 bp, Homo sapiens
gaagatggcggacattcagactgagcgtgcctaccaaaagcagccgaccatctttcaaacaggaggagggtcctgctgggagaacttggcaaggagaagctcccgcggtactacaagacatcggtctgggctcaagacacccaaggaggctattgaaggcacctacattgacaagaaatgcccttcactggtaatgtgtcattcgaggcggatctctctgcgtgtgaccagatgagatgcagagacattgtatcgcgagactatttcactacatcgcagtacaccgctcgagag

SEQ ID NO: 560789 - DNA, 82 bp, Homo sapiens
gaatttggaatgaaaagcacttcgtcagaaccttctgtgggagccattgagagaaaagcatggtccagtgccttctgagaaa

SEQ ID NO: 560790 - DNA, 180 bp, Homo sapiens
  misc_feature (24)..(25): n is a, c, g, or t
atgtgtctgcgtcctgttagcatnngtgaggaggtggagagacagcccacccccgtgtcaccgtgacccctgttcccatgctgacttgtgtttcctccccagtcatctttcctgttccagagaggtggggctggatgtctccatctcgtctcttctcttgtacatctctctcttctatgt

SEQ ID NO: 560791 - DNA, 222 bp, Homo sapiens
attacttatacttctcaacgctcatacttctcaacgcttatactctctcaacgctttatacttctcaacgcttcatacttctcaacgctttatacttctcaacgctttatacttctcaacgctttatacttctcaacgctttatactgctcaacgctttatacttcataccgggaaattaactgagaagtataaagcgttgagaaagtatacagcgttgacg

SEQ ID NO: 560792 - DNA, 115 bp, Homo sapiens
  misc_feature (101)..(101): n is a, c, g, or t
agtagcatacttttggaatcgataattcccttactaaagaactctgattcattgttaacatggattctatttctgactgtgatctctagagcacccggggnaaacatatgctaaa

SEQ ID NO: 560793 - DNA, 248 bp, Homo sapiens
gcggtccatggtgctgcgtgccagtgataggtgcgtttctctgttgcgggccgttttgccgtttaagacggacgcaacgacggcagcgcatgcccctgtaccgcatgcttgcgtcacccctgagccgcgctcccatacgcgaaaatgaagttcccgatcattgacgacttcgacaaattcgacattgactccttccggaaaacgagcatctttttccactactggccctaacgacgttaccggcgcct

SEQ ID NO: 560794 - DNA, 97 bp, Homo sapiens
cctcaacaccgcatcttatcaaagaaatgctagattcagaaaaccatcattttaggctgggtgcagtgcgctcagttaaaaatacattttttatttt

SEQ ID NO: 560795 - DNA, 167 bp, Homo sapiens
  misc_feature (158)..(158): n is a, c, g, or t
cccggtcgacgggggattgagaataaaaatcggataatagttggttaaaagacaaaaagaataagcgggaaaaatcctagggattactgtgacctagacaatcaaaagcagataggtgacctttgattaaatccatttactgtgtggcgtgagctaanaaggaggct

SEQ ID NO: 560796 - DNA, 642 bp, Homo sapiens
tcaaaaagcaaatcccatttatgggaattcactgacaacaaatggaaaggaaggtttccccctcccctgaaacatgccatcctctttgccctcagggctcacacagggataaaaaccccattccgattgtccccagagggcagcactccaggggggtgggggggaggggagggtgtgctgctacgccaggctgggggagctggggacaggagggaagactgtgcaccctcaccttctgggtctcaatccctctcccgcgggaccgggtgctggcccccaggtcccgggggtgggctgacaaacagggctcatgcaacaatgagtagacaggaggtggcacggaaacggtggccttggtgccccttggcgggggcgggaggacataagggggccatgctggtggccacagggggctccaaagggaagtactctgcagtgtacactacaggagggttggagagaggctatcttttcccctaggctgtgcctgggggacaagagagaggggaagtcacagtgggcactgccgtgccagggcaggtccaggccagcgtgccacctgagggggcacaggagctggagctcggtactcctggggcggcatgatggtgaggatgtaccggaaaaatgtgatgatgtctg

SEQ ID NO: 560797 - DNA, 701 bp, Homo sapiens
tataactttttaactttaataacataaatattaattttaaaaaataaggctggccaggcatggtggctcacgcctgtaatcccagcacttggggaggctgaggcgggcggatcacgaagtcaggagatcgagaccatcctgggctaacacggtgaaaccccgtctctactaaaaatacaaaaaattaaccgggcatggtggcgggcaccgtgtagtcccagctactcgggaggctgaggcaggaaaatggcgggaacccgggaggtggagccttgcagcgaaccaggattgtgccactgcactccagcctggacaacagagcgagagtctgtctgaaaacaaaaaaatacaggctgggagctgcaggggcctcaggctgttggtcctggcgcttggggaggcgaggcatacacgttcgaggccaacctgggtcaacatttgaccaaaaaacaaaaaaaattccacctgggtaaaccagggtagaaacccggattccatcaaactttccaaaaattgtgttagggcatggtggtgggccctggtattccccaagaatactccggaaggctacgaggttggacacacgatggcgttaacccccagtaggcacaaggttcgcgcacattggcccacaattcggccacatgacctatcacaaccacggcgctaaaccaaaccttggtctcaaaacaaccaaaaaa

SEQ ID NO: 560798 - DNA, 930 bp, Homo sapiens
ggtttggcgacattatgtacaggctgtgatgcatactgtcgaagatttgatgttcagatggttcttcttacatatactatgttcgtctacagttgcctatgctattggatgatacttacattgtgttgttctggtgttgatgaaaaaggggcaactgtctcctctatttagtaccttgcacacttattactgcctcagtgtgtcgcctgagacgtaaggaaatgccacaacgttctggacaaggtaacagtatcagctgatggaccatttggattgtgaacaaatgaagaaaacctgtgatatctggtgaacagatggtcccagcaaatactatattgtggacctgcctataccatgtgtcctcgatttctctcacccaaatagacttcgcattcttaacctggacctttcttgactgggacacctcttgacaggagctcttcaatgatctgctggccaacccctatattgttatcgagcctgcgtacctgacagttcactctcataacctaacttcacagcttgttctctaatgtcacagttgtgccctcacccttcacttaacccactatgggcctgtgtactcccccgcgcacgtactatctaccggacatcttctcacccacacaatggcttgcaccccacgcgccgggccaattcccactcttcatccggtcacatgagacggtccgcccccgtcaaccactcgggtcctcacacctgatagcaggttttcaccctcatgggacattatgccgtggcgccacctctctcggcactcccgggcattccttccactcttatccaaacaatcgcatgcacggtcccaggccggtctcatccgacagtgctagtgacaatcttcctggccctcaaaagcgtcacggccgtgcgcttgccctacacggtcactccaatcacctcacctaa

SEQ ID NO: 560799 - DNA, 242 bp, Homo sapiens
gagatcacgagataataagccactaaccagcagcttcaggacagacaacctctatgcccctgtggcgatcagtgaggatgatcagaatggtcccgggggatatgctggctcgcagttatctcacgtgctgactgaagggttaataagccgatggcatcaacagcttacgaggcacatcatacagataagataatatctaggcatttagcgaagattaaccacccgggtaccgccgatatctt

SEQ ID NO: 560800 - DNA, 353 bp, Homo sapiens
  misc_feature (74)..(74): n is a, c, g, or t
  misc_feature (85)..(85): n is a, c, g, or t
  misc_feature (206)..(206): n is a, c, g, or t
  misc_feature (328)..(328): n is a, c, g, or t
gtgtgctttaggaaaaatgtattacctgaagactaattggaatgagaggatattagtaaatcttcccagacctnagtttctttancctgatggtaaagtagttgaagtggaggctgggtgcagtggctcacatgtgtcatcccagcattttgggaggctgaagcaggcagatcacttgagcccaggagtctgagatcaacctgggnaacatggtgagaccccatctctgccaaaaattagctagacgtggtggtgcgtgccagtagtcccagctacccgggaggtcaaggctgcagtgaaccatgattgcgccactacactccagccngggtaacagagtgaaaccctgtctc

SEQ ID NO: 560801 - DNA, 133 bp, Homo sapiens
gtacctattgaaatataggagtttttatacaagtgtgagatagtaaccctcatcagaagtacgatttgcacaaatattctctcatttcataggtatgtctatttctactctgtatgatatgggttgacgtcag

SEQ ID NO: 560802 - DNA, 310 bp, Homo sapiens
ggcaggggtgacctacgatatcggtcacagctctatttagctcctctaacagagtcttgtacctaatttgccctggcaagccatctgaaaacggtacacacaacatcaggagttgtgaaaaaggttatttggctgggctctgtcattgtagcctactttctctcctgtgctctgtttatgaggccctctaccctgtggatagaatgaaatgtgtcaagtgggtagatgtaccctggagcaagattctccccacccccatacaagaaaacggtagtaggtagtttattcagaaatttgaataaactgtgaa

SEQ ID NO: 560803 - DNA, 423 bp, Homo sapiens
tgcattccatagtgctttggagacccgtctccattctctcccatcttgaatctgctggagccagaagaatgcctctcaagagctgaatggggcagggctgagcactgcaacctgtgtgcatgaaaacaactgaaaagcagttctcaggagggcaaaggctcagacactgcacgactattcctcgttcctgagtttctccaaacctgcactagaccatcaaggggcaaataaaaatcaaccacccccagatagcaagtcctcgtataggactagaggtggatattgaaattagtaagcattagagaggaaccggaaatacaccaaagcaaagcagaatataaaatggaaggacaaagatgaaaataacttgaaaagtgtactttacatgagaaaaatacttaataaaagtctgcgtatttaaaa

SEQ ID NO: 560804 - DNA, 178 bp, Homo sapiens
  misc_feature (11)..(11): n is a, c, g, or t
  misc_feature (19)..(19): n is a, c, g, or t
  misc_feature (22)..(22): n is a, c, g, or t
  misc_feature (29)..(29): n is a, c, g, or t
  misc_feature (44)..(44): n is a, c, g, or t
  misc_feature (85)..(85): n is a, c, g, or t
ttagattattnggggaatnaantgagacnatagaaataagtttntttgaaatatttttaaataattttaaattacaaattattgntttttgtttatcaaataagtgaagtatttcttagtgtctgtcagtcattgtacctaggaaggaggtgtaaagtgatgactgtcctcacaaggc

SEQ ID NO: 560805 - DNA, 414 bp, Homo sapiens
cagtccaaatccggggtggggtgcacttactttaagataaacaccaaaagcactcctcggccaatctggagcaatagatagaccgggataatatggcatgggctccaaaagcggggtggtagcttccttctccagatttaagaccggatgtctggaagagggcagcaaatcctaggagtggacacacgggcattccacgggaatcagaacaggaaagggagcgagatcccctagtgcagggggaaatagagtggttcccagcacaaaaccatagcataatgggtactttttttttgttgggagaacgggtctcaggggttgggtcactaaggggggagggcgggggcgcagatctcagcccagggcggcctgcgcctcgggggtcacaaggcgagatctcgggcctcagcctcc

SEQ ID NO: 560806 - DNA, 208 bp, Homo sapiens
atctattcggttcagatactctacgtgtccaagtgacattcagtttcatcaagtcatcgcgcatgtacagctcaaaaaaaaaaagtcatcgcgcagttaaatgtttacggaagcgtgcgaaattgcagatcctgtgaggaggcaagagcttacctgggggcacaggttcaggatcatccagggaatcggtcgaggccaattgttgggg

SEQ ID NO: 560807 - DNA, 180 bp, Homo sapiens
gatggcacggtaaggtctgggctcacctgaaattctggtagagctgaacttagtatagaattcccagagctgtaggcattttatacaattgcttacaatgtagctagaagacacatgacagttccagcaccctgccccaggatacatcctttgagggctgctgcaattgcgccagcgggc

SEQ ID NO: 560808 - DNA, 827 bp, Homo sapiens
ttggcacgtgtaacccaccttcatgtatagcacttgtgttccatgtgccttgaatttggctgacttgggactgctcgccttgtcgagccctgagctttggccacacgtttgtgccccttgtgtggagtccaggggctttgaggtctccacaactaggtaatgcatcgagtgtaatcctccgctcgtctagcgtgctgggccatgggcgcctgctcacagtacagtcatggagccagggatgtggctcgctctgatgcacaatgtctcagcaatgcccttgaaggtggtaggacggtggtgctccgtgggttcctcgatgtctggtgcaggatgctgaatggcgattggagtgctgccaagaatgatgcccgacctccccaggatcaagatcagaacttttggtaacaaatcagtacccaagtcttatttatggtccgtcgcggtttctgcgttgttctttccatgttcgatgactattgtgaacattcccaggtattcggagcactctagtggccttaaatgtggctcagtggagggagacccagcatagccaggccagtatcggatgcacctcacgcacagctctgcagaatgctgcaaggtcggatcgaacatctgaccaaagacgagtagctggtacgaggctcactgaaagagaaagggcctgctggtctcatcctctgtcttcaatcttgcctttaccgtatacctgctctgcacgtgccgcaccccattattgccgtgtagctcacccccaggatgctgtacccggttgtagaaggagctgaaatccaagctgagatgtacaaggacttgcatatctagaa

SEQ ID NO: 560809 - DNA, 257 bp, Homo sapiens
  misc_feature (73)..(73): n is a, c, g, or t
  misc_feature (154)..(154): n is a, c, g, or t
  misc_feature (162)..(162): n is a, c, g, or t
  misc_feature (242)..(242): n is a, c, g, or t
  misc_feature (247)..(247): n is a, c, g, or t
ggtctcctcctgcagtggatggagatggggagaggctgcgtggacttgtcgtattaaatgtgcctcctccctncacaggtgggatcccaccaggacatcaccgaagacagcttttccctcttctggttgctggagccccggataggtactgggnaagggganggagaacagaggtgttctgggccccagaaggcgacccccactgcaggctctcaacagaactgtagactagccacacccanccttncctagagatc

SEQ ID NO: 560810 - DNA, 386 bp, Homo sapiens
tccacttgcacccccgcagtactcagtcttccacatcaagctcggccacgtcctcacgccccacacctgcagggttctgccgaagccccccagtcatgctggctggagggcgtgtcttagaccagcccagcatccaacagatccagaggtaggcaagaagggaaccagggaaggggacctccgttttctctttttcctcctcttcttactgtctgtcccttctttttcccctaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacat

SEQ ID NO: 560811 - DNA, 281 bp, Homo sapiens
tgcccctagcctgggccccccccgacagactgcaactgcgttactgtgcttagaggtacccagaaggttcccataaagggcagcatgtccaagcccctgaccccagatgtggcaacaggaccctcgctcacatcccccggagtgtatgtgtggggaggggcttcacctgttcccaaaggtgtccttggactccccttggcacatgttttgtgtttcagtaaaaaaagacctgatcccccatctgtgtgcttccctcctgcattaaaattccctcagtgtga

SEQ ID NO: 560812 - DNA, 134 bp, Homo sapiens
tgtgagaaataaaaccctagaggaggcaattgcactctgatcctcacgacatagtccacattcaagcctgaggtagctctctttccttctataacccttggtctaatccctccctggggctacctctctcacgc

SEQ ID NO: 560813 - DNA, 932 bp, Homo sapiens
tcttgtcgagtttcttccgtgtcagtgtacacgcattgggcctacccctgcgataccttatttttgggaaccctctttgtcgggatccgcttccccggttagctcccctaattggggcaccccggtgtgggctcccaatattccgggggccattccccccctattctccttggaaaagtacacatggttttgttagacccccagtttttccccgcttcgttaagcccctggtaccaccccccgttggagccacgcggaaatgatggtaccccccttaaataatttgcttttcagacgaacatccttttctcgtttgtcatcaagcacaccatcatttgtaatcaactaccctccccactaatgtaatataaatttttcatcacagtccccactgaattattagctgaaccacaaaaaaggtaaagaaacattctgcacccgagtctgaaaatccgctcggggagcacttattttcatgtataacaatattttgtgcccccgccgatatcattggacaaatatacttcttccaaagagtttctaaaccgctcctggaccttacgagcacacccgccctgttatccacggtttattcaccataatcccagagttgttgacaaaaacaattttgaaaatttgataccccccaacaaggtcttcttctaataaatataatgccctgttattcttgtgtccaacccagaatgtgtccccggcttgtttcctttatgtcacaaggagactccctataaaggcccttccgagccaaatcagaattttcttattcccttgccaggggtcctcctatttacaaataatgtgaacccaccagtggaatatctataaaagctctccttcaaaaacgcagtaactttccgaaatacatctggccccccctttaaaaacaccccccattttccccccacataaca

SEQ ID NO: 560814 - DNA, 244 bp, Homo sapiens
ctcgagctcggacccctaagagtgcccccactagggcttcactgaggcttttggggcacacaggggccttcctcttttggctctatgtccccacccaaatctcatcttgtagcacccataattcccaggttttgtgggagggacccggtgggagatgattgaatcatgggggctggtctttcctgtgctggtcttctgatagtaaatgggtctcacaagatctgatggtttttgaaaacaggag

SEQ ID NO: 560815 - DNA, 228 bp, Homo sapiens
  misc_feature (197)..(197): n is a, c, g, or t
  misc_feature (212)..(212): n is a, c, g, or t
  misc_feature (222)..(222): n is a, c, g, or t
gactgagagaccgtgttgcaatgtttgtctgagatgatagcatccaattatgtgggagcattttgggaatgatggcacctgagaagaagccttctctcaagaatgcaggcagcatttttaggttgacaggtgccaagaatccaaggcaattgtgtctgaggtgtccccaactgtttttccaaatgacattgcccatngcaacacggtccatngcaacacggnctctca

SEQ ID NO: 560816 - DNA, 431 bp, Homo sapiens
ctgttacaataataattaaaaggcatataattcaatttttaagaatcaacaagagatctgaattaacagttctccaaagaagatacacaaaaggccaataagcacatgaaaaggttctcaacatcactagccatcagggaaatgcaaatgagatctacaatgagatatcacttaacactcactggaatagatatataatcaaagtgataatatcaagtgttggtgaggatgcagagaaattggaaccctcatgcactgttggtggatacccacgtgatataaaaacaaatgtctacacaaaaacttgtgcacagatgttctttgcagcattatttataatagcccaaaattgaaacagccctaatttctatcaactaacaagtgtataaacccacacgtggcatatccatacaaggaatataattcagcaa

SEQ ID NO: 560817 - DNA, 882 bp, Homo sapiens
agcgggggcggaggcgctgctgcggcgctgcggccgacgccgggtccgcaccaactgtctccccctcccagcttcttacctcggcttcctactccttcccccgcccgcccacgcatccgccagctccgggtagagcttgccgggagttccccgggagcctctagggtgagtgactatcctgttgagaagcaataaggatactttgcaaggtactgaaatagtgcctcccaagatttaagcgccacctcaactgatgatgattgtcatcaggttctgtcgagaagtgcacaaggacgacaagtcttattggaagatgattcagatgactgcaagagcgcactttttctctaagggagaccatctgggaccaacgtattctgggactctagaatatgcctaacagttaagccatgcttcagaatcgaagtggatgaagtgattgatgtctatgccacgaaaatcttaccacaggtacattgcagtagagcggcgagagacgtatcatgaactagcaggacaccatcagaacagctcatcggctaatgcaactagctttcagccaacatgatccagtacaatcttcgaaggccactgtggtggcgtgcgatgcgtaatatccatagccatcatggctttgggtgagcctgctatccttttgcctaggtgattactcattcttatagtccgtgaaataccgtaccttgatcttgatgacaggagatcttcattcaatcaagatctgggaccggtcaatagaagattggtgcattatttggacatgaaaccctatgtgtttatttacttttcccaaccttcgtttttccaagaaactcaggagctcccgatggtcctggcctttgcaccctgaagtttaacccccat

SEQ ID NO: 560818 - DNA, 157 bp, Homo sapiens
cgctatgacgccagttcggttaccaaaattgtacgatgtggtacttaccatcggcatgaacggcaatgtgcccacggtcttctaaaaatcctacatgatctatgctgaaatttgcctccagtgcatgtttgggtcatgttgataaaaggaaaccttt

SEQ ID NO: 560819 - DNA, 526 bp, Homo sapiens
caagacgtatcagaacacagaagagggccaggcggggtggctgcacgcctgtaatcctaggcactttgggaggccgaggcaggtggatcacctgaggtcaggagttcgagaccagcctagccaacatagtgaaaccctgcctctactaaaaatacaaaaattagccgggtatggtggtacacgcctatggtcccagctacccagggggctgaggcaggaaaatcgcttgaactcaggaagtggaggttgcagtgagctgagatcacaccattgcactccagcctgggcaacagagcgagactctgtctccaaaaaaaaaaagtcctcttatgttcacctcccatccatcttttctccaaatcagccccagaatttcggtttggacccttttcttttctaaagtaaattaatctctctttttcttaacctttttttcctaaactcggtgtgcttttacctcaggattcctagatgcagttaatcttatgtcttatatttactctttttttcggctttcatccttgtg

SEQ ID NO: 560820 - DNA, 229 bp, Homo sapiens
  misc_feature (56)..(57): n is a, c, g, or t
  misc_feature (73)..(73): n is a, c, g, or t
  misc_feature (93)..(93): n is a, c, g, or t
  misc_feature (98)..(98): n is a, c, g, or t
  misc_feature (109)..(110): n is a, c, g, or t
  misc_feature (127)..(127): n is a, c, g, or t
  misc_feature (140)..(140): n is a, c, g, or t
  misc_feature (145)..(145): n is a, c, g, or t
  misc_feature (161)..(161): n is a, c, g, or t
  misc_feature (201)..(201): n is a, c, g, or t
gttgatagtctaaagggagacgtgtacagtaaatttgcacgcgcgtgaagatgtcnncttagggttgaggaanaaggaaagtgttgtgggaanatatncttgcgctgcnnggtgaagggagtggccntaaggtatgtgtnaagtngccaatgaagttgtgnagtgaagttgacattcaaagtgtacgttagggcccgcaanaaatgaacgaggaaacatgcggtagcgc

SEQ ID NO: 560821 - DNA, 282 bp, Homo sapiens
  misc_feature (175)..(175): n is a, c, g, or t
ctctagccgatcctactcccacttggttgcggcagcaaccatcataggcactatgatccaaatgtactttataacgttgggggcgaatcataaccaaaaacaagcctgcccacttagagagcgttaggtggggacccagagggagacaccagtagggttgaccagggcatcagcnctgaacactggtgtcagcaggattctgtactacactatgtggtaatccaggcaaagccaatgcaaggtggggggcaactgccggcaagaaccataagactgtgatat

SEQ ID NO: 560822 - DNA, 1266 bp, Homo sapiens
gggaacgaccgcatacgtatcagttgaccgaagagcgattatcgctcctccatgaatgactaggattctagtcgagatggatagagaacttgtgttcatggggatcatgtacgccaaggatgcaacacatgctcctgggcggcttcgtgcaggagagggcgcattgactgtgacgtcgagatagttgcggcaggtcgattcataaatttgcgccaggagaacatggtgctgaacgctgggcaaactcaaatagaacgagcttctagagagggcatcggacctaggcgagtgctggtgggacgaatgaggtgggagcctgaagatcggaggagctttcaatctagagatggtcgcttgcatgactgtctcgccccgcagtcctcatgacgtcagtgggtcgtcgaaggccatggactgtctcatcctcgtacttgcacatgtgaccgtctcgtagccgaggaacgccgcttcatatttgtgattggactgtcaaagagggtcgagataggaatggagccacaggatcttcgtgccatcgcgtgatggggcagcgtgggggcgatgggataggaccgcgtcacggaattcgttacgtgtgatgatccctcgacctgtcccatgatagccatcatccttattaacccgccgtgagcttccctgacatgcaagtggggggacgggggcccatcgaactcttggaccagagacccaacacgtcaaggctctgagccggcagatgtcctgtcatatcgaagtcacggctttctagggggtgctgggtgtatgactggggaatggaattgccataagtacatttagtctatgatgaggcatgggtagaaatgggatgatagaataaggaaatgagagaaggttaataaagaagaaaagaagagaaagaggataacaaagggggagagaaaaggtgggaatccgagggagccaacacagataaccgcaagacaaccccatcggagaccagaccatatcaagagagaagcacacacagaggaaacaacagacagtagcagacacagagacaccaaccacgaccaaagacagacaaactacaaggcagcacatgagggttggcaggaccaacacctaaaaggaacactagacagtatggcaagaataaggtgagggcaaagggaaacagagacacgaagccccggcaaggagaccaacgagcaagacgaaaacgagcaaaacagaaaagcagaagaccagagagacacagaaagaagcaagagactacacacttgc

SEQ ID NO: 560823 - DNA, 250 bp, Homo sapiens
gctactagtaaaagtttttttttttaaacctgcttagctacatttacattatgtaaaaataatggatatcactgagataagcagttgagtatttataccaataatattttatggggcgcttataatgttataatattgtaaccactgtgtactctatccattaatgctaaatgcttgccatcttgggataagggtcattaaaaaatctaggccggcaccatggctcacgctgtatccaggcttaggggca

SEQ ID NO: 560824 - DNA, 221 bp, Homo sapiens
tggaggccaggcgagcgggacagtagttagacgtagacttgcgtgtcgttcaccatctaacagagaaaggggggggagtctaattatcattgagggtgcttgagggaagtgttcctttcaaaagaagatcttaaagcactggctattgaatagggcctaagctatgtacagcatcgctggatttaacttttaagagccttgcaccttgaatctcacttggc

SEQ ID NO: 560825 - DNA, 129 bp, Homo sapiens
  misc_feature (64)..(64): n is a, c, g, or t
aaaaaagaagcggatagtgtttatggagaatgggtcctgtggagaaaaatggtgaagaaacaangatgatgatatgtttcagcagcattggcctcagagctgtggcatctctcagcatgagtgacgggc

SEQ ID NO: 560826 - DNA, 268 bp, Homo sapiens
ctccctgcagcctcaacctcccgggctcaagtgatcctcccacttcagcctcctgagtagtgggactacaggtgtgcaacaccacatctggctaatttttgtatgttttgtagagactggggtcttacgatatagtccaggctggtctcaaactcctaagctcaagtgatcctccccccttggcctccccaagtgctgggattacaggtgtgaatcaccatgcctggccttgatattttaaattaaatgcggcaaagctatgaataaa

SEQ ID NO: 560827 - DNA, 772 bp, Homo sapiens
  misc_feature (31)..(31): n is a, c, g, or t
  misc_feature (62)..(62): n is a, c, g, or t
  misc_feature (70)..(70): n is a, c, g, or t
  misc_feature (74)..(74): n is a, c, g, or t
  misc_feature (77)..(77): n is a, c, g, or t
  misc_feature (80)..(80): n is a, c, g, or t
  misc_feature (96)..(96): n is a, c, g, or t
  misc_feature (105)..(106): n is a, c, g, or t
  misc_feature (108)..(108): n is a, c, g, or t
  misc_feature (113)..(113): n is a, c, g, or t
  misc_feature (117)..(117): n is a, c, g, or t
  misc_feature (119)..(119): n is a, c, g, or t
  misc_feature (132)..(132): n is a, c, g, or t
  misc_feature (143)..(143): n is a, c, g, or t
  misc_feature (154)..(154): n is a, c, g, or t
  misc_feature (156)..(156): n is a, c, g, or t
  misc_feature (160)..(160): n is a, c, g, or t
  misc_feature (180)..(180): n is a, c, g, or t
  misc_feature (189)..(189): n is a, c, g, or t
  misc_feature (191)..(191): n is a, c, g, or t
  misc_feature (228)..(228): n is a, c, g, or t
  misc_feature (248)..(249): n is a, c, g, or t
  misc_feature (253)..(253): n is a, c, g, or t
  misc_feature (279)..(279): n is a, c, g, or t
  misc_feature (282)..(282): n is a, c, g, or t
  misc_feature (287)..(287): n is a, c, g, or t
  misc_feature (295)..(295): n is a, c, g, or t
  misc_feature (303)..(303): n is a, c, g, or t
  misc_feature (307)..(307): n is a, c, g, or t
  misc_feature (313)..(313): n is a, c, g, or t
  misc_feature (316)..(316): n is a, c, g, or t
  misc_feature (319)..(319): n is a, c, g, or t
  misc_feature (357)..(357): n is a, c, g, or t
  misc_feature (363)..(363): n is a, c, g, or t
  misc_feature (370)..(370): n is a, c, g, or t
  misc_feature (372)..(373): n is a, c, g, or t
  misc_feature (399)..(399): n is a, c, g, or t
  misc_feature (404)..(404): n is a, c, g, or t
  misc_feature (413)..(413): n is a, c, g, or t
  misc_feature (432)..(432): n is a, c, g, or t
  misc_feature (438)..(439): n is a, c, g, or t
  misc_feature (463)..(463): n is a, c, g, or t
  misc_feature (465)..(465): n is a, c, g, or t
  misc_feature (486)..(486): n is a, c, g, or t
  misc_feature (507)..(507): n is a, c, g, or t
  misc_feature (519)..(519): n is a, c, g, or t
  misc_feature (550)..(550): n is a, c, g, or t
  misc_feature (564)..(565): n is a, c, g, or t
  misc_feature (585)..(585): n is a, c, g, or t
  misc_feature (588)..(588): n is a, c, g, or t
  misc_feature (603)..(603): n is a, c, g, or t
  misc_feature (621)..(621): n is a, c, g, or t
  misc_feature (626)..(626): n is a, c, g, or t
  misc_feature (655)..(655): n is a, c, g, or t
  misc_feature (693)..(693): n is a, c, g, or t
  misc_feature (695)..(695): n is a, c, g, or t
  misc_feature (728)..(728): n is a, c, g, or t
tcccccaggtgggaggtccccagtgccaganaggtcccaaacccctccctcagcatccttanaattccangaangancancttctctcaggattangtcgcaaannanctcantcanancttcttcaacaanaatcaaaaaantcaaaaaaaantnaaangctctcggaaatccaatganctctcgganangtttcctgtcctccccggttcccaattgctgctcaanaaacctgccctggagttcannaaanaagtgtgcaaagtgctgtccctgganaanaaaancaaaaaanaagtgaanaaantgaaanganaantgcttcgcctggtggatgtcggcgagttctccgaggangcccanttccgananncctgccgctcctaagtgcttcctgangtcanctgccgcanctgtaaattctgccgcganctgganntgtgtaaaaaatcttccttctcanangatggggcggtcctgcctcantggctctgctccaaatgtcangcgccctaagantcctctgccatcgagatgacgctggtggaanttctaaaaaaaaanntgatggccttcaccctgcanganctggtctgcctgaantgccgcggggtgaaaganaaaanaatgcctgtgtaatgcagctgcgcggganaattcgacctaaaatccaaaaacaggtcttcatggaananatcggaatattccggaacattgcccagcactanggcatgtcgtacctcctggagaccctggagtggctgctgcagaa

SEQ ID NO: 560828 - DNA, 1349 bp, Homo sapiens
ttaagaaggaagaaaagagaacaggatgagctgaaacccggagctacaaatcgggctagagtcaccaaatcaggaagcagaggacatggacgcggacggtcgtgactggataacctcgaacaggagagcccgtcacttagcgtgaaaaccacgaagcaggatccaacagagacgaagctccaacgaggtcaggactcgcagacgtcagaacacgcaaacgacacacacgacgacgaccacttctatgatctgttttgactacaacactcaacacgacaccacacactgggacgacgacgacgacgccacgacgtgcagacggggacaaccgggacgaactccgtcgacaacacggacgacgcgcgtgcgtgagaagacgcagacgcaagcagagagagacagggacagacaaacacgcactcagagagcacttaccaatgcagcaggcaaaggcagcaaggccacgggcatcacagcgcgggacacgcactggcaagactacgagttgccaagagaccacgaggactagagagcgtggaagcgcaatgtgagacggggagccgggatgagagacgcaaagcagcattgcgacgtggaagcagtagagcgcaaggaaaggaggcagggaagcgcacatccaaacggagaagacgacagaagtgtagacttgccgaagagcaaaagacaatggaacaccaggcactggcgattcacaggacgccacgagcagacgagagtgaccccgggagcaggagagggacacggacacgaacaccctggacacccagaagctacagccactgcaatagccatacattagacgcccaaaacacgggcaacaacacgtatgatgagcaacaaggtgaagcgcaaccagaacaatcatgcggatgacagagacacgttacaccccacgggacacaggaacacaaaacacggaagttacacacgcaccgttatccgacaaccacatggacacaaccggtagtgtcacagaggtagacagagtgacacacaggacaaaaatgagcaaccaggcgtcggaagaggcacacgaaaagggcacaaaaagtgaaggggaaagagcaaccaagcgaggggaacatgagagacaggaacataatagtggacaagaaatgtgacaaccgtcgacacgtgaacacaacaggagagagtcaaccaccagcaaaggaagaccacagccgagaggaaacaacacacaccggatgacgagaaaatgagcgaagggacaacacagtcaaacagcagaaaaaaacgcggagaaaaacaagatacgaggaagaaatgcaccacaaacatcacgctagggaaatggacaaagaacaaag

SEQ ID NO: 560829 - DNA, 449 bp, Homo sapiens
caccagatgctcccaccagatcatgtcactgcactccagcctgggcgacagagtgagacttcgtctcaaaaaaaagaataggccaggacgggtgcggtggctcacgcctgtaatcccagcactttggaggccgaggcgggcggatcacctgaggtcaggagttccagaccagcttcaacaaggagaaaccccatctctactaaaaatacaaaattggctgggcgtggtggtgtatgactgtggtcccagctactcgggaggctgaggcaggagaattgcttgagcctggtaggcagaggttgcagtgagctgagatcgtgccattgcactccagcctgggcaacaagagtgaaactctgtctcgaacaacaaaaaaaggaatacgccagaataatctatggggatagaggtcagaatggtggtaagtcctggggtgggagcatctggtg

SEQ ID NO: 560830 - DNA, 300 bp, Homo sapiens
  misc_feature (211)..(211): n is a, c, g, or t
tttaaaagaatgacacttctggccaggtgtggtggctcatgcctgtggtcccagcactttgagaggctgaggtgggttaatcacttgaggtcaggagttcgagaccagcctggccaacatggtgaaaccctgtctctaccacaaaatacaaaaattggccaggtgtggtggtgcatgcctgtggttccagctacttgggagcctgaggcgngacatcgtttgaactcgttgaacccgggaggcagaggttgcagtgagccgagaacgcaccactgcattcgagagtgagactctgtcaga

SEQ ID NO: 560831 - DNA, 320 bp, Homo sapiens
  misc_feature (1)..(1): n is a, c, g, or t
nacacaggcctgggggtttgggcccccccctgccccgggggggccgggggggtggttttgggcccaaaggcccacccctcctttttttgtttggagggaaaggggcccaaatcccctatagggttcggggccggtttgaggtttttggggggacttttccagggagaattgctttttccccaaactttggggggggggggggtccccccgggggcagggccgcccccccggggccggcggggggggggtttccccccccttttcgggggccccggttgggggggtaagggttggttgggaaaaaatttgtttttttggga

SEQ ID NO: 560832 - DNA, 956 bp, Homo sapiens
atccccaatttgtgttcggactctccgttaccttcggtaacccctagacgtgtgccataaggcactggggcacccaaaaccatggggtcgcaaagagtgtccggtgccgcgtgacgacccccgtgagtactgaggcccctctggtgtaagcaagtgggccggcaacaattacgggggttttcgagctataccaacggaccatcgtccgctcaaggctatgcccccggggagtgctttcagcactgcaaactttacaagcaggtttcttgtgcgcccccggattagccgtacaagcaccaattttttgcacagggggcggctcttccagagaatttgacaccacagtgtttgagcggctacacgggctcttaatatgccgctttctccggaggaatctaaccagtccaattattaatccgtccccgtggaacacaggaccaccaattacgggcgacaagtggtgaagagaacctagcgcttttcatgcgggtcgtgcgccactataggacacatatacatggtacatcatttggcgtgagccacaactcagcctaaaagcttacatgctggggaccaggaagtctaagaagtaagcacatatcttcttctgccccctgcacaggtatcaaccatggtgttatgcatgccacgtttgcagcacagccccaccaagcaaactttcatattgtgccactgacgatcgcaccccaaccgtggacactttcgggaaaccacacgcctgggcggtgccgcgacactggtgcaagcaccccacctaaagatgcgccaggagaacgccaacagatgggtgcacaacaggggagatccctactctctctttggattgttctgttgacaagaccccggaggatcggtttacaaaggtaacaaaatttgggttcttcgaacaaaacacccccatagaaagcggaaaaccggaaaacaactacataaca

SEQ ID NO: 560833 - DNA, 425 bp, Homo sapiens
tggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcctgctgcctcctgctctctggaggtactgagacagggtgctgatgggaaggaggggagcctttggggggccaccctgggcctgtacctatacagggaggccacattccaccccacctatatgatctgggtccctgctcccctttgggggtgtgtgggaatgtctcaatacactttatggaaaaatggacaaaaaaaaaattgagatagaggtttctaactgctataaactgaccccatgtggccccggcctggttaaacctctactagtg

SEQ ID NO: 560834 - DNA, 146 bp, Homo sapiens
ccgtctgctggatgatccgctttaatactgcttgtttggctggatgatccactttagatactccaaggtatgcaaccatgatgtgtgcaggctagctctctccatgccagacaagcagtatttaaagtggatcatccagccagacg

SEQ ID NO: 560835 - DNA, 384 bp, Homo sapiens
actcgttggctaggggaggctgactaaagcacttgctagggcaatttggcaatacacacgcaaagatgtcaaataccgtttgctctaataactgctactgctaggaatctacctttcagatataaacacaagtgtaccgaaatctttcgtattgaaaatgtccacggccgcactgaatataccagcataaaaatctgcacactcaagtgtccatcagcagggactatgcagtgaaatagtggttcaaacctcagcatcaccctgctgatgtaggacaccttcaggtatggcctgtactacatgaagcacctcccagctcaacggttcacacctgctggggtcctcttctgatcacttctcctgtgcaaccagtggaacctggac

SEQ ID NO: 560836 - DNA, 422 bp, Homo sapiens
tggaatcataggttctaagtgagagaattgaaaagatatgttcacacaaaaacttgtacgcaactgttcatagcaccatagttcataatagccaaaaaccagaaataatccaaatgtccaaatgatgtgtgaataaacaaaatggggtctacccatacagtggaatattattcagccagaaaaaggaacgcagtactgttatatgctgcaacatgaatgaaccctgcaaaacccgcataagtgaaatcagacagcacccacacagacaaatactgtatgcattacacttatctgaggcccctagaataggcaaattcacacagacagagcagcacaaaaaagtttaccagtataacaaaggttcaccaaagactagggggcgagacaggtaggaagttcttcctctatggattcatttgggg

SEQ ID NO: 560837 - DNA, 178 bp, Homo sapiens
cttgtgcacgcaatacagcaagggagacacgggaatgataaagaagtataaagcgttgaagctactcaggaggctgagacaggaggatcaactgagcctgggaggtcgaggctgcagtgagcaatgatcaggccactgtactccactatgggtgacgacagagtgagactctgtacca

SEQ ID NO: 560838 - DNA, 317 bp, Homo sapiens
tagaggatcccatggtcgcagtatcgagggcgcataagccatgcgatcagataaaaacactgaactgacaattcacagacccaatatctacaatacaaccaaccaagtcattattaccctcactgtcaacccaacacaggcatgctcatcacggaaaggttacacaacagtaaacaggaactcggacacatctctaccccgacctgtttaccaaacaacatcaacctactcagcatcaccagatattagcaggcaccgacctgcccagatgacacatgtttaaacgagccgaggaaacccatgacccgatgcacaag

SEQ ID NO: 560839 - DNA, 908 bp, Homo sapiens
cgtaagggtgatccaccagcctcagcctcccaaactgctgggattataggcatgagccaccgcgcccggggaaatatagggaacatattctatcatggccacgttctctgtggacagcaatgccctgagcacatagtaagcgcttgcgtcgggaatggagttgcttttgggtcactaaactctgtgcgccccgccccacgctaagctactttccctctcctctcttcagtcggagccttaaatcaactcagtgagacatgacactctatcatcccacttttacaggggaggatactgaggcacacagaggggagtcaccagccagaggatgcatagcctggagcacagaggaagttggcatagaggccggtcccttccttgggccccctctcgtttcccttccccagatatggaggcaaagccagaatccatcatcggccccatttacccaattctgtacaaagacccttgatccgccatgcatactctgtagtatgacatcagtcctttgtctaccagctctggccaggtcggtctatggatgggtgtgaatggggtagtgtcgacgtcagaatcttggtcctcgacttgtcgtatgcatcgtctcacttcattacgtgtttcctgaggtcccctggtaggccccgggtctcggcgcctgtggcgcttgtcatgagcctggctcttgctgtccgagccgttgcctaggtgcgctgtgtcctcgcttggctatcggcccgactagcgaccaaggggaattacagcgactccggggtggcagggaatgcccactagcgcgagctagtggagacgtagaccaacagggcagggccgagggggcacacgcagccaggccagggagagcggagaaggcattacaagaagcaagtggaattagcaaaaggcga

SEQ ID NO: 560840 - DNA, 132 bp, Homo sapiens
tatcagcgctccataaagagcgcccgtaacgagcgctctaacaccctccgataacgagcctctgtaacgagcgcctaacgagccctcctaacagccctccgtaacgagcgtgtggtggaggtccgtagcggt

SEQ ID NO: 560841 - DNA, 387 bp, Homo sapiens
  misc_feature (104)..(104): n is a, c, g, or t
  misc_feature (369)..(369): n is a, c, g, or t
ttactgccaaaacttgatctgcatgaacttgagccacagcgcggaaaccgtcatctggtttggtggcgctgaaagtaatcttgcacggctcgcgaacgctctantggaaagagtaacccacgatttccgctgaaatgctctgaaatgcgattgtgacggaatttttttcaaaaattttttcggcaggtttgacggaaatgatggcgtaaaattacgctccggcgatgaaccggtcatcggctccgagggcgaccatcgcagcccgcgccgattccgccatcaaccgcttcgccttaagcacattccgacctcgaccggtcggctgccagggtccctctcgccgcaccttcggtgccggagccggtgcanccttgatgttgatcggag

SEQ ID NO: 560842 - DNA, 1285 bp, Homo sapiens
gtcgggggtttcctgcttcaacagtgctgtggcacggaagcccggcgctcgttccccaccccaggccaggccgaacacatagccagccctccgatcacctcttcaccgcaccctcggactgccccaaggacccaagagcgccgatccagcagcacagaagaaagaacaccgccggacgaccgacgactcatccattaggtcgccgccatgacgagcgcgtccacctcgcaggtgcgccagaactaccaccaggacatcagacggccgcacatcaaccgccagatcaacctggagctctacgccatcctacgatctacccttgctccactgtctttcacgtactgtagaccgcgatgcatgtgtgctttgaagcaacttgtgccaaatacttagattcaccaatctcatgagcgacgcagggacacactgctgagaaacatgatgacgacctggagaactaccgaggttggacgcagtcttccttcaggatatcacagaaaccagcactgcgcaccacccgggcacagcgggcgcagacatgcacacggagcgtgcatacaccatagtgacacacaaaactgtgcaatacaggcaccaacgggaacggcaaaaacagggcaatgcacaacacaggacccacaattggtgtgacataccggagcaacctaccccgactgaccaggcgcaggcccaaaaaatggcggcctctgacaactgcgcatgagggaccacgaaacggaagggcggaaacttaggagacgagccggagaaagtgatagacagcaagccagcaataccgggagagggagaacatgccagcaaggactgagcgaacaagtgatagtgcaaaccaagatgggcgctacagccgcatacatgtcgctatgcctattgctcgcttctcttgtcctcgctgctactccgcacgacacactacacttaccacacctcagagcggatgacccacacgacacgtacgaaaacaagaaaggagagggaagaagagagcgaaagaaagcaagacgcaagacggagaggatggcacagtaggagcacgaggacgcaaagagaaaatcggggcaacagagagagcagacagaaacaggagagcaaggagaagaaaggaaggtcaagagggaaggcaaagacagggagaagcgagacagacagaacaggaaagccacgaatcggaagaggaagagaagaaagagcaagagagaggaagaagcagaagagaacaagtcgaagaagaggaagaaagaagaagaagcaaacatagaagaga

SEQ ID NO: 560843 - DNA, 313 bp, Homo sapiens
cgtttgcagcaactgataacaagatagagaaaatgttagcatacgcgttctcctaacagtgagatctggggggagtttgttttcctgcttctttatactctacaaaattcccacaacgaacgccataaaaaaatgaaacaagatcataaaaaagagctggcatgtttggttacctgtactttggctctggggagctgacctttgtagggcgggtgctcttatgggggctgtaatgccgtggcgcccacaacctcacagggcactgtcttttaaccctacgtggatttcccaagcacgggccaagtcacctact

SEQ ID NO: 560844 - DNA, 457 bp, Homo sapiens
cacgagggaatccaagacaggaggaaccccttctctggctgagctgggccatgcctaacagtaggacgaactcgaacagcacagagttttttatagatgtatagatgtatcaagccaaatgtggagatgctaactgaacattctggggaactgggcaccaggagtgccttcatacactgtgccccagctctcttccaaaagagaagtgggtggacacactggaactgtttggaggccccaaccacaggatagctgcacattctctggcttatggtgatacttttgccctccttgtgcccctctcagctttccatccccagcgaggaagaaagaatggcactcttgggcttggtccagaattagagttattacagcaagagagagcttaagaagcatgagggcaacaagattgaggccttaatgccaggagggagggttttggttgctggcgcttgtg

SEQ ID NO: 560845 - DNA, 833 bp, Homo sapiens
  misc_feature (27)..(28): n is a, c, g, or t
  misc_feature (30)..(30): n is a, c, g, or t
  misc_feature (37)..(37): n is a, c, g, or t
  misc_feature (41)..(41): n is a, c, g, or t
  misc_feature (54)..(54): n is a, c, g, or t
  misc_feature (57)..(57): n is a, c, g, or t
  misc_feature (88)..(88): n is a, c, g, or t
  misc_feature (96)..(96): n is a, c, g, or t
  misc_feature (98)..(98): n is a, c, g, or t
  misc_feature (115)..(116): n is a, c, g, or t
  misc_feature (119)..(119): n is a, c, g, or t
  misc_feature (130)..(130): n is a, c, g, or t
  misc_feature (145)..(145): n is a, c, g, or t
  misc_feature (150)..(151): n is a, c, g, or t
  misc_feature (160)..(160): n is a, c, g, or t
  misc_feature (162)..(162): n is a, c, g, or t
  misc_feature (169)..(170): n is a, c, g, or t
  misc_feature (172)..(172): n is a, c, g, or t
  misc_feature (180)..(181): n is a, c, g, or t
  misc_feature (187)..(188): n is a, c, g, or t
  misc_feature (191)..(191): n is a, c, g, or t
  misc_feature (196)..(196): n is a, c, g, or t
  misc_feature (199)..(199): n is a, c, g, or t
  misc_feature (227)..(227): n is a, c, g, or t
  misc_feature (284)..(284): n is a, c, g, or t
  misc_feature (309)..(309): n is a, c, g, or t
  misc_feature (339)..(339): n is a, c, g, or t
  misc_feature (341)..(341): n is a, c, g, or t
  misc_feature (368)..(368): n is a, c, g, or t
  misc_feature (406)..(407): n is a, c, g, or t
ggctggatcaggctggtgtaatcgcgnngnagctgcntgcngtccggttatctnctnccggtgagaacgaaccgcagtgtccaccggngaggagcnanccctgtcccggtcagannaangacgacgaggnatacctgggagcggncgggnncgggctggncnggccggnngngggctggnnactctnntcntccgnttnctgctgtctctgggaactgggtgccagngctgaggggcttccagcggacagggacccccttccccggctccctgcccaccctgcnggggagggcggaagatgccggtgangaagaagagaaaatcccctggggtggcagnancagtagcggaagacggaggcctcaaanagtgtaaaatctccagctattgcagatcccaacccctnntagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgtagttttagcgtgaaattggaggctgaaagcatgggattttttaccaaggaagaatggttaaagggaatgacttcattacagtgtgactgccacagaaaagttacaaaacaaatttgactttttggctcacagttgaatgatatttcgtcatttaagaatattacagatatgcctttgatttgcaagggataaagatcaggagaaggctggatattgatactgctaaatctatgttaggtcttctggttgggggggcatgggcactgttttcagcatt

SEQ ID NO: 560846 - DNA, 834 bp, Homo sapiens
ctagtaagcctctacctgcacgacaacacataatgacccagcaatcacatgcctatcatatagtaaaacccagcccatgacccctaagcaggggccctctcagccctcctaatgacctccggcctagccatgtgatgtcagttccactccataacgctcctcatactaggcctagtaaccaggcagcactaaccatataccaatgatggcgcgatgtaacacgagaaagcacataccaaggccaccgaggacactcacctgtccggaaaaggccttcgatacgggataatcctattgtattaccgtcagaagtttttgttcttcgcaggatttttctggagcctggtctaccacacttccaggcactagcacacctagcccgccaagtgtaggagggcacgtggctcgcccaaacagtggcatcaccccggtaaagtccccgtaggaagtcccaactcctagagacatccgtattactcgcatcgggagtatcaatcacctgagctcaccagtagtctaatagaaaaacaaggcgaaagcaatgtaatgcaagcacggctgtattacaagctgtactgggtctcatatgtttagcctcgctagaagcctcgagagtacttcgagatctcccttaacattttccgacgggcatctacggctcactcatgttttgtagccacaggctttcacggccttcagtcattatgggctcagtttcctcactattggttcctcgcaagggaatcacttgaatccacaacgtcacttgcgtcgaaacgccgccgaaatggcgttgaaaatggcggaccatcgggggccacatgggggggcccg

SEQ ID NO: 560847 - DNA, 312 bp, Homo sapiens
ttaatgaggaagagatggacaatagaaaagataatacataagctccaggagaaggaggaactactcagcacttgcaagcccagcttactcggcgcacaggacgaacaactctgcacgtgagttctacaggagtatggaagaatttgtaactgatgatgcacagtctcctggagaaggatgaatccattagcactttacaagccccgctctagccatacacaggcagagcatgctgcacaggtggtccgtgagacacgatgcccgctttgaaacacgagttcgtcttcatgaagatgagctgcttcagttagt

SEQ ID NO: 560848 - DNA, 376 bp, Homo sapiens
tcaacggaactttagggtttcaaataaatttaaatgctttttttttctgattctgtgaagaaatgttattggtagtttgataggaatagcattgaatctataaattgctttgggtagtatggccatttaaacaatattgattcttcctatccataagtatggaatgttttcccatttgtgtcatctctgatttctttcagcagtgttttgtaattttggtcgtagagatctttcatctccctggttagctgtattcctaggtattttattcttttggtggcaattgtgaataggattgcattcttgatttggctctcagcttggatgtcgttggtgtataaaaatgctaccatatttggtatattgattttgtctc

SEQ ID NO: 560849 - DNA, 369 bp, Homo sapiens
cagtacacgagggagaggagttgaacctctggtaatataggttcaagtctcacgcaattgccggtcgctgccacccgtgtacgtgccgcttgctctagtggctggctttattatgcgttatttaggtcgagattatctcattcattatctctgagacgcgtatgtgaggttggtcccattgctctggtcctttcgtactgcgagaaatctcttataaatagaaaccgacctggtatagctccggtctgaactccgatcacgttcgactttaatcgttgaacaaactaacctttaatagcgggtgcaccatttgggtgtcctgatccaacatcgaggtcgtaaaccctattgtcgatcgtctacggttcg

SEQ ID NO: 560850 - DNA, 127 bp, Homo sapiens
accctgtcaaccttgcgggtcctgacttggaaaaccccttgcggatacagagtaaagcagtggcggatgcttatagtgaggtatcctaatcatcactttaaccttgcgttcgctgctcaactgcgcg

SEQ ID NO: 560851 - DNA, 673 bp, Homo sapiens
  misc_feature (47)..(47): n is a, c, g, or t
  misc_feature (93)..(93): n is a, c, g, or t
  misc_feature (104)..(104): n is a, c, g, or t
  misc_feature (121)..(121): n is a, c, g, or t
  misc_feature (131)..(131): n is a, c, g, or t
  misc_feature (135)..(135): n is a, c, g, or t
  misc_feature (155)..(155): n is a, c, g, or t
  misc_feature (159)..(159): n is a, c, g, or t
  misc_feature (177)..(177): n is a, c, g, or t
  misc_feature (182)..(182): n is a, c, g, or t
  misc_feature (234)..(234): n is a, c, g, or t
  misc_feature (285)..(285): n is a, c, g, or t
  misc_feature (302)..(303): n is a, c, g, or t
  misc_feature (305)..(306): n is a, c, g, or t
  misc_feature (334)..(334): n is a, c, g, or t
  misc_feature (338)..(338): n is a, c, g, or t
  misc_feature (353)..(353): n is a, c, g, or t
  misc_feature (360)..(360): n is a, c, g, or t
  misc_feature (365)..(365): n is a, c, g, or t
  misc_feature (396)..(396): n is a, c, g, or t
  misc_feature (416)..(416): n is a, c, g, or t
  misc_feature (445)..(445): n is a, c, g, or t
  misc_feature (569)..(569): n is a, c, g, or t
  misc_feature (607)..(607): n is a, c, g, or t
  misc_feature (613)..(613): n is a, c, g, or t
  misc_feature (654)..(654): n is a, c, g, or t
tccccactccctcccaagtacagacaaccttccgtcctgctccagtngaaggggtgacaacgattcctgaagcattctgtctgaatctaatgntggctctaaanagaaacagggaaatatngctggatggntgtnggatgatccaattccttggnagcnaatgtttgtacccctggnattanctgtttttcccactaaaataagcactgagaggcaagaccatgtccctctganctatttgccgaagacttcaggctggaggaaaaacaacagggcttgatagangtgcaaggtggatccannannaactcttttttttttttttttttttttntgantgaacactgactgcnagtttanatctnaggtgtgtagggagcgtggaggaggcaaatnctgtttggagaaagccagtntccaacacagcacttggtaaacatcaggnaattttatattctgagtgacaggcaccatgggccacgctgagccccactcgctcatctggctggggtcatcagagggaggcccaacccaggatctcctgtccatgggctggggagcagcaacantcaggagcgagggcccagcccacctcccctaggaggtngagggnaagggggctgagtggttgtcaagcgtggttctccccatctncgacgtggcggtacaaaga

SEQ ID NO: 560852 - DNA, 436 bp, Homo sapiens
  misc_feature (62)..(62): n is a, c, g, or t
cgaccagcaccataccccctccccaacatccgggctgatagggatcaaggaggcctgcctcncccagctgggctggggctcctgtcccccactgtggtgtgcctggggcctggccaggactcccagtgatgccagaagccctggggggaagccctgctaccctggaccttacaccgggtgtgggaatcagcctctgccccgccccctccagccccatctctgtctcaaggagagcagggtaggtgaaagtctagagaaagaggctacctgcccagggtcacagcaaggctgggaccatggcaagcttggaaccaggacttctatctcccaaccccagcagccagaatactgtgccctcttgctttgggggtaactcccgaaaaccctgccttacctctcccttccccctaacattaaactatttggcatgaaaaaa

SEQ ID NO: 560853 - DNA, 265 bp, Homo sapiens
ttcgaccggagcaggtaggtggaggtcgcagtgagccaagatcgcgccactgcactcaagcttaggcaatagagcaagactccatctcaaaaaatgaataaataaataaaatctgggtttcaggccaggtgtggtggtgcactcctgcaatcccagcactttgggaggctgagatgggcagacagctcgacctcaggaattccagactagcctgagcaacgtggcgaaaccccatgtcttcaaacattacaaaaaaatagctggg

SEQ ID NO: 560854 - DNA, 277 bp, Homo sapiens
  misc_feature (126)..(126): n is a, c, g, or t
tgctgattaagatcgtgatactagatctatatctctgtcttgctctctctttggttttgttcttctctctagcttgtctcgtctgttgtctattgtttctgtgcttgtacgcccagttcgttgcanatcctagcgtatgctcatcgtggtgatagaagttgcaagatgtgcagacttgactgccagaggtcaggccacgacgcaaagtatcataggcatagatactggatcgggagaatactcggggtgtcatttctggtggatcacgtgcccttga

SEQ ID NO: 560855 - DNA, 631 bp, Homo sapiens
  misc_feature (24)..(24): n is a, c, g, or t
ctcaacgctttatacttccatggngcaagtaagacgggaagtgtttttcatcttcttagagtttgggatatatctcaacgctttatacttcatacatgtttttgcaaggattaggaggaaatagttggttaaacaaatccttacaccatggataaataggggcctcaaaagactgacaaacatgttgaacttggaaaaatcccaagaccatgcatcacaatcttgacactacaagtatctgttccccacccaactgagcagatgttattgctctcaaagctccatttttcagccaatgcctcctgctagatttacccactgaggatttctgattgatagctatagagaggagagccaccttgaagttacaatttttaaaaaatcagccgctagattttgggtttgaacatctcaaaacgataggcccctttctcccaatttgccatggatatgtcccaaacagtctgtgcaagtctgtgcttcagattcacagcccttagaaagaggaaaacataacttgacatctaccttcctcactggcttcatgaagaggattaatgagttcataagcattaagtactttgcaagccacaggtgactgggaaacattattaggaccacatttttctaa

SEQ ID NO: 560856 - DNA, 820 bp, Homo sapiens
  misc_feature (325)..(325): n is a, c, g, or t
  misc_feature (363)..(363): n is a, c, g, or t
  misc_feature (365)..(365): n is a, c, g, or t
  misc_feature (377)..(377): n is a, c, g, or t
  misc_feature (389)..(389): n is a, c, g, or t
  misc_feature (394)..(394): n is a, c, g, or t
  misc_feature (400)..(400): n is a, c, g, or t
  misc_feature (403)..(403): n is a, c, g, or t
  misc_feature (417)..(417): n is a, c, g, or t
  misc_feature (428)..(428): n is a, c, g, or t
  misc_feature (454)..(454): n is a, c, g, or t
  misc_feature (464)..(464): n is a, c, g, or t
  misc_feature (466)..(466): n is a, c, g, or t
  misc_feature (473)..(473): n is a, c, g, or t
  misc_feature (478)..(478): n is a, c, g, or t
  misc_feature (485)..(485): n is a, c, g, or t
  misc_feature (487)..(487): n is a, c, g, or t
  misc_feature (512)..(512): n is a, c, g, or t
  misc_feature (521)..(521): n is a, c, g, or t
  misc_feature (530)..(530): n is a, c, g, or t
  misc_feature (537)..(537): n is a, c, g, or t
  misc_feature (539)..(539): n is a, c, g, or t
  misc_feature (542)..(542): n is a, c, g, or t
  misc_feature (550)..(551): n is a, c, g, or t
  misc_feature (560)..(560): n is a, c, g, or t
  misc_feature (564)..(564): n is a, c, g, or t
  misc_feature (590)..(590): n is a, c, g, or t
  misc_feature (594)..(594): n is a, c, g, or t
  misc_feature (603)..(603): n is a, c, g, or t
  misc_feature (637)..(637): n is a, c, g, or t
  misc_feature (735)..(735): n is a, c, g, or t
  misc_feature (766)..(766): n is a, c, g, or t
aaacaatagtgctaggtacgaggctgggtgttgggcgcaggcccgctgcggcggactgggcggcggaagttcgacggcgccgggcgagtggctgttgagcggcgccgcgggagttccgcaggtttcccgtgttcgcagcggagccggaggcagctgaacccggccgtgggatcccggataggcggtggaggggacccataggacgcgttaacatggacctggaaaacaaagtgaagaagatgggcttaggtcacgagcaaggatttggagccccttgtttaaaatgcaaagaaaaatgtgaaggattcgaactgcacttctgganaaaaatatgtcgtaactgcaagtgtggccaagaaaagnangatgtcctcttnagaaataaaaangatcnaaaagnggnaaaactttttgaanaaacaaaatanaacacactgattgcaaaaaaaaagtnagatggaatncncatgtanaaacnaaatgtnanaaaaaaaacgaatccagttgcagcnaagaagaanatctccatnaataaananacntatgagtnngatccaccngacnagaaacaagaattggccaggaagtanatgnagaaactanccaaagaaaagcaaaagtagcaggctcagaaggngcacagtaccggaagaagcagctggcaaagcagctccctgcacatgaccaggacccttcaaagtgccatgagttgtctcccagagaggtgaaggaganggagcagtttgtgaagaaatataagagcgantctggggagtaggagatgtcaaacttccctgtgagatggatgcccaaggcccca

SEQ ID NO: 560857 - DNA, 590 bp, Homo sapiens
aaacaatagtgctaggtacgaggctgggtgttgggcgcaggcccgctgcggcggactgggcggcggaagttcgacggcgccgggcgagtggctgttgagcggcgccgcgggagttccgcaggtttcccgtgttcgcagcggagccggaggcagctgaacccggccgtgggatcccggataggcggtggaggggacccataggacgcgttaacatggacctggaaaacaaagtgaagaagatgggcttaggtcacgagcaaggatttggagccccttgtttaaaatgcaaagaaaaatgtgaaggattcgaacttgcaactttcctggcagcaaacaatcattgtccgataacttgctaacgtgtcggcccaaagaatgaagcatgcattgtccatccttggatgcaagttgaaacgcatgtgcattcggaaacaagtagaggggaaacacacgtattcttgtggaaatgaaccatcgccaaatgttatttacccaaacataccttggattttggcgaaaaaacctaaacaatgttcacgaattgggaaaattactcccaattggttattaaaaacggccaaatgggttac

SEQ ID NO: 560858 - DNA, 742 bp, Homo sapiens
gccgaaagcgatgaaggagagctcgctgcccctccgtaaagctgaagtcgcaaggggaaggctttaaagacggccatagaatggccgggtggaaaggtgttcacagccacaaaaagaaggaacgatccgcacgtcaccgcaccttccggtcggccgaagatcgctgcgactccggatactgaccaaatatcctcggacgagcgctcccagcgagaaacatagctctgaccagcgtatgctatcatgcagagtttgtccgctgaccagcgtgagctcgtgctcgatgaagaacgcatagaacgacgaaccaacatcgacttgtgttcatggtgggatgttgaaagcgcaaacaagcagccagattaaaccaggcgtgtgctgaagctgtatgacattgatgtggcgcaaggtcaacatcctgattgcggtactgatggagagatagataggtatatgttcgactggtgtcctgatgacgagtgcgtttggatgtagcagagaaaagttgggatcatctaaacgtgagtccgagtgtgcctaatgctgaatatttatagtatatatattctttgcagtataaaagatataactgaaaaacagctgtcattattcctgtagtatcaaccgggaggacatggaagaggaccaggaaaaatgtacgtgacgccgttcgggcgaatggggaaaaaatgagggtgccaggacttagagcgatgaaaagagtgaagcaaggtgccgagga

SEQ ID NO: 560859 - DNA, 1653 bp, Homo sapiens
cctgttgttgtgttggtcggcgttgcgtggtggtatgttgtcgcgtgggttgtttgctgtgtgctgtgtgttcgtgtgctctggttttattattctcgtcagcgtgactccatggttggtgtttgttctcgcgccgccctgcatgcttgcttgtcgctacctgttgtttctgttggtggtccgggcggcggccggtgtgtctagtgtgggtggttggcgcctacagttgctgctggctgtgctctttgttgcaggttaggtagcgcttgtgggtcttccttcctgggcgtggtccgaccttgtggctcggttgggtgtcgcctgtggtcgcttcttatatcgccgccgtgtggtgactgttttggtgtatcggcggcggtcgtgtggtgagaacacactgtttgctgattgtggtgcgatgcttggtccggcgtgtggtgttgtaatgatgtggaggttgtgtttctcttgggtggagcagtcgtagtctgaatgtgtcgtgcctgttggatgactgcctggatgcgtgttgcttgttttgtgttgtgaggggtgttttgtgttctcgaggtgaattgtgagggcctcctggttttgtgagaggagtatggccgtgccagagtggattgatgcgcggggtttggttggcttctgttgtcgtctgtttgggtccgactgtgctggtgttggtgctgttgtggtgttgtttctgttgtggttgtgggggtttcctccctcgtatgcgtgtttttgttgctgcgcccctccgtgttttgtttcgccgcccatcaggggtcgttcgtgggggggtgtgccactggtggaggggtgtcggccacggctttgggggtgtgtgtcgcatgtctttatctcacgtggtcggttctttctcgttgttcaacatgcatctctctgtgggtggtgttgtcgccgcagcggtgggtgtgagttgtatccttgtttgggggtcgctccacgttgagtgtgtttgtgagagggtcttcgcgcgcgtggtgagagtcctcaggagagtttttgtgcgggctcactgtgtgtgcacacttctcgcacgccgtctgggggtcacacaccgcagtgttctataattgtttcgctggtgtgtgcccataataaaaaggagagaagatgttgtgttttgtgtgtgtgtccctgtgtatatatatatataagatatatgcgcctctatagggggttgagataggcacatatatatgggggtcccacacatgagatgtgcgcaagatgtgtgttgtataagagtgtgtataaggcgctcatgccacgagagatatgaggagaactccgccttttaacaaatacataaataagataaaagttccacatgtgtggcccacatggtgacaaagcggttctgattatatggaggagaacgccaaattcctccacggagaaattaagagtataaatataaaaatttaataagacactctgtgcaattaatttgtttaagtaaacgtgcacgggttagcacccgaaaagttctagctgaatttaactgtgtattttggcacctgtgttttataaaaggtttattgtttgatgtttttaaaggtttttgaaatccaggaattaaatcatcccttaataaaatagttccaaattcatatttta

SEQ ID NO: 560860 - DNA, 305 bp, Homo sapiens
tctacttgtcaaacatggacctaggttcagaaagctatttaattttgcttttaaatcaatataatatttaccccctattcacaccaatagtaagatctgaattcttactatcgtgaagcaaagttatcattacacagagaaaaaaaaattctctttttcataccagccccctttcccactggaacatcttagtgggaaaatgactggcattactgtttgttcttacacacttggtccaggctacatgagcagctgatctacctaaatcctaaataccaaatacagagcttcagggttactgaaga

SEQ ID NO: 560861 - DNA, 448 bp, Homo sapiens
  misc_feature (77)..(77): n is a, c, g, or t
  misc_feature (136)..(136): n is a, c, g, or t
  misc_feature (223)..(223): n is a, c, g, or t
  misc_feature (354)..(354): n is a, c, g, or t
  misc_feature (358)..(358): n is a, c, g, or t
  misc_feature (383)..(383): n is a, c, g, or t
  misc_feature (419)..(419): n is a, c, g, or t
  misc_feature (421)..(421): n is a, c, g, or t
tctgcaaaactcttttcccaaccggggtcccccttgttccagttctggttgctgtttagtttcccctggaggtattngcaaaccaccatggctgggtaaccaccgaatcagcacagctggtccccttggtcttccntgtatcccagtcactagtcctccctggtccaccccaccctcatcctcaggagccacagccatttcttagagggtttcaaaaggacanctttggcgccttttccttctaacctttgagtccagccctttccagttttcattcactcgaagtaactgcactcaagctgtgctcaaaatcggcaacgcatttatttacaccaagcccttcccattgggggnggantgctgaagaaaatagcagacgttgnggggtctctctaactctgggtatcccacagatgcanangggagaataaacctgaatattattacc

SEQ ID NO: 560862 - DNA, 123 bp, Homo sapiens
agtctgcacagcgttatatctgtgggaaacttctggtgggaaaagcgtactagatggtacgattagtcgtttcgcgcctactagcctggtcgggctgatcgattagcacgtcaggacctgcta

SEQ ID NO: 560863 - DNA, 101 bp, Homo sapiens
cccagacttcggaatacgaccttttggacgctctggattgagggtagtgacttctttgatagtttgcttcagaagctgcaggttacttacaagttcaaact

SEQ ID NO: 560864 - DNA, 241 bp, Homo sapiens
tactactactaaattcgcggccgcgtcgactttattctttttttttacctgaccgtactcctcaaaatccaaattgttggtgcatacatttaaaaaaaaaaaatttaatggaaatttccacctttgttcgaacacataaagtttgccatgaccaatataacattacaaacgtactgtgacaaaccattaataaagaaggattactagaccaggagcggcggtgcatgcctgtagccaagct

SEQ ID NO: 560865 - DNA, 1138 bp, Homo sapiens
  misc_feature (1019)..(1019): n is a, c, g, or t
  misc_feature (1022)..(1022): n is a, c, g, or t
  misc_feature (1029)..(1029): n is a, c, g, or t
  misc_feature (1035)..(1035): n is a, c, g, or t
  misc_feature (1056)..(1056): n is a, c, g, or t
  misc_feature (1059)..(1059): n is a, c, g, or t
  misc_feature (1065)..(1065): n is a, c, g, or t
  misc_feature (1074)..(1074): n is a, c, g, or t
  misc_feature (1077)..(1077): n is a, c, g, or t
  misc_feature (1123)..(1123): n is a, c, g, or t
ggtggagggtgacgccatgggtggggcggagcgtctgggatgcgctgggagcctaggatccccgacagttttgcagaacactgaaatctatggactctaaaatggacttcatttaaagaaacccacggaccattaatggacaaaaacatgagtcaatatgtattgtggcattcaaatcctagcactctgggagagcatcaagtaccacgtttttgaagaccatggcctatcatcattatgcattcaagatttgagtttgaataacctcatcaagacttagatcttcttcagaagcttcaagtctcatctgcattaaagctctccattgaaccctctcacaaaagtacaagcttaaaggggctaaaatccattaatacattccattttatatcccttcctctgacttctcttcaatttccttggcctctagggtccttcatattgcttacgttcctttagactagagccaaggagacagtgctttccaaaaaaaaaaaaaaaaaaattgtgttctggggccataagttttcattgatagagaagcataaatttggtgaatttagaattaggtcttttatcatatcctataaaaagttgagttaacaggctgggcacggtggctcatgcctgtaatcccagcactttgggaggccaaggcagctggatgccccaaggtcaggcatttgagaccagcctggccaacatggcgaaaccccatctctactaaaaatacaaaaattagccaggcatggtggcaggcgcctgtaatcccagctactcgagagactgaggcaggagaatcacttgaaaccaggaggcgggggctgcagtgagccaagatcacgccactgcattccagcctgggtgacagagcgagactccgtctaaaaaaaaaaaaaatgttgatttaacaatacgggaatgggggtgaagcggtaaaattgttttgggttacattatactctcagaagctatgtggtttagagaaaagggcccccaaccacaaaagttagtggttnttnttctgtntgcttngtactaggtatatggtaactnaanaaagtnacttaaccnctntgaaccttaacttcgtcatctataaagtgaatttaaattttccccnggcctacttaaaggg

SEQ ID NO: 560866 - DNA, 520 bp, Homo sapiens
agtctggtcaaactattcccctgcctcagcctcccaagtggctgggactacagcacgtgccagcatgcctggctaattttttgcatttttagtagagacactgcagcgggataattaaggaatcagagagaccggaggggttgaggtggaattatttaattgtttaggtgcatcaacccagtcagattaacatccaaaggactgagccttgaacaaaaagtcaagctaccttttaagcatttcgtggggtgggggtagatctgtgcagggggaagcgtattacagaagcaagaaacaaagacagttattcagttaagacatgcattacatcatttcttactttttaaggaacaacatgctttacgacttgagattatctgtctagtgaccttgcggctgcacagctagagaaacagggtcttcacaatgcctgggaagtggagagataaggctcactagccacagtgggaaaaacaggcagttaattttaaaggactctcagtcgtgaggactcgtcagt

SEQ ID NO: 560867 - DNA, 413 bp, Homo sapiens
  misc_feature (71)..(71): n is a, c, g, or t
  misc_feature (125)..(125): n is a, c, g, or t
tcggcagctatcggtcatgtgatgtccactaaattggacatctaaatgtctgtgtagtataactttattcntaatgagtggtatctcagggtacttaggtctgtacattgacattctgagttttnagttttgcagaacactgaaatctatggactctaaaatggacttcatttaaagaaacccacggaccattaatggacaaaaacatgagtcaatatgtattgtggcattcaaatcctagcactctgggagagcatcaagtaccacgtttttgaagaccatggcctatcatcattatgcattcaagatttgagtttgaataacctcatcaagacttagatcttcttcagaagcttcaagtctcatctgcattaaagctctccattgaaccgatagctgccaggtcctgtgtt

SEQ ID NO: 560868 - DNA, 751 bp, Homo sapiens
  misc_feature (71)..(71): n is a, c, g, or t
  misc_feature (125)..(125): n is a, c, g, or t
  misc_feature (632)..(632): n is a, c, g, or t
  misc_feature (635)..(635): n is a, c, g, or t
  misc_feature (642)..(642): n is a, c, g, or t
  misc_feature (648)..(648): n is a, c, g, or t
  misc_feature (669)..(669): n is a, c, g, or t
  misc_feature (672)..(672): n is a, c, g, or t
  misc_feature (678)..(678): n is a, c, g, or t
  misc_feature (687)..(687): n is a, c, g, or t
  misc_feature (690)..(690): n is a, c, g, or t
  misc_feature (736)..(736): n is a, c, g, or t
tcggcagctatcggtcatgtgatgtccactaaattggacatctaaatgtctgtgtagtataactttattcntaatgagtggtatctcagggtacttaggtctgtacattgacattctgagttttnagttttgcagaacactgaaatctatggactctaaaatggacttcatttaaagaaacccacggaccattaatggacaaaaacatgagtcaatatgtattgtggcagtggctcatgcctgtaatcccagcactttgggaggccaaggcagctggatgccccaaggtcaggcatttgagaccagcctggccaacatggcgaaaccccatctctactaaaaatacaaaaattagccaggcatggtggcaggcgcctgtaatcccagctactcgagagactgaggcaggagaatcacttgaaaccaggaggcgggggctgcagtgagccaagatcacgccactgcattccagcctgggtgacagagcgagactccgtctaaaaaaaaaaaaaatgttgatttaacaatacgggaatgggggtgaagcggtaaaattgttttgggttacattatactctcagaagctatgtggtttagagaaaagggcccccaaccacaaaagttagtggttnttnttctgtntgcttngtactaggtatatggtaactnaanaaagtnacttaaccnctntgaaccttaacttcgtcatctataaagtgaatttaaattttccccnggcctacttaaaggg

SEQ ID NO: 560869 - DNA, 477 bp, Homo sapiens
ctgtaaaaaatatatgtgcaaaagtgagtgtctaaatgttccctagagagttggcaaggctatacatcagagtcttccttcacaaggtttgcggtgtctttaaaggtgtcttctgtggcagtgtagccatggagtcgaacttctttttgaagctttagcaaggaagagaaggagatggagggggagccacagccacagcttccttttgctcagtgtccatctctgcatagattggattttcgaagttcgttgtctgcttgggttttcgtttgaagatattccattttgtgccctgagtttcatcagctccaggggaggctggctttggctctggaactatctcagaaggatctatggaccttccatagttctggttttccacattttctggtacagtcacctgtgagcttactgacggtccctgcactgccaggcccactttggaagtactgtctttggctgcatacattgggtttt

SEQ ID NO: 560870 - DNA, 431 bp, Homo sapiens
gggaagaataagttgaaggctttaatgaaatacatcctggatttggttgaacttcctagcttttgctggtaacccagctgtgacccttgaaataagttaccttcatcctctgagcctgtttccctcttttagaaacaggagtttaaaatgctgctttgggttgggcacggtgctcatgcctgtaattccagcactttgggaggctgagatgggaggatcactggagcttggagttcgagaccagcctgggcatcatagtgtgagatcctgtctcctcaagaaattaaaaaattagctgggtgatgtgcgtgtgcctgtggtcccatctactctggaggctgaggtgggaggattgcttgagcccaggaggttgaggctacaatgaaatatgattgcacccatcctgggtgacgaagtagaccctgtctcaa

SEQ ID NO: 560871 - DNA, 1517 bp, Homo sapiens
gtgccgcggttggcagcggtggggccttgctgcgcggtagggcggcttgggcttcggcctccctccggttcccttggaagcgggcccgctgaccagcgcgggacgcagtcagcagaggctggagggctccatgggcggttctctctccttccccgcttcagcctgagccggggtaggagaggctcaggtgcgtggcccgggggtgctcatgcgcagtgggatgcggaggagctcccggtgtgcccctgaaagaattggcgaatttccttctttcagttagcaacttattgggacgacttgctcacaattcagccaaggtagccacaaacagctcatattcaactgtggttgcgagacgcctgcgccataaatgtggccatgtgggaaaaaaaacaaaaacccaatttccgtttacaccccagagtttcatcccctatagtgcacacctgaaccacgcttgtgtactcacgcaattacgcatttccttcccataaaacacaagtaaagggacaaacccggttaacagtgggtccgacacagaggcgacgaacatacgggtcagccacttcataagctacatcattaagcaaccgtcttagccccaataaagagtgtcctgcgccaccattatttcggcccagatgagtcccacaaagaaaaatctgctatgcttgagcgcaacgcgcacactccccgtggggccaacaccacagcattattaccccgttattatacaccatatacaatacaacaaccaacgcacacgtactacactcggatcaaaacctaacggcttacggcatagggcctcggagccaacccaagagcttccaccaacagacaaccatctcgaaaccacacggcaccgcagacatctcacccgattggctatcacaccgctgttgatcggaagcgcacaacagagagaccctactctatagttcacacccacacgtgtctaacacgcccgcgccaatttgaacagggggacccccaatataaggccaaacaccaacgcccttaggcaacgactacggccctaggacaacactgtagtgcggcgctatagctttatactacccccacaggcaaagttgcattacacacaagcagggacaagtgtgcccattttcaaactgctgggctctacgcgcacaccacagaaatttctttccccacaagggcatatgtgggacacaggcatttacacacatgacaataagttataaggaggggaaattcacacccaaagtgtgtggggcccattaacttccgcaatgggccaattttgcgcagagatggcaattcactaaacccgttgcgcgccacaacggcggccacatcagtgtcgacccaaagaggtgtcacccttgatcaactcggcgccgtaagcattgcctcccgcgaaactttctaagacgagatatacagcaacatatgcaactctccataaaacgtgacagcccacatttcttgcaacataaaaaatttcggcgtactatatcatagcagcagtg

SEQ ID NO: 560872 - DNA, 913 bp, Homo sapiens
  misc_feature (6)..(6): n is a, c, g, or t
  misc_feature (123)..(123): n is a, c, g, or t
  misc_feature (289)..(289): n is a, c, g, or t
  misc_feature (318)..(318): n is a, c, g, or t
  misc_feature (353)..(353): n is a, c, g, or t
  misc_feature (365)..(365): n is a, c, g, or t
  misc_feature (414)..(414): n is a, c, g, or t
  misc_feature (463)..(463): n is a, c, g, or t
  misc_feature (663)..(663): n is a, c, g, or t
  misc_feature (724)..(724): n is a, c, g, or t
  misc_feature (729)..(729): n is a, c, g, or t
  misc_feature (826)..(826): n is a, c, g, or t
  misc_feature (852)..(852): n is a, c, g, or t
  misc_feature (857)..(857): n is a, c, g, or t
  misc_feature (878)..(878): n is a, c, g, or t
  misc_feature (906)..(906): n is a, c, g, or t
ggagtncaatggcacaatctcggctcattgcaacctccgcctgaagggagattttcaaagcaacattgcctctataataggtagttttcaatgtaatactggcaccaacaagagaaccgagcnaaattaaaactaccctcaaaatgtcatcacagctgaagtccacagcaggaaggacgatgtaacaaaatgcacagatctgttcctattgcacattccacctttcccacgtactgctggaagcccagaataaccaaaatctttttagatgtttgttttaaagagagcnataatatgcaaacatacacacacacacanaaacaaaaaaaaaaacccacaaaaaaaaaaaaacncaaacctggttnataaaagagctttgtggataagagtacaccctcatttggtccaagaatntaattgtaaacattaggcaaatagacccaataaatgtaaacaggaaganaataaactggttggctggaatattgtattttatataatatgcttatttgcaaactaatttccaactgtttgtccagtactaattcaactaattaatcttctaaatgtataggacaaagcctttaaaaagtaaagctcttcagcaacgaaaagttaacaccatctaaaataaatagattttaaaatatatgtgatgaaatnacaggtcactggaaattcaattctacaatgaatataaattaacattaaaatctattaagtnctatncctgggaagattttggttcagaggttttatttttttaagggcttaatatttgggaataaatgggcatagcttagaaacccttacaaagttgtgagtngactagaggtaagaatatttggtganaaganaaaaagatctttttctatgtncaaaataatggcttacctcattttagtnaaaagaa

SEQ ID NO: 560873 - DNA, 292 bp, Homo sapiens
ttttttttttttgggacggaatctcgctctgtcacccaggctggagagcagaaggttgatcacagctcaccatgaacacctcctgggtttaagtgattctcttgcctcagtcttctgagtagctaggactacaggtgtgtgctaccgcaatggtgtgatctcgctcactgggattacagtcatgagccacgacacccggcctaatttttgtatttattgtagaaacagggtttcaccatgatagtcaggttggtccccaactcctgacctcaagttatccacccgcctaggc

SEQ ID NO: 560874 - DNA, 1163 bp, Homo sapiens
ggattcagctgtttctactaaatatacaaaaaaaaaaaaaatagtttggatgtggtttcgtgttgccttggtggtgccagcttactcaggaggctgaggcaggagaattgcttgagcccagaaaggcagaggtttgcagtgagccgagaattgcaccacttgcactctccagcctgtgggttgacagagcaagacttccattcttcaaaaaattaaaacaagttccaggaggggcgtgttactttctttttaagttttatttatatttttgtgtgaggcagggttttggctgctctgtggagccattcattacccagttctggaagttgcaggtgattgcagctcatgtggctcgcctgcgagaccttccacacttcccggggcgtcgaagcgagtcctctcccaccctctagagagtcccctgcatgaaagaaaggtgtgggacaccccagggaggccgtggtggcaataaattcttggaacttttgtggttagaacgaacaagaggtttgtggcccattgttttgccccaagttagaattcttcaaaaggcagagggggggcttggtataccattctgtgatctcaggggccaaaaaggggggcttggtgccctccttggggaccccctttgtgccacaagcccccaaggtgcgggctttcatattcctccctcgtgtctaaggggggtggctataaagggtttcactctgtgcccgtggcaatccccgttgaagtttacccccaaatggtggttaaacctacaaggccaaataaacacggttacggtgcaagccggagaaacggggggtgtcacagaaagacatcaaggggttctccctcgttccccccagttgtgcaagctttcctcttggaaccctgttggggccctttgttgtataccgcaggtcgtttttacccccagccgggtctatatctgtggcctctatttgtgggtggcccctttggagaggggttacacagggggacgggcaggggctcctgggctcgggcttggttaacatcacagcgcaatgtatttattttgggccgccaggctctggcgtgttgccccaccgcgaaaatcttcttcccgctggtccccccaacagggcaaccacttgtctcttctcacaacttcttcgtcttgggggcctcccaag

SEQ ID NO: 560875 - DNA, 230 bp, Homo sapiens
  misc_feature (190)..(190): n is a, c, g, or t
aacctggggggcagtggtgtggagaaccacagcgctgagattcatctgctctcctcctggagcccagaggagggcagcagataggggtggtgtctcgaccccgcagcactgaggaagagcgggcttcttctcattcacccgtcctttcttccttgccccaggacctggctactcttggttgggcaagtgntctaggatggcctacactaggatgtatgactacaaccaaa

SEQ ID NO: 560876 - DNA, 484 bp, Homo sapiens
agacgtgcacagtaaatgttgccacatttccccatgagatcttgtatcctacatccaagagatcgcatgtatctagtccatgtatcacaaatagcacgtatgttatcgaggcttatagctgatcgtgcctgatgattccttgtcgggatcgtctaatggctaacagtaggtatgccgactagggctagtatgtggtgaaacgcaggtctcgatattctaatatctggcgaaaccaaacacacaactctaagacactggagtagttacaagaactatacttaaattttaagaactattgatccctacccaaaataaatccgatcaaaccaatgcagcacccaatctgactgaacctccaccaatagcttccaaaacttcttccttagcaagaaatcagtaataatcataatgataaaaattagtacaaggatgatcagaacaaagtccaggagaacctctactaggcagaaactatgtattttcc

SEQ ID NO: 560877 - DNA, 98 bp, Homo sapiens
  misc_feature (13)..(13): n is a, c, g, or t
aggtcagtatgantcactttctggggactcaagccatgaacacccacagtctagatccctgccctcagaagggttacagtttatgtgaattactattt

SEQ ID NO: 560878 - DNA, 466 bp, Homo sapiens
cagcctcatttgcaggagcagcatgattccatgcacagatttgcagggatgctgattgcccttggccctcgatttatgccaggcaccctttgtgcagagaggaaactcgctggaaggcaaccacgaacttcaaaactcgttcatggccaggggtaatcctctgtgggaggtacagctcaacaaggcacagagcctccagttcctgttgtcagctgagtacggtggtcatcatcctggctgctcagttcaaagtcaaagcacttaaagttctcagcaatgcgttctggtgtcacagcattggggatcaaccacaagttcctctgcatggggacaccggatcaggcactgggctgtagtttaattgtgcttggattgcgactcgcttgatccctgggatcctccaggagagcagggtcctcgggcttggcccagggccaggcaggagagccgagggggcagaaggcgg

SEQ ID NO: 560879 - DNA, 2124 bp, Homo sapiens
cccagttaccagcaagtgtacacagggaccaacggagacggatcgcagcgagctgagggtgccttagcgacctcctggacagacccgcccgcgccatgcgctcgcacactggcctgagggcgcttgtggcgcctggttacccgctcctccttctatgtcttctggcggcgacgcgccctgatccggctgagggcgatcccacagatccaacttttacaagtctacctgttcgagaagaaatgatggcgaaatactcaaacctttccttaaagagctgtaatatctcagtgacggaaaagtccaatgtatcagtagaagagaacgtaattttggaaaagccttctcatgtggaactcaaatgcgtgtacacagcaactaaggatttgaacttgatgaatgtgacttggaagaaagatgatgagccccttgagactacgggtgacttcaatacaactaaaatgggcaacaccttaaccagtcagtacaggttcatcgtttttaatagcaaacaattgggaaaatattcttgtgtctttggagaaaaggaactaagagggacctttaacatccacgtacccaaagctcatgggaaaaaaaagtcgttgatcgcttacgtgggggattctactgtgctgaagtgtgtatgtcaagattgtcttcctttaaattggacttggtacatgggtaatgaaaccgcacaggttcccattgacgctcactcgaatgaaaagtatatcatcaatggttcccatgccaatgaaacaaggctcaagattaagcatcttttggaggaagatggaggatcctactggtgtcgtgccaccttccagttaggggagagtgaggagcagaatgagctggttgtgctgagcttcctggtgcccctcaagccatttctggccatacttgccgaagtcatcctcttggtggccatcattctgctttgtgaagtgtacacacacaagaaaaagaatgacccagatgctgggaaagaatttgaacaaattgaacagctgaaatcagatgatagcaatggcatagaaaacaatgtcccccggtacagaaaaactgactctgcagatcagtgaatacagaaagagcatctcgccctgggaagaagtacagcgttggagtttgtacttcagcttccttattttagatttttaaaagacaaagatgccctcaacgtgcacagaagtagctttatgaacaatatagtccatctcctacctaaagatgtactttcattttgtaattgctttccattaaagcaaggtcaattgtttcagctgtgttctgtgagctgtaacctagataataaactcccctctgtgggtacagggtggacaccagcaaaatcacttaataatccacaaataaatatcgccgaagatctgtttattaccaaagaatttattaaagagaaagcgtttgccagttgtcttaagtgtttgcctccaccagacatcttacctatagaagtatttatcacagttttcatgtgaagtgtatccagtgttgagtgtgatttctctaggaaatggaaagtatgctttcaatatcggtggctacactgcagtctagacactaagataaacttgtgctctataaataatggtgcaaagtaagggagttcaaatgcttgtgccatggccactacattaccagagcttctcatcttcattgcactcatttctgctctttctatcccaagccgaagagcttcccagccttaagtagaacattttccttgttctttgtcattggggtttggacttcaatagtcttcagaggccagatccacgttgtcacagtacaaccccgctcgctacctgcatgcctttgtggctcatggtttctgggtgcctttatgtgccatctctttcctggtaccatacctggctaaaatgcattcttagtgttttccaataataattcctttgtctagtatacaggaggactagtgcactatctttatgttgctgcgaatgccttagacttaacttcaaaattgtatctgagatactttatgaacttagaaccaaatcacgtcagaattttaatggacatggaaacttgtcaatggttttaaatgaaataaaatgtgccttggatggttggatt

SEQ ID NO: 560880 - DNA, 357 bp, Homo sapiens
  misc_feature (11)..(11): n is a, c, g, or t
  misc_feature (16)..(16): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (164)..(164): n is a, c, g, or t
  misc_feature (176)..(176): n is a, c, g, or t
  misc_feature (178)..(179): n is a, c, g, or t
  misc_feature (197)..(198): n is a, c, g, or t
  misc_feature (220)..(220): n is a, c, g, or t
  misc_feature (248)..(248): n is a, c, g, or t
  misc_feature (257)..(257): n is a, c, g, or t
  misc_feature (268)..(268): n is a, c, g, or t
  misc_feature (288)..(288): n is a, c, g, or t
  misc_feature (303)..(303): n is a, c, g, or t
  misc_feature (317)..(317): n is a, c, g, or t
  misc_feature (335)..(336): n is a, c, g, or t
  misc_feature (341)..(341): n is a, c, g, or t
aatcagccggnccttntatgggccagaaattatttgggctatgtggagcagctgtcttgcataaaaagctatattgggctctagagaaagtgagaatggaaagaatttgagagatacgtgagaccaaaaaaaaaaaaagacacaattaaaatngtggantanantacaatgacaanannccttcccaaaacagtaannccaaaaagccggctaattagcntaaaacaggaaaaagataaggaagcaangggttggcngggaagctttnatcccagagcccccgatttncaagagaggcttcancttccttttaaaanctgttggctttccctatnnatttnctgtgcccatttccag

SEQ ID NO: 560881 - DNA, 423 bp, Homo sapiens
  misc_feature (5)..(5): n is a, c, g, or t
  misc_feature (16)..(16): n is a, c, g, or t
  misc_feature (86)..(86): n is a, c, g, or t
  misc_feature (219)..(219): n is a, c, g, or t
  misc_feature (236)..(236): n is a, c, g, or t
  misc_feature (258)..(258): n is a, c, g, or t
  misc_feature (313)..(313): n is a, c, g, or t
  misc_feature (321)..(321): n is a, c, g, or t
  misc_feature (329)..(329): n is a, c, g, or t
  misc_feature (357)..(357): n is a, c, g, or t
  misc_feature (382)..(382): n is a, c, g, or t
  misc_feature (392)..(392): n is a, c, g, or t
  misc_feature (415)..(415): n is a, c, g, or t
gaatnatgtaactttnatatgcactgagaaaccaaataatttgtgtgatttgctgtattgtgatgttagtccattgaggtggtttnaaaccgaacttgccatatctccaagatacgcttgtattcaagaaccatttgttgaaaagactattctttttctatcgaatcatctttgtacctttttccataacttagtgaccttatctatgtgagtctcttnctggattatgtattctntttttcgatcttggattcaatntgctaatatctcgttgcgcatttttgtgtctgtgctcaggctgttattggtctgnagtttctnagtacggnctttggttctagtatcggggatgctggncctcataggaatggggttggagtgncttcactctncttgcagtgttttcgtaaagganactgttgt

SEQ ID NO: 560882 - DNA, 593 bp, Homo sapiens
agcctttggtttgccttgaatttatgatcctctgtaattgaatgttaactgtgtgccccttggtaatttgtttaatatccctgtacaattatgcttctgaggtgtgcaatcctcttatgtaacgttgtgggctatggtctaccttacgtggactaatggtaagaaacgtgacttgtggaagtatcaagttctgtggctatggtgaagtactgtgtgcgccatgcagcactctgatctgtgcagggtattaacgtgtcagggctgagtgttctgggatttctctagaggctggcaaagaaaccaagattgttattcgtcttagacagggtcatgtcagggttggaaaagtccaagccgtaggacccagtttccatattcttagactgatgtatattggccagaacaccgtgggatgttaaatatgctaatagaagatggaagacggtttagcatataaacgcaatgtaaaagtatatcattcattaaatttatgtaaggtaatatatatagagcggagaatcatcgaattctatcgaaagaagaaagacaactaatgcatggggctctataagtcactatgtgaacagtaggcc

SEQ ID NO: 560883 - DNA, 388 bp, Homo sapiens
ccaaaaaatgtcttggcccacatggtcggtctaggcctatcaatgagtccagatacatgcttgcaatgatccagcgggacttctcggctccatgactcgggcactgaccgtagtcttagccatccccttggtgcacgtgagccgccggttcctctctacagtcggcgcagctgtcaatgtagggtataagcctgcctgaatgtcagtcacgactacatcacgggcccatgctcatgcggtgcactcggcaggtgcacttactgggttagagcatttctggcgcgcttgttgtacagggtttggctgtctctgctcacggtcccagcatgaacagcaacctgttgttcgcgcgctatagagaagctcgtcacgaattcgctacagaccg

SEQ ID NO: 560884 - DNA, 265 bp, Homo sapiens
gctctcgacggctcccctcaccgactggccggttgggcagccgaccgactggacttggcggcggcttcctcaccctggcgacgacgcagttctggccggccgtgtgtgcgccctttgtgggtggaccgccacctgggcgacacgacgtccacgcacttctgccacgtaccgacggcttggtgtgtccaccacccgaccctacgactgctggccaccgggtgtaccactgggcggacgactgtggcctggcgtgaccgacgctacc

SEQ ID NO: 560885 - DNA, 140 bp, Homo sapiens
gttctcatggctcccttctcctgtgaatctgaacccttgatatcccctgtcaccctgtgatcaccattgtgtagtgcactggctgactaccatctgaatatgtatgactatgtggcatgactgttctgaattggtgtctg

SEQ ID NO: 560886 - DNA, 260 bp, Homo sapiens
ccagtaatgaagccctggggacttgtctatgcatagtgttttcccagcaggagaaccaatattggtcagttctcaggtcctcagaggcctttctcactaaatggaacagcattagctatgttctttaagtctaattaacaactaaatcataacttgtagcctttgcccagttagatgaaactttcagcaatatccacgtttaaaaaactccaagtgccttgaattttattagataaaatggaatacaagggcgaaatggt

SEQ ID NO: 560887 - DNA, 871 bp, Homo sapiens
gatgtcgtgcttcactataaaaaaaacggtgctcctcttagttgtcctctgcagcaaagcctcccctctactattctgctccccaactactataaagttctctgtaatatcatcctcatgctccgcctatttcgccccctgcgctgttatatttaataagaagaataatgttactcctccccccccctacattaggatgtatataatccccctcttctttaaaaagatatttttcttccttctcctacccgctctggcgtgtcccatcagcaaaatcttctacttgatcttcatctcgtcagcgtatatatatcatctccccaccgcttcgtgtctaccctccagaacggccccctctagattatttgttatagccgagaagcgacgccaccttctgtttaaatcctaaaccattggcgtgggggactgctactattttatggatgatatatattgtggagaaaaaatacataggatagttccaagagttggagagagtcgagacggatattactacacccgagagatcggttgtctatatcatagtggggagagccccctacacgatgtgtctctatatcttcgtctgtcagagtgttcctcacattaattgtgacgacccccactcctattatgcaaaggtacgcgatttttattcacactcgccaatagacactctaatcatcccgtcatttttcctttttcgaccaccatcacctcgcacgcatcatacctttcatccgcacaaataatttgcccctcagaaaacttggagttccagacaacgcgggggaaaagtttataacatcttttactagtttctatcatacctggggaaaacaaagggttctcaccttcgccccacaagaca

SEQ ID NO: 560888 - DNA, 228 bp, Homo sapiens
ctatcgaggcccctgaggttgaagtcggcctctctgcgctcgagatcttccaggctgctctggcccacgaggaaaaggtgtctgaggctattcgcgagctctaccgtgcctgcacctcagctggtgatatcgacgcgattccgctgttgcagtggttcatcaatgagcagatcgaggaagaggcgactgttgacgaaatcgtcggtcgcattgaactcattggggacg

SEQ ID NO: 560889 - DNA, 288 bp, Homo sapiens
tcaatcatgagcagtccatttcatgacttttttgggatcccaatactggtgaatccagggtgatcctctgtatgtctgatacagttggtcttttaccagctgatagagttagtcagcttctactgtgatagggggcattgattcactgtcacacaggttcatcagtcacaggcaggctcactagggctcagagcggggagatatttaccaagttaccctgcgaaggtctgagatgagtgagaaggtgtgtctgtattcttacatatagggctgacacaactaatggga

SEQ ID NO: 560890 - DNA, 128 bp, Homo sapiens
  misc_feature (3)..(3): n is a, c, g, or t
tcnagcagtattagagtggatcatccagccagataggcagtattaaggtggatcagtccagccagactaagcagtatgtatagtggatcatccatgccaccacaagcagtattgaaagtggatcatcc

SEQ ID NO: 560891 - DNA, 369 bp, Homo sapiens
  misc_feature (37)..(37): n is a, c, g, or t
  misc_feature (137)..(137): n is a, c, g, or t
  misc_feature (152)..(152): n is a, c, g, or t
  misc_feature (162)..(162): n is a, c, g, or t
  misc_feature (179)..(179): n is a, c, g, or t
  misc_feature (193)..(193): n is a, c, g, or t
  misc_feature (216)..(216): n is a, c, g, or t
  misc_feature (228)..(228): n is a, c, g, or t
  misc_feature (238)..(238): n is a, c, g, or t
  misc_feature (241)..(241): n is a, c, g, or t
  misc_feature (243)..(243): n is a, c, g, or t
  misc_feature (246)..(246): n is a, c, g, or t
  misc_feature (279)..(279): n is a, c, g, or t
  misc_feature (285)..(285): n is a, c, g, or t
  misc_feature (332)..(332): n is a, c, g, or t
tagcaacagacagcgtttccaatttctcaaaaggcanataatatgagactagtgggctatgatgatgcctgtgaatagccagctactgtaccccactgtagctggacaagtgttaaacaagtaaatgcctttcaagngggcagagccctgcncccccacccncccccccccaaaaaaangggaaatgcctacntttcttgttctgatagcttcccnccacacaccaanggttcctcanggncngcngccaccagggctgctgcaagaacatgtttttcnctgggngtggcttcacagttagttcctcaagcagaagattaaaattttttttntttttagaagatcttggttgggggggaacataccaat

SEQ ID NO: 560892 - DNA, 161 bp, Homo sapiens
gccgcggtcttccgagcggtcgcgtgaacttcttcctgcaagcttggcattgcgcttcacgttcccaaggctccgggctttgcccaggatgctccaaggaggggagcccaaacactttttttagggttttgaagagggcttttttttaagaaacaaacaaa

SEQ ID NO: 560893 - DNA, 109 bp, Homo sapiens
gctgatctgcttacgcacgggaaacagcagtgattaacctttacaataaacgaaagtttaacttaaagctatactacaccccagtgttggtcaatttcgtgccagccac

SEQ ID NO: 560894 - DNA, 220 bp, Homo sapiens
tgagcatggcgaggccgcggagtaggtctacaagaggctacttccccgtatcatagaagagcttatcacctttcatgagtcacaccctcataatcgttttccttattctgcgtcctgagtcctgtatgcccgttgccctaagcactcgacaacaaaactagactaactactaagcatctcaagacggctcgaggtaacatagcaaatcggtctggcacac

SEQ ID NO: 560895 - DNA, 548 bp, Homo sapiens
cccccgcgtcccgggaggaattaccacgtgactttgatttgaatacttagtagaaactggcccggaaaaaggtacactttttctgaaaaattaatggatcccttgggaattactgacttgactagaagtatccaaggatgtttgcatagtgaatgtgggttatagttctttccccccctgtgagcataattcgatgaaagttgagttaagctgatagcgtaaaaatctgtgtttacaccagccatagtgaaaaagtgtattttatctgtgtaaaagtgccattatcaccagtgtttgaatagttgatagtagtgttcgtttttacaccagttttaggtaataaaggtctgttttccattctggtggcttttattaattttgatagtatgatgttacttactactgaaatagtaagctagagtgtacactagaatagtaagctccatgagagcaggtaccttgtctgttttttctgctgtatttattccccacgcttgatgatggtgcctggcacatagtaggcactccaataaatatttgttgaatga

SEQ ID NO: 560896 - DNA, 200 bp, Homo sapiens
ctcctaaagcagacatcgttgctacaccacaaatattccagaaaacctttacacagtcccacatataaagacaatgtgttcttcataatatcagtaaccgcgaggtcatgctgcttgctggtcttctaccctcacaatacttaattccgcaggattctggtctggtgcacgcactggcccaggcggtataagcttgagtc

SEQ ID NO: 560897 - DNA, 951 bp, Homo sapiens
gagggtcggagtccggcgcacctgcgtggtcggtgcccgggagatccagggggccgtgaagcccatgcagatcgatgtggaccccctagggaagacccgcagatttgcacctgatgtcaactacgtgttgtgagaaaccccagccatggatctggaacaggtattgcggtcagcatacggcggtctgaatgcgcatcgaatcggctgcggttcatttgctgatctactgcccactcgctgccgggtggagggcccgtgtaagatggtcctactcctttgatgcgggagaacctttgacgtgtcacactgttcgagagagatccgtctgaagctcatcagaggccaccaagggacgtctgcgagacccgcggaacttgatgccaatctccctgaaggagcggcggtggaagcccttcaagcactcggggggtagaagtcctgggtggtatggccgatcgcggtaaaagaagggtgctgctggagatctaggaagaatgtctgaacgagcaggaacctgaaggaaacctacatgggccccgtccgttcaataagagagacttcggcgtgcgcctgcggcaagctggggtgagacctcttattctgggctgtggtgtgacgtcttgtaaattgaccccggcaggtggctattgcccggggcccagggagctactgcgccggctgccacactgtgcatcaacattgtgccttcgctggttgtccaacgtgcggcgcttacttgccgagatgggcgtcatgtgctcagctacgttcgcacaggtgagtcaccccggagattggcgggcctcgagggagatggtgacacccgtccgggcgcgcccccaaggtcaagtgtgcgctgcttttggctggccccgggtacccggggcattcccctgatggccttggactgggttctgagcgtgcgcccggcctctggccgccgtcttcgcg

SEQ ID NO: 560898 - DNA, 145 bp, Homo sapiens
tctagagatcctgggacttctgtgaatactgagcctagggctgagggggacaccacgcacagagacacggcaggcccgtgttggccgggggtgggggtgagggcagaaccagccgagggacgctgagtcagaccgcttgcccact

SEQ ID NO: 560899 - DNA, 114 bp, Homo sapiens
tatccgcaactcatcacataagtaaataagagcctctagcttaatgttttttcttctcaggtgtctttctcctacagactctaattccacatatgttcaaccacttaatattaa

SEQ ID NO: 560900 - DNA, 329 bp, Homo sapiens
aggatgtttaccggcacgcgggacgagagatggcctcttcacctgagtgcagtgagatgccccttgatctgtcctccaagtacaacctgcagaagcttccattgcctgaaccagcgcaagacaccccccatgcctgtatagacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctggctgaagaactcaactgcactgat

SEQ ID NO: 560901 - DNA, 962 bp, Homo sapiens
  misc_feature (21)..(21): n is a, c, g, or t
  misc_feature (432)..(432): n is a, c, g, or t
  misc_feature (434)..(434): n is a, c, g, or t
  misc_feature (656)..(656): n is a, c, g, or t
  misc_feature (698)..(698): n is a, c, g, or t
  misc_feature (763)..(763): n is a, c, g, or t
  misc_feature (910)..(910): n is a, c, g, or t
  misc_feature (960)..(960): n is a, c, g, or t
ctcctgcctcccacctcattntctaccctacccctcccatcgggctgtgctggggcttggggaggggaggggcgccttgtttctccctccagtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtntntgctaggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaattngctttccctcacctctcacttccttctagaaggagcttcctnactggaaccagagaatgcatgtctgtccacttggtggctgctgggtggggccgggaacaagggcncctgaccctgtgtgctggccgggacctgccaccagccccccagcctgcttcttccccttaagctttgtgcccctggatgcgctaacattcactcttgtttgtccctggactggccatgaagtgaggagatggttatttaaagagaantccctatttatttgacaaaaaatccagttaatatattaatgtgaaataancc

SEQ ID NO: 560902 - DNA, 881 bp, Homo sapiens
ggcggcatctgcagtcacgtccggggggcggcggcgagacgccttcccagcgcgcagcccttacacctctccgtgccgcgccccgcggcgaggtcgcgcgggtgctgtcaggatgcggagtctacgaggggaccgagatccacgaggcctcggcgatcctggttgcaccttgagccgtggaggggctgaagtccagatctttgcgtcctgacgtcccgtcagatgcacgtgattgaccacaccgaaggggcagccgtccgaaggcgagagcgaggaatgtgttgaccgagtctgcgaggatcgcccgtggcaaaatcacagagctggccaacctcagtgcagccaaccaatgatgctgccatctttccaggaggcttcggagcggctaaaaacctgagcacgttggccgtggacgggaaagatggcaaggtgaataaagaagtggagcgtgtcctgaaggagtaccagcaggccgggcacggccagtcgggtgtgatgcttccaccgagacctcccggtaacctgatccattggggggtcctaggaagaggggcagctcgtgctggttcacggtcgtcagggtggcgtgtaggggcttggcaagggcgagaagtcgaggactttgcggtggagtagaagatcgagtggacgggggagtcggcaaatggggcgcctcactaccgagttctgtcacggcgaacaaggatgagggatcgatcgggaatcctgtctcgccagcgcagaggcactcacttaaggacctgcgtggtcactgtccaaggaaggccgctacagtggacgctcaggaagaggtgcagggcgcagaagctcctgaaaggaaggtcctggctggagaccgggcacaggcggggttgaagggg

SEQ ID NO: 560903 - DNA, 729 bp, Homo sapiens
tccctttaacttctcagtggactgaattctgtttccaccggatttttggactaaaatagcttatggcaacagaggctactctggggttaaggaaaaatgtagttctcggtttaatgttataatatcgctcaaagaaaaataaaagcatctccctctaacaccaccagacttttcctctcgtgtaccttatcatgtaaatttggctattggatttctcaccggggtggttccctttaatgggtgcaaaaatttagggctatttagctgacaacggcctagggtggtaaaacgggttatcaagaatctgaaagtctaagataggaaaaaaaagtgggggggcattataattctataaaaggtacttctatgggcatgcctaatacgtctttatatgttatgtttgtgtggtgtacccgatgttttagtgctaaaattttgtaaaagagctctactgggtttaaagaaaaataaagtgcttaattcagatactaaaaaagaaaggtagtcaaagtgctttttcaaatttttggtaccttaggtaaaatctttaataaataaaggtacgctttaaaattttgggtaacagtagtattagaaagtgtcttaggaaatgtgcagcatacattttgggttggcttatataattcaaccagttttatacttaatcccttgtcaaataccagaaggtgtgccaattgtggctagggggttttaaatataaacccaggg

SEQ ID NO: 560904 - DNA, 385 bp, Homo sapiens
attaaaagaacccctgcattgctatggctgcaatagcaaaataccacagactgtggggtgtcaccgacggaaaggtattttctagcactgctggaggctgaaggtccacgatgaaggggctagccaagcccgatcctgataggggctcttcgtggcttgctgacgggcgactcctcactgtcttcacatggcagagagagaaagaaaaatctctcttgctgtgcttaggaggccaccaattctactgaattaaggccccacccttatgatgacctcacttaaccttagtaatctcctatctgccctattgcctaatacagtcacacagggattagggcctcaatatataattctgggagcaccaccaatacagggtaccgagctc

SEQ ID NO: 560905 - DNA, 526 bp, Homo sapiens
  misc_feature (267)..(267): n is a, c, g, or t
  misc_feature (285)..(285): n is a, c, g, or t
  misc_feature (289)..(289): n is a, c, g, or t
gaggttgaagctgcagcgagccatgatcatgccactgcactccagtatgggcaacagagtgagaccctgtttccaaaaaaataaaaaataaaataaagttatataacaaagcctgatatttgtagtgttttctaggtaacagagtgcttcatatgagttcattgaatcttaaacaactctgtaaggtggacattttaatgcacctgtcattagggttaaacttcggtgtatggagtgagacttttaatcaataaaaagtttaatctnaaaggaaggggaagggtngtanaggtgcctgggggggcaagaaacaactgtctatagagtgctatcctaaagacacccatgaagccatgttgtcattctgtctagacccgctggactgcaccctaagccatgacatgttgactgtgcaaaaagtcatttagctggggggatgcaaaaggtaaacaaatattgcataaagcaaatggcttttgaagtaataatgataacaataataaatgatctgaatttgaatcctgaa

SEQ ID NO: 560906 - DNA, 836 bp, Homo sapiens
tgggcacccgctcgaaaagggacatttcagagggcccttgcggaagttctcacaggacccctcaactcttcctgtggactggcctacccccacctgtgaactacctgggggtttctcccgggaacctcctaattgatggccccagcgaactcccggtattaaagcccgtcagtgcgacaagcttgcccttaggaaggccagcccgactcgacgggtagggaaaatcgacggatacgactctgaagttcccaagtgagacttgaagggtcctcgagggtaggacccatggagcccagctgttccccgttaagcgtgtctgtacgagatcctccctagaggcacgctgaagacgagaagtcccgcatcagccatcatcccaccatgaagtaacggtgggccatggctctgaaggatggaggcgccagaagctcatgcattgcccgtggtgccatgaactccctgaggtgcccatggagatgcctattggatgctgccgccctagagctacgagctgctctcacgtggaagcagtgcaacagggcagtaggcactggaagctgcaggctaaacagggagcccgacttcagcatgcctgcgtgtcacctctcagccccacgacaggataggctgcccgggtcttctacctgctcactggtgctctcagcgacaacagattgcttcacgctgatagcaagaaaagccatatggtcgcatcatgatccagccggggcccagattccactgaggtatagagtccatttacaaagctgccaggaaaccggccacttctagtaaacacacgtcgtgcctcacgtgggtcctgcctacctagctac

SEQ ID NO: 560907 - DNA, 735 bp, Homo sapiens
agcgggtctccgctctccttcgcgctccgtcatagtccggactgacatctacatccagtcctggggagcctgtcagcctggcgactgcatctctcgaggtgcacggctgtgagtcggaagagcctgactagctatttctgtcaaagcccatgcgcatgatcgcgcatgggggagtccgtgttcgtcgcgtggaatgaacttcgatggtgggatctagcaacacgatccatgaacgactaggcagcacgagcgcggacgacgcggagagatcctggacgataagttatccaagacagataaatggtccttggatgaaacaccacttgagtcctcgaatttctgaataatagtgattcatacattgatcgatggttgctcacaccatgttgtgtgtgcatgttaatcaatagttgtagaccgacttggatcctgtagcatgggtcagtgagtttggggcctatgcgttcggcaggtgcattaacgattctattgactcttggctaatgccaggagattggcacataaatgtatggcatttgagtaactgcaaaaggcgatagtgggaaatggctgggtattggaacttgtattgactaatcctttgcctaattaggggatttccagtactttctaatgtgcctgtatacagaggagtatcagccattggattcaatcaatcagtgtaccctatggtaggctgaatgtgcgtgagaaatgtaagattattgtctagac

SEQ ID NO: 560908 - DNA, 106 bp, Homo sapiens
tagagcttgttcgtgcatcctcacaatcacagatttgtttctccaatcctcacagagacccaattgaccaaaaaaagaaaagaggaaaaaaaaaacgtcgtcgttt

SEQ ID NO: 560909 - DNA, 161 bp, Homo sapiens
gtaattttcatgttggttttttgtggagatgggacgttgccgaggttggtctcgaactcctggcttcatttatcctcctgcctcggcctctcaaggtgctgcggttgtaggtgtaagccaccacacctagtccaggcttttaattttgtatcggcaaaacg

SEQ ID NO: 560910 - DNA, 208 bp, Homo sapiens
agaggatcccggcgcaggtgctatgatgcatgaggactctatcttacattatggctgggaatcttactctttcatgtgcctatgatatatttgaatcaaaatgtggtagttggtatttcagatagctaacttttaacttttttgctctccacattatagatctagagaggcaattatcaatttaggagaagccaacaaacttctaata

SEQ ID NO: 560911 - DNA, 472 bp, Homo sapiens
  misc_feature (13)..(13): n is a, c, g, or t
  misc_feature (75)..(75): n is a, c, g, or t
  misc_feature (77)..(77): n is a, c, g, or t
  misc_feature (111)..(111): n is a, c, g, or t
  misc_feature (170)..(170): n is a, c, g, or t
  misc_feature (270)..(270): n is a, c, g, or t
  misc_feature (359)..(359): n is a, c, g, or t
  misc_feature (370)..(370): n is a, c, g, or t
  misc_feature (399)..(399): n is a, c, g, or t
  misc_feature (445)..(445): n is a, c, g, or t
acaaaggccagtntgggaccgggggaggagggagggaaagcacaaagacatcttctctggactgcttgggacccntncccacttggagcaaactctgttcctcttgccgtnatattctcagccatggggtcggtcctccaagcagcggggccaagtaggagaagaaaaanatagaaatagaacctcctctagtactctgacagaaaaatgtccaattacagatcaaggacatcattgccaccctcacctctccttcctcaaagaaaactntctggcctagagggaaaaagtaaagaactgaaaagccaggggctcaggaggaaaaaaaccctctactatacacacaggcgtaagggganaaaagggtgcnagtaacagccctaacaacttcagaaaggnaacccacattaccactaggttacacagcatccagagccccaagggncctaactctcccagatataaattcctg

SEQ ID NO: 560912 - DNA, 975 bp, Homo sapiens
  misc_feature (198)..(198): n is a, c, g, or t
gaaagagaggatagagagaagcaccggccagaagaggaggggagaagtgccccagaaaaaatcatccagtctctgaagctttgcccaggtgggtcaacaggccagccagactctcctcctggttgcccagtctggctggaggctgtcattgtaatccttccgctccgagcatgcttaggaggtgtcgcagatgtgctngatgccctcttctttgaaaaacctgtttgcagcaaaatgcctcgggggtttttatgcaccttcacacctcacactaggccaaaaaggggcccaatagagaccaagacatgcatgtcgtcgacgacgaacagtagactctttgggtgtcccaattccatgacccgatcgtcctggatcatctcgtgaggggcttcattggaacccccgctggtctggattgctcctgttgggaagtctccaggctgcttcatttgcgtcgcattgaaagactccacgggtcctctcgttgtacccgtgggaaactttccaaaacgtcctccttttgctctgtggaaccttgagtagttctcacgggccttgtgtgctgccatggaaaactcgcggcgtcctgtgtcgcatgcatgtggctaatgccagaatccttgtggttctgttggtcctcaagggtgtggtgtgtctctggtggaactcggggtctgcatgctccatggaaaagcgcctgtgtgtacttgatcgcctagaccattaagtaaatcttatttagttcctggccttactgtacacattgtggaggttgtatggcccacatgtcgttgggtcatgccgggtcttcagcgggcgagcatgggtcgcggggaggcggtgtcccttcgcgatctggttttccactacggggcagggagtctggggggccggggcggtcttgggcggggcgcgcgggcacggccagggcctggggtcccgggggcaggcgggtgtttgtgccacagatggcca

SEQ ID NO: 560913 - DNA, 131 bp, Homo sapiens
  misc_feature (27)..(28): n is a, c, g, or t
  misc_feature (95)..(96): n is a, c, g, or t
tatacattaactgcccatagagttgcnnatgagaggagaccaggtaatttacctaaattgtactaaattgctacatacacaaaacccgtgccgannttgttttaactatgttttgtccccttcttattttt

SEQ ID NO: 560914 - DNA, 533 bp, Homo sapiens
ggttcgacgcaaaaccccaatctgcatcaactgaacggcaatcaaccaatttaattaagctaagcccttaattgaccaatgggacttaaaccccagaaccattagttaaagacttaaggccctaatcaactgtgtttaatctaattctcccgccgccgggaaaaaaggcgggagaaaaccccggcaagtttataaaccgcttctccgcaatttgcgattcacaatgtgaattatcacctcggagctggtaaaaggaggctaaacccctgtctataagattaacagacaagtgcctctctgacattttatcccacccccccaaaaaaaaaaaaaaaaaaaaaaaatttttgcccaccaagggtggggacttaaaaaaattttacgcggcggcgagttttttaggtgtatatagcccaccggagtttttcgggggggattttgagggggaaaagcattttccccaaggagggctcttaaaaaagttggggaaagagggagaaatgttttccggggaaaatttatccccccacaca

SEQ ID NO: 560915 - DNA, 153 bp, Homo sapiens
taccgggtcctggaaaacacgctgacggagagtgaggcctgctacagctccagcttgcccagatgcatgtgcatgatcaccaattgttgatggcccagctggctgagatctgggctgacctggagcggcagaaccaggagtaccagtgtgctt

SEQ ID NO: 560916 - DNA, 376 bp, Homo sapiens
attcttctctatacgaagtatgctctctcttctgggaagagaaatttctgggcaaacaccattttgagaaagaaattcagatatgggaaagctacagatcatggggagcaggaggctttaagaaacctggcttgtgcatgtggtttacacatgttgaaaagtctgacagattactgaagccaagagcatagaagatagaacaatactcagatttgaattacagctgagttacccacttgggacgtcagttttagattggagctggtatgagggaatagggccaaaatactgaaatcttgggtaatcaaaagctaaaataagattcatggatttatgaattgtgttttattttgaataaatgcttatcttaacttcc

SEQ ID NO: 560917 - DNA, 389 bp, Homo sapiens
  misc_feature (13)..(13): n is a, c, g, or t
  misc_feature (57)..(57): n is a, c, g, or t
  misc_feature (111)..(111): n is a, c, g, or t
  misc_feature (123)..(123): n is a, c, g, or t
  misc_feature (184)..(184): n is a, c, g, or t
  misc_feature (293)..(293): n is a, c, g, or t
aaaagtgaacggnagccccgggacttcaatggggcttaaagaagcccttcccgcctnagcctctcccagtagctggggctacagggtacacgtcacccatgcccggctaanattttttttaantttggtttttgtagagatgaggtcttccctatgttgccccacactgttctctaactcaagnagtcctcttgtctcagccttctaaaatgttggcattacaggcgtgagccatcgtgtccagtccctaaaaacacttttggttcctcctagataacatgtttttacaagcnccagggtgattaggttcgtattcatttttatctttatattgaaaggttatttgaacctttaataattccatattaaagaattacttaattctttaa

SEQ ID NO: 560918 - DNA, 451 bp, Homo sapiens
cgctcggcctactttcgttagaagaaactacatcagcttaatggctgcaaacagccagctagcatcataatgacaggatcaaattcacatataacaatattagccttaaatgtaaatgggctaaatgccccagttaaaagacacagactggcaaattggataaagagtcaagacccatcagtgtgctgtacccaggagacccatctcatgtacaaagacacacataggctcaaaataaagggatggaggaagatctaccaagcaaatggaaagtaaaaaaaagcaggggttgcaatcctggtctctgataaaacagactttaaactaacaaagatcaaaagagacaaagaagggcattacataatggtaaagggatcaattcaacaagaagagctaactatgctaaatatatatgcacccaatacaggagcacccagattcgtaaagcaag

SEQ ID NO: 560919 - DNA, 287 bp, Homo sapiens
  misc_feature (181)..(181): n is a, c, g, or t
gaggtgatgggagatcacatatctataaattgagggatggtcagtgttgctggcaaccaccagaagctgggaaggggcaaggaaggatcctctcctagaggctacagagagagcctggccctgccaacaccttgatttcagaattctagcctcagcctgggtgcagtggctcacgcctgtnatcccaccactttgggaggccgaggcaggtggatcacttgaggtcagtagtttgagaccagcctgaccaacatggtgaaacccccatctctactgaaaaaaaaaaa

SEQ ID NO: 560920 - DNA, 800 bp, Homo sapiens
  misc_feature (101)..(101): n is a, c, g, or t
gaaactgatagcaaccgtcctgcgcgcgaccgacgaatgaccgtctaactacatccaatgtctccagtaaacatggcgtgtcactgacagctaggagtgcncatggcctcagtgtgacataatgtgtccgtttattgcagcagcctactgataactataatacctggacgtctactggtatgcgatatagtaataaatccagatgcgaagttctgatagtcgtgttctgaattctgagtcttcatggaggctcatgtgagtcacggcacatcaggatacttcccttgtccgtgcttttgtggaaagggcaagtaccactaatagggtgtatctcagaaactgaattgccaatacacgggacaacataggacttttcttgtcctgagtttttgaacgattgttcttgattcccttgattcccaggagagattctctgacattcacgtgtcagccactttggcacggaagcattacagtgtggggaaccaaaacttcgtgtctcctctttccccgatgccatcagcatagacttgacttcctttaaaccgagagtttgatgtggccttggaaacctaaaatcagctgtgttaggtaacaaaactcaggctatctgttgatgacatcgagatggtgtcacttaaaagagccaagattcctgtttccagtttgtggattcatcctgactggttttactttaagtcctccatgtcaaagtggagactgagaaaaggtcatacattgcctcatgtgaagtgtccaacctctctgaaaatcttccttgttcaaaacagaaacgaata

SEQ ID NO: 560921 - DNA, 265 bp, Homo sapiens
  misc_feature (77)..(77): n is a, c, g, or t
  misc_feature (86)..(86): n is a, c, g, or t
  misc_feature (88)..(91): n is a, c, g, or t
  misc_feature (93)..(95): n is a, c, g, or t
  misc_feature (133)..(133): n is a, c, g, or t
  misc_feature (141)..(141): n is a, c, g, or t
  misc_feature (152)..(152): n is a, c, g, or t
  misc_feature (168)..(168): n is a, c, g, or t
  misc_feature (212)..(213): n is a, c, g, or t
  misc_feature (219)..(220): n is a, c, g, or t
  misc_feature (239)..(240): n is a, c, g, or t
  misc_feature (242)..(242): n is a, c, g, or t
  misc_feature (264)..(264): n is a, c, g, or t
gaaggggctggcctagggccaggttcatcataccgttagccctgcagccccatgcctgtgtgtcctggtttaccagnacaaatagnannnncnnnaggatgtggcgcctgtaggacttgcttctcagcggctncaagcagnatctctgtctnggaaggtgggaggtgnagccagtctagtacctgaagaccctaaaaaaaaggaactaaggnnggcctnnctcagccttagcccttcgnnangcccaagggtgggggaggaaana

SEQ ID NO: 560922 - DNA, 338 bp, Homo sapiens
atttgtggacacatagtatacgtgggagggaaggaggaaggtgagcagaaaacccaaagccagggccggagcgcagtggctcacacctgcaatcccagcactctgggaggccgaggcaggcggatcacttaatgtcaggagttcgagactagcctggccaacatggggaaacccagtctctaatacgaatacaaaaattagctgggcatggcggcaggcacctgtaatcccatctacttgaaggctgaagcatgagaattgcttgaacctgggaggcggaggttccagtgagctgagatcgcaccactgcactccagcctgggctacagagcaagact

SEQ ID NO: 560923 - DNA, 284 bp, Homo sapiens
  misc_feature (38)..(38): n is a, c, g, or t
  misc_feature (238)..(238): n is a, c, g, or t
tccaagcaaaatcccaaggtaaaatatccaacgcacgngcgcagttgtccaatcaaaatgacaagaaactaaactttctattgcatattatgctttgggatttaaaacacaatatctaaaacttaatctccctaactgaacaaaatgtaacacttaattaaattataaacaccacgtttatgtattttcacaagaagcagggcgagggtatggcgtgaagaaagctggagcatgccanacatctcagtgttattcccttttacttaaacatagaagggcattaa

SEQ ID NO: 560924 - DNA, 651 bp, Homo sapiens
agatctctctcttgggcttttcatcatctttttgaatgagcggctctcttaagccaataagatagaaatatataccctgttgaccttgtggcttttcttttctgttaaagaagcattcaggcagataccagatatatgaggcgcgcctttcagatgctcatctttttcactcatcacttttgccctcctaccctcaggagccaggtcattcttcgtaggtgagctgtgtaaaatctattttatagacgtatataaggagaaaataatttatttctgcaggcttcataatgtcatgccagtatgctagctgaaaacataatggcttttttttttttttttgaggagaaactttctggttttttagcaaaagagactgaccatgtgtaaacattctttaaactcgtttctcacttgtggtttactgtgtggagggctaaattttaaaaagtaatataatgttataacacattgcttattaccaagcaagttttaaaattgacacaagtttatgtaatgggtggcttaatgggtttaaccgggaaaacaggtttggagacagtatttacttttgtttgctggaatgggaggaggcctataaaaagaaaacttcgaagcttctttttttaaaaagaaatgagaggtttctgtggt

SEQ ID NO: 560925 - DNA, 248 bp, Homo sapiens
  misc_feature (71)..(71): n is a, c, g, or t
  misc_feature (77)..(77): n is a, c, g, or t
  misc_feature (238)..(238): n is a, c, g, or t
cgaatcgtaaccgttcgccatgcgtaaccgttcgtacgagaatcgctgtcctctccttgcggccgagaggntcatanagcgccattgccgcgcgacgccgggcgtcgtcccgatgtggggccaggaaggcgacttcctggcttccgtggacgggatgcgcgtatgggtggaggtcgaaagcggctacggcggcctaaccacggtgcatttccagttccacgccgtggaccttgatacncctgaaacct

SEQ ID NO: 560926 - DNA, 208 bp, Homo sapiens
ccttttggggttttttaaaaaaaaggggggagattcccttcgggggccctccagaccacggattgttttgtttttccccaccccgggtccccccccttttggggccggggttttttttggggcccccctattttgcgtttttttgaattttttcccccctgggggggggggggggggggccccccccttttttatttttttgggggga

SEQ ID NO: 560927 - DNA, 571 bp, Homo sapiens
cccggcccgccaacgctgcgccgggatgctccagaccttgtatgattacttctggtgggaacgtctgtggctgcctgtgaacttgacctgggccgatctagaagaccgagatggacgtgtctacgccaaagcctcagatcttctataatcactgcttgccccctgtgccttgcttctatccttcatcagtatcgataactatctttagagcttgtactgtggctacaccactggctgccctcttgaacataaaggagaaaactcggctgcgggcacctcccaactgccaccttggaacatttctaccttgaccatgtggcaatgcatgcccaatgcaggtggaagtagagcttttgtcccggcatgagccgggctctctggccgccaaggtagagcgtaggttcctgtctgcctgccgcaaccagtggaccctggcccagtctcctcaagaagttccgatgaatcccagctggatgattcacatttttacctgattgccttcatttgcctggctatgtcctgtccattgtgcattaaaccctggttctatgacattgaagaacagttctgg

SEQ ID NO: 560928 - DNA, 1689 bp, Homo sapiens
  misc_feature (1410)..(1410): n is a, c, g, or t
ggagagaactagtctcgagttttttttattttatttaatttttgggaaacagggtcgtgctctgtcccccaggctgggatgtggcagtgggcacagatcaagggtctcactggcgaacctcagattttcagggtctcaaagggatcctcccaatctcatgctctcccggtgtagctggggaccacatgtgtgcgggccaccacaccatggctaattaggggtatttttgtggcataagcacgcggggtctccactattgtttggtccaggttgggtcctcaaaactcctgggggctcaaaagcagatatctcctggcgctcagagactcccaaagagtggctggggataacaggggttgtacataccacccatgtgttttgtgggccaatatatcccacacagagatttggtagccaaataatgaaccatacttatatataccttccagtctaccacgcccggggctattaaagaaaaattccacctcttaaacagctctgaggaagaactatccaaaaaagctatgagggcaaccttttgccattaaggggataacccaatggtgcccacaacatgtgtgatgggtatgggattcccctataaccaacagtgcgaccaggagtagaagtgggacacccgtggagtaggggccccaaaacagctgtagtgtgtgagccagcgcgggggagcaccacaaaaagcaagagagacactcccacgcggagagtaaccaccgggggaggtgttgcacccagaacaggccatgaggttatcagcttggtcgaaccaccacaaccctcaatagtggcacctgagcagaagcacaagacacttagcgagaagggcgcaggaccgctatgtttgaggccaacaaacttcacatgtgagtgcttatgagccacaagaacaactccacagcaggggggtccccccaacaaagcagaaaaaacacctctgaataaaagagtccaaaaggaggccacgttgtatgggcaaaaaaaacaagaggcccgtagtgaaacagggcaccacaagcgaagttccggaagacaaagaatacgcccggggggactcccaaagggcaccagaggcacacacacccaaattgaccgccactggtgtgccaacacctgcgcgcgttatcagttgcaagccgcacaacagagggtaattattcacgggcgcattaaaacacaacgggagaggacccaacaaacaaacagccggggaggacgagaaggaaaagggcagaggaagatacagaagagatggtgcaaagggagtaacacaaacacagacagcgaccaaacaagcaatagcaagcagaaagagcaaacacacgcacaaccaacaaagcagtaggaaaaaacaacaccaacgagcgaacaatcaaatgaacccacacacanacgatagaggacaggatcacagctcatcgacgatcgcaaagaaaacacacacaggcagaaacagacgatcgagacagaccaggtacgatataatacaaacgagcgtagagaaacaatgagtgaaggaaaacaacgacaacacactgtctgttacatcctatctgctctcttcttctcttcgtccgtctctctcttctttgctcttcttattattagatctacaagacaccccacacaagcacacaagaacagaccagaagcaaagaaagacaccacggg

SEQ ID NO: 560929 - DNA, 305 bp, Homo sapiens
gcagagtccacacaggcctgaagccctatgcctgtacccagtgcaggaagagtttccacaccagggggaattgtattctgcatggcaaaatccacacaggagagacaccctatctgtgcggccagtgtggaaaagcttcacccagagagggagtctggctgtgcaccagcgaacgcttcacagaggctcacctttgaccactttcctgagagagtctcttatgattagagtacacatctctgagatgagcacctatcagtctatggatgatgagatcttcagaagccatattggtaggcaactga

SEQ ID NO: 560930 - DNA, 134 bp, Homo sapiens
tctagaggatcttaccgcgtacagttgcgcaaggcaagatgctcatgactgtgcgcatgtcaagcatgcttcgagatcatacacctgctcacaggcgagaaccctctgcaggttcctgggtgaacgccatcatc

SEQ ID NO: 560931 - DNA, 433 bp, Homo sapiens
cgttgtctcaaaaaaaaaaggtttttctctctgaattactcctgttaactgaaaaaacaagatcacagcctagaaggaaaatatttgcttgtctcacatttatgataacgggagttgtttctatggtatttcagaaacccccaaaattcaacaagagaacaacccagtttttaaagtagacagaagatattaacagacaccaccccagagataatccacagatggcaaggaagcctgtgaagatgctcagtgccattttcatcaggaacctgcaagttgaagccaccgtgaagatgccgtgatacccacccgtgctagaacagccgaaataccagcaccgtgaaaggctggagagggtccagagcagcagagactccccttcactgctagggatgagggagaatgatacagcctaggggggaatctgaggatc

SEQ ID NO: 560932 - DNA, 444 bp, Homo sapiens
acaacaccgcggtgacgggcttcttaattagcacccttctgcctgatacttttttttcgttttgttttgtttttttgagacgcagttttgctcttgtcatccaggctggagagcagtggcacaatcttggctcagtgcagacctccacctcccaggttcaagcgattctcctgcctcagcctcccaagttgctgggattatagatgcccaccaccacgcccagctaatttctgtatttttagtagtgatgaggtttcaccgtgttggccaggttggtcttgaactcctgacctaaggtgatccactgcctcgacctcccaaagtgctgggattacaagcatgagccaccgcacccagcctgctatgtttttatttttaaagaatacaaaaaaattgctgagaagaggaaaacacgtgtgcaaatgtctttaaagtctagcctta

SEQ ID NO: 560933 - DNA, 234 bp, Homo sapiens
ggctcagcctcgcagtagctgggattacaggaacatgccaccagcccagctaatttgggtatcaactgcagacgagggttggccacgtggccaggctgatctcgacctcctgacctcaagtagtctgcctgccttggcctcccacagggctgggattacaggcgtgagctaccatgcctggcctatttttttattttttgtagagatgagggtctcactgtgttgactaactct

SEQ ID NO: 560934 - DNA, 844 bp, Homo sapiens
  misc_feature (844)..(844): n is a, c, g, or t
taaagagcgaaaacccgtgtaaatgatgtcgtggtggttgagggataggatggaaaatgtgtgggataggtgtatgaacatgaggtgtgtgtatctcgtgtgaatgatgtggttaatgtggtaaatgtgtggctgggttgaagtgagccccaataggaggtgtgatgggaaaaatatgtacagaggtgctgatatacggtgcttgtagacctacgtatagtagcagacgtcctgataagatcgtgacagacgctgactacttgtgactcactggacgaacggttggtctactacgcaacacgatgatgttctcccactgtagtgttaactaacgttgggggtgataactgtgctgacggttcactgcccatgggtctatgaccacccaacgctacaattcaacacacactcgctatacaacgtgggtgagaagtccagaccgttcacgaaaccgatctcttgtagcaaagacgagacattcattgactcgacagaacctcgatcgaagttgcggtcacagctaagtcttaggaccttcagggcatacgagaacgaactcagctaactgcgcagcgccttggtacaagatcacccgattgagtgacgacatctcaactcgacacacactagaccaggcgagccaagggcatgacaccgcccaccaacgagggagagtacagacactagaaccaatgaggggacgcgcacaaccaacacaggagcgcacacacagctgagcacagcatccgacacaccccatccgcacgagacagcaacaaaccaaaagagcaccagggccaacggcaccaacccgcacaatcggaccccacccgtaccaacacan

SEQ ID NO: 560935 - DNA, 108 bp, Homo sapiens
agagaggcggaaaaatctctactttgtctcagtttcactttcagtccacaatactttttccatgcggccagaattatttgaaatcaacgcattggcagcctctagaat

SEQ ID NO: 560936 - DNA, 112 bp, Homo sapiens
gttgacaatcgtctttaaaaccttgcgtgggcaaatccttgacggaacgccgtgattgccaagggaagacaagggcgacctctgcagttccactactttcctaagatcatat

SEQ ID NO: 560937 - DNA, 118 bp, Homo sapiens
ctagttttagaagtttcaatagcacggaaactgaattatgagcagcaagatctggaacccgtaagttaaagtgtggagtcaataaagcgactcggcattatcgaactggggcaccact

SEQ ID NO: 560938 - DNA, 178 bp, Homo sapiens
acctcagtgtattccttgctcccttcctgggaggaaatgaccaaaatcagtgttagccttctctgcttggtaaaaggttttttccccaacgacttttccgtggagtgggaaaacaacgggcagccggggaacaaaataaaaccccacgccttccatggtggattccgaggggtccttt

SEQ ID NO: 560939 - DNA, 172 bp, Homo sapiens
gctgtacagttgcggtccatgttaacaccccgttgtgctgcttcttcacgaagggcagggtggcgcaggtggcggcaatccccgccgtctgtggcccgtcagctgtgtggttgcactcgtgggtcacatgtatctcatcccgcaatcttgcttgatgtcacatgttggccat

SEQ ID NO: 560940 - DNA, 121 bp, Homo sapiens
tatagaagtcgagccgtgacctacaacttcttaagtcagtacacacacacaagcataatatttcacacaaagtatttcttgtccatcaaagaataatcgatcgacaaatattcattaaata

SEQ ID NO: 560941 - DNA, 464 bp, Homo sapiens
cgagggcacgatggcgcgccactgctgcctctacttcatccccgcacgaccactccctcaggccctgacatcgagtttatggaacgcctgagccaaggtggtcaacatcgtcccttcatcgccaaggggacacactcaccctggaggagagggtccacttcaaacagcggatcaccgtagacctgctgtccaacgtcatcgacgtgtaccccgcagaagaatttgatgaggactcggaggaaccggctgttgaacgagaagttccgggagatgatcccatttgctgtggtgggcaggtgaccccaagtaccaggtcaacgggcagagggatcccttgggaggaagaccaaagtggggtaccatcgaaaagtttgaaaacaccacacactgtgagtttgcctacctgcgggaccttctcatcaggacgcacatccggaacatcaaggacgcgccatcgtgcggtt

SEQ ID NO: 560942 - DNA, 312 bp, Homo sapiens
ctcccttattgcggtgtcttatcaagaagatacgtgtccaaatagccaaggcacaggaatgggctccagacacccctcccttccagagcaatgttgaaggaaaaaaaaaaaaagagacagattctttaactgtaactctttggcaagtcttcttaagctttattatgtttaacaaatgtctgtattaagccagttctggttttcctttcaatgcagctacaaggacactggctatgcaaggtcataaattatgttatgctatagattacatgacctgtcactgtatgattaactgctttggttgggcatctg

SEQ ID NO: 560943 - DNA, 116 bp, Homo sapiens
gtatgctttaagtatattagtaacaaaatggcattaatttggatgccactgatttgtgaatttggtcatctggaaaaggagtaggctctagtttacttttccattatttgagctaa

SEQ ID NO: 560944 - DNA, 499 bp, Homo sapiens
  misc_feature (79)..(79): n is a, c, g, or t
cagttgaacattgaacagcatgggtttaaactgtgcatattcacttatacatgattttttttcctgcctctgccacccntgagttagcaagaccattccctcctcttcctcttcaacctactcagtgtgaaggctatgaggatgaagacttttatgatgatccacttccacttaatgaacagtcaatatatattttatcttcctcatgattttcttagtaacattttatttcccctagcttactttattataaggatacaatatataatacataaaacatacaaaatgtgtgttaattgactgtttatgttattgctaaggctctgatcaacagtaggctgttagaacttaagttatggaggagttaaaggtatacacagattttctactacacaggaagttggcattcctaatccctgtattgttcaagggttaattgtaatttcagttttgcagagaagctgccaagtaatacagtctataaaggaaagagtgaaag

SEQ ID NO: 560945 - DNA, 700 bp, Homo sapiens
aattctcctgcctcaacctcccgagtagctaggactacaggtgtgcaccactatgcctggcaaatttttgtatttttagtggagacggggtttcacctattggccaggctgggctgaacctcctggcctcaagttatctgcccgtcttggcctcccaaagtgctggtgtgagccacggcgcctcacccctcctaccttgctctacttttcgagctgctttggctattcttggcccttatgcatttccatataacatttcagaggacacgaagtggacaattctgggaagcacattgacaacttttacatcactctctaattcatgaataaggtatatactctctcagctcaatcccacgcgttcacacagtctctcctcaccctgtcttcactcacgttcccctcgctggagcacggtatcaagcactgctcactctctcagctcacacgacgacctactggttacgctcgacctaatcctcctacaacacacctacacgaccgctcacacaattaaacgtcataaccctacacaacagcttaccaacttaatccccactgcaatattcagtcccagtggtcacacaactcttcccagcttattctccatcacaatctacacgcccagctatccacgatcccacaagtagtaccaacccacacggcatcggccgactaggtctcccctcaaactagaatc

SEQ ID NO: 560946 - DNA, 356 bp, Homo sapiens
tgcgatcactgctacacactggtggcactgcgcaaatgaagaccccaccagctgtattctgcacattcacggtgcgatatgaagttcactgtcaaggactgtgatcccaccactggggagactgatgacgaacgctataaggataagtgtgtgctgaaagatctggaagttactgtagctgatcacattcaaaaggtcatgaaactgaacttcgaggcagcctgggcatgaggtaggggatgaatttgacgaaggaggaaacgttcaccttgtctaccatcaagacacttaaagaggctgtgggtaatatcgtgaagttcttgggaatgcacccttgtgagaggtcagacaaagtg

SEQ ID NO: 560947 - DNA, 229 bp, Homo sapiens
cattactcatacggttgtgtatgattggagagcccctctgtgaaaactccggtactttctggtgacctacttagttccgtggctccattgtgaggggattaatttctgccgatcagaacccatccctaaaacgtcagatgatagtggctttgacctagggaagaagaggttgagcgaagaaaccacaccaggtatggtttgagagtctttagtgagggtcaattggacg

SEQ ID NO: 560948 - DNA, 147 bp, Homo sapiens
  misc_feature (123)..(123): n is a, c, g, or t
cgccgaatggatcggataacccgcggagtagaaattgaagttcgcgccgaacacggagtagtcctcaccgaggccgtcggtcagcgcggattcgcgaccgggctcaccccacgtgtcgatgangcccccgggtgcgccgaagatgta

SEQ ID NO: 560949 - DNA, 503 bp, Homo sapiens
taaattcgctttcgcgtcgacagaaaagaaaaagatagtgcaggataatgggaattgagaatgctcggttagggggccaggttttagtctatgctgtttagaagagttcattgagaagatagcatctgaaaaggtgacaaattatcacttgtcctataattatgactaccaattagttgctaagaaaatgtcaggctctgaaaattaagaaaatatggatcagcctgagtgtgatggctcacccctgtaattccaacactttgagaggtaggaggataggttgagcccaggatgtcaagaccagcctgggtaacataccgagaccctgtttctacaaaaaataaaaaaaattagcctggcatggcacttagctgtggtctcagccacttaggaggctgaagcaggagggtcgcttgagcccaggaggtcaaggctgctgcgagccatgttagtatcactgcattccagcctgggcaacagaatcttttttaagactgtcttta

SEQ ID NO: 560950 - DNA, 128 bp, Homo sapiens
atggacacctgggctgattccctcatgcctcccaagattgaatcaggaagaaatcagatccagaacagactcatttcatgacaagttatgaaattgaatcagtaatttacaaaaacctatcaatcaaa

SEQ ID NO: 560951 - DNA, 495 bp, Homo sapiens
caggacggggctgaggccctgcgtggagatgctgcaccagcggaaggctgagacccgggttaccttagttcatctgtcactcgtaataaaaagaattctctcaggtcagaaaaaaaaaaaaaaaaaaaaaaaaaaaaaaaaaaaaaaaaaaaaaaaaaaaaaaagaaaaaaaaaaaaaaaaaaaaaaatgaaaaaggaaaaacaaaaataacgagaaacagcaaggacgcaaacagcagaggagcaacgcgatcgagtatgtacgcagagagagatctactcaagtccaccagacagtatcgcaatagacaaagtagaaaggcaaacatgcagagcatgagcaaataagagtaaataaaaaggagaagaaagcggcgacaatattagtaagaaaagacaaaagagagaaatgatgaatgtgagacaaaacatatagagcaagcaaaacagctaaaagaacaaggataaccacgtcgcgaaaaaaaataaattagt

SEQ ID NO: 560952 - DNA, 507 bp, Homo sapiens
aagatactggggaaggcagatgctggatttgctagacaaagactttgaaacaactgacttaaatatgctcaaaaacttaaataaaaacacaggccgggcaccgtagctcacacctgtaatcccagcacttggggaggccgagatgggcagatcacctgaggtgaggagtttgagaccagcctggccaacacggtgaaaccccatctctactaaaaatacaaaaaaaatgccaggcacggtggttcacacctataatcccagcacttcgggaggctgagacaggcggatcacctgaggttaggagttccagacccgcctgaccaacatggagaaaccccatctccactaaatatacaaaattacctgggcatggtggcgcatgcctgtaatcccagctactcgggaggctgaggcgggagaatcgcttgaacccgggaggcggaggatgcagtgagccgagatcatgccaatgcactccagcctggtcaacaagagggaaacttcatc

SEQ ID NO: 560953 - DNA, 782 bp, Homo sapiens
ctaaaacgctgctaggagctcttcctcctgatgatccataaaccacagaaccatgttattaaagaagtcttggattatgaatcaaatacaatgtatggaccttgtttggattctgttttgaacaagccaattgtaaaaataacaataattcccttgataatagggaaatgtagacatggtatggacttttgataatattaaggaattggtaaattttgatagtgtaatcatggtattgtaattatatttttctttttttaaagaaggccctgtctttttagaaatacatgttgaaattatgggtaaaatgctatattgattgcttgaaaataattggcgctgaaaagtagttgatgatagaggtaaaagagattggccatgtattaacaattgtgaagaaagctagtgattagtacacatggtattcatttatctgtattaaatctttctaccttttctatgtttatggaaaattacctttcaaaatgtaaacatatatgttttggtaaacataatatatataattccaaaatagctttattgaattaaattgtaagtcactcttagtaatttacactgtttttttgtaatataacagttattgaaataatactaatttcaaaacaatgttgtatgcaaggtaaaggcaggacttaaatgttaagtttaattgacttaggtctttccacaaaaaggatttaaaggaattaaagttcaatttcaaagtttgtacaattaaccccgtaaaacttttagggaaagaccttattgtagtttatttt

SEQ ID NO: 560954 - DNA, 332 bp, Homo sapiens
tgtaatccactcttgggcatctatccggtacaaaactctacttaaaagagacacatgcacccgcgtgtacattgccgccctattcacaatagccaggacatggaaacaatccaaatgtccatcgacagatgattggattcggaagaggtggtatatatacacaatggaatactactcagccacaaaaaaggatgacataatgccattagcaagcaacatggatagaactaaagaatctcatcctgagtgcaatgagccagataagaccaagacaaataccatatgatatcacttataactggaatctaatatccagcacaaatgaacatctc

SEQ ID NO: 560955 - DNA, 121 bp, Homo sapiens
  misc_feature (20)..(20): n is a, c, g, or t
  misc_feature (74)..(74): n is a, c, g, or t
gtgtctagaggatcccaggnactgcgagacgagagctagcagacgcacttagttgcttatagtcttcctgctgnaggaggaggtggtggtgtacttgatggtgggaacttgccggcctcca

SEQ ID NO: 560956 - DNA, 691 bp, Homo sapiens
atgatacaaaaagtactggcctgtgcagaaacaataatatacacagatcttaccaaaatagataacttagatcaaatcactataaagttatgaagaacactatgaagagagcgacaaggccatctacagaatgggagagcatatttacaaattatagtgtctgataaggtattaatatccagaatctataaatgactcctaaaattcaacaagaacatcaacatccattcagataaaacctctcaacaaactgatcataaaagagaacatcctaaaaactgataagacacatgtataagtagtatacaactaataacataatacatagtgacagtctgaattacttcctcctaacatcaagacccagactagcgtgtgtggttacaccactaaggtcaacattgtattggaacttgcatcaagtgcaataaagaaaaaaaaggaaagataacgaagaaaagagtataaataaaaagaaataagacatctagcatgaaagagaagtaaaactatatatggataggtagaatgatatattttccttagggtatatacccagcagggggatagctgggtctaacagtagctctgttttaggttcttatagaaaacttcagaatgttactacatggctgaaatatttaatttctaccacagtgtaattgtccattatctgagctcatagtttgta

SEQ ID NO: 560957 - DNA, 302 bp, Homo sapiens
  misc_feature (268)..(269): n is a, c, g, or t
gcttaagcctggaattccaacactttgggaggcccaggcgggcggatcacgagatcaagagatcgagaccaccctggccaacatggggaaaccccgtctctactaaaaagacaaaaattagctgggcgtggtggcgtgcgcctataggagtgccagctactcgggaggcagaggcaggagaaccgcttgaacccgggaggtggaggttgcagtgagccgagatcacgccactgtactccaggctggtgacagcgagagtctgtctccnnaaaaaagtcgtattacttcctggccgtcgtttt

SEQ ID NO: 560958 - DNA, 552 bp, Homo sapiens
  misc_feature (278)..(278): n is a, c, g, or t
gaccacctgtgtgaaaagcatgaggtaagacagcgcctcacctgcatgagaacatacatggagcctcagggacgacttcatttttaccctgagggaactgagggccaggaggattccaagtagaggaaggatatagggtctccctctgtctccccggctggagtgcactgacaggatcacagctcacttcagcctcaaattcccgggttcaagcaatcctcccacctcagcctcccgagtagctgggactacaggtgtcaccatgcccagccaatgtntctattttttgtagagacggggtctatgttgcccaggctggtctccaaactctgggctcaagtgatcctcccgcctggatcccaaagagctgagattgtggggccgagcccactaagtgggccatgcttctcctttatttgcttcctgctgaaaggccagctcctcccagagcagaagtttctggtaactttgctcagggccatggtcccaggcacacaagtaaaagtactcagggaacatttttaatgaacgaacaacaccttaatgtttaag

SEQ ID NO: 560959 - DNA, 197 bp, Homo sapiens
ctgccagtatattgtggtggagaaaaaggacccaaaaaaaacctgttttgtcagtgaaaggataatttaatgtgcttttagtaggcacagggctcccagggcaggcctcattttcctttggcctctaaaagtcaaagattgtggaaccatgcccatcagtaaaaaaattttttagccaaccctttgaaaaaaaaaaa

SEQ ID NO: 560960 - DNA, 1045 bp, Homo sapiens
gacatgctcacagaactcgcaaactttgagcaagaacgtgagccaagctatccacaagtacaatgcttacagcaacaagccagcatctgttatagcaaaatacctacacaaaataaagcagtggcagctgcaagctaaagcaaattggcctggcagtcaggtaaccaaacacattagctgcacacacagcattgcatgcagttatttcagccaactgggccaacattcacgtaaactgggcacacacagccattcgagccaggcatgcaatcacgcaagttcatccaatcacagtttaccatgcactcgagtatacgtggcatttggtccaatctgcatgaaaaggagaagatatatgtagacatagaacggaaatttaaaacacctagacaaggactacaacagattggatttccaatgcccaagtacacacgggtacaccatgaacctgggacactggaggtcaccattttaggaaccttacatactggggactggtttactgaacccaactatctatacagtttaacaacatcactgcacgactactcagaacacacaactgaccgactaccaatttgaaaagcatacaatacgccgacatatggagcctgaaaactactatggggggaccttttggaataaagagaaattacctcgtatgaaaaacagaatggttacaaaatgcaaagaatatgggtacctaaaaattgaagtttaacaaacaggtggatttctagaaatacaattgataacaagataatgtgaggaagatatacaaacggaggttgagagtccaagatgtggtgtgacatggaatgtgtcatccataaagacaaattccgaagatttcaactttcagacattatgacaacaaaggccaaacactgtttacccttcaagaatgatggacgccgattccaaacacggttcaaattgtattaccagaatatccatgtttccaaaggggtaaaacacaagtcaacagagatgttatgcccgaatcccaagaaaaaatgtgtgtatgcaaatatttcacacacaa

SEQ ID NO: 560961 - DNA, 259 bp, Homo sapiens
aatgcaccaatcagtgctctgtaaaaacacaccaatcagtgctctgtagctagctagaggtttgtaaaatggaacgatcagcactctgttaaatggaccaatcagcaggacatgggtggggacaaataagggaataaaagctggccacccccctgcccccccgccccgtagccagcagtggcaacctgctagggttcctttccatgctgtggaagctttgtaattttcctcttcccaataaatcttgaagctactcaaa

SEQ ID NO: 560962 - DNA, 183 bp, Homo sapiens
ctcttggcttacgagaggagtcccgaggcggcgggcgaggggcgaacgaaccggacgccaaagatgggcgaagtaaaagagattgttcgaaagatacttgtgggagggaagcgtgtccatcaaatgaaagaattattaagattctgggaaagaaggaaatacgaccggttttcttaattttga

SEQ ID NO: 560963 - DNA, 163 bp, Homo sapiens
  misc_feature (124)..(124): n is a, c, g, or t
ctggattaaattagaattttctgtgtctgcaacttgtttcatgacaccttggttttcttaatcatcttgtattattatttgagtgaacattattcttaatgcatgggtgactgaaaacctgaancaagattacttgttaataaattgtctagagactatgact

SEQ ID NO: 560964 - DNA, 968 bp, Homo sapiens
cttgaacatgtattaacaaatagttaaaaatgtctgctatgagtaatacggttcatgttatggtttcttgaggttcatttcacttgtcatggagttctacaagcagggtgtaacatcttgggcctgttatctttgcacatttacttgtgcccatttttcatctaaggagaaacttaaggagtagagcaaaggatgtaagtctccttaaggctactcaggaattgataacacagtaagaatatagaagttctatagcaagattcttaaagctgttgaataaaactcttcctttcctataaaaaagactgttctgagtatccagtacagagtatcagtttataaccacaggcagggtatgtaggtgggcttcgattgcaggtgctgtgtttgctgaagtctgtagcagcctctaccatcaaattcataatgatatgaaacatctatggttcttagaaaaagaatggttgagcaatgtgttactaaaagcaattggtctcatcatgttaagtgttgatgccctcttatcccagaacctggctgaagctggagtcaaaatctatattggttaattttaagtggccttgtgaacaagtgcattcaggcaatgaaggaactgaaagctacttagaccaaccaggctctggttgtggactctcggatggggctgggctttgttacggaggtgactacatgcttaagttctgtgaaggacggagtgcaattcaggaccagtcgtgctttatgaatcaggtgcgactggattttacgaggctatagaatagaattaaaagcctattgcaatattgaagggcctaaaggtaaatggtcggactaaaaaaggattacgtaaaacgtcggggtggatccggtccccattgagagggccattgcacaaaagctcagggcctaaaagggggaagcgccactgaatgaaagagtacgactttatacttttatatttcttcgcg

SEQ ID NO: 560965 - DNA, 398 bp, Homo sapiens
  misc_feature (311)..(311): n is a, c, g, or t
  misc_feature (338)..(338): n is a, c, g, or t
tcctgaatctcgatgatttttgttcctatccatattctgaattctacttctgtcatttcagccatttcagcctggttaagaacccttgctggggcactagggtggttgtttggaggaagagactctggcttttcaagtagctatatagcaatgctccactcctcagtaccaattttctgtgggcaggccatccttatattgcaaaaaatacctgaggctgggtaatatataaagaggcttaattgggcttatgggtctataggctgtacaagcagcacagtcccagggcatctgcttcagcttcccgtgangcctcggaaagcttaacaattcatggntggaaggcaaaagggaacccgatggttctcacattagttgagaattcaaggagttaagga

SEQ ID NO: 560966 - DNA, 358 bp, Homo sapiens
caatcagtatgttccctggaaagatgaataagtctcatgactaattttttaccaattgtttaagccaaagaaatccctttcttttttttactcccaaagcacagtatctcaacagcagcagcccccatggggttttagcagcttaactttaccccctaaatacagctttgtataaaccagtggttttcgctggagaaaccgctgtccttcaaagcaaggagtggcagccagacatcaatgcaaaacttggaatgattcgctaatcaacatggcacttaccaaaggtcgcttattcgaatattccacttaagaagaggttacttttttgtccctccttgccccctggaaaaacaaaaaa

SEQ ID NO: 560967 - DNA, 375 bp, Homo sapiens
cagtactaaagcctgttttttggaggaaataaaaaaaatatgtttggaggggcctgaatatgaagaactttgttaaatacttttactccagcaaaaagttggtcagggcgaaggaattcccttcctcagcactccctgttgcctggccataaagaaggcctgcttggcagtagcaataaatgtcctgtaagctgccccctgggaaaaatttttatgcaggtggtaaccaactgtcccagtttgcttggaaataaggggttttttgtgacttgaaactttcaatgccaaaaatggggcagtttcaacctcccccccttttggtcagcctaaaaaccgccattttcagcaaaccctgatgaagggtccaaagtaaga

SEQ ID NO: 560968 - DNA, 158 bp, Homo sapiens
  misc_feature (148)..(148): n is a, c, g, or t
gtaggctgggcctggcctcagaacctggtggctcctgcctgctccttcacttttgtaaaaccatccccttcaccagaatggtattaactcctggtgctttgtactacaggtccacctaacctgggctccttttctatattataaaaancgagtatttt

SEQ ID NO: 560969 - DNA, 283 bp, Homo sapiens
ggtctcacacatggcccaggctagttttggaacttctggggctccagcgatgcttccacctgggcctcccaaagggcggggataaagccggagtcacggggccggtcactacaagtggaattggtagtgaaaacttttactacaaagaaaacggcaggtccagatgacttcgccagtgaatttaactgaacataagggaagacgtattgggatgacatctaagcaccttcccatatggtgctatgaggccagcattacctgataccaaaggttagaccccgtc

SEQ ID NO: 560970 - DNA, 945 bp, Homo sapiens
  misc_feature (489)..(489): n is a, c, g, or t
  misc_feature (691)..(691): n is a, c, g, or t
ccacgcgtcggtagagaaacaagaggaggaggaagaggaggagctgctccctctcctcgtcttcctcttcctcttcgttcgctccatctctgggaggccatatgccagggaggacgcgaagaagaggaagaggaacgaggtagcgagagggagaagcgacaagacggtagacgaaacaaaacggagggaggcacagaggaggacgactgctcccatgagacactgggagtccccaagcacagcaagccaggtgcttcagggtcccggatgaactatctctgcgtcgacccagcatgtgagtgcatgacctctccagggtgaccacacaaaaatagccagggcacttgcacagggaccgtcacgcgagggacactacgggacccctacgatcaaggatggtcggaagggtcggcgagaaggccgacggtcgactcgagggctgccaggcgtttgcgtggctttgcacatgttcacgtacagccctcaacnatcagcgaaggtgaactcacgaagggagcagagccatgtgagccatccgaacgccagctcaggatgaatgggctcatgaggggcccaagcaagttaggcgtgcgccgattgccctgccacgtggtgcttgtgcggagtaacgcacggtctcagacgccgcatcacaatctcacgccgaaggcgagaggcccgagagcgaaangccgcacgatgtgagggaaatccacgcttgggtgttcgtcatagagccaatgacagcgaatggtagcggtgaaccggacttctgtcggttcgaattctcggcgtcaataggacaacaggcatcgtcaatgtgtgagccctgaaggccaccccaaagatagtacattgatccccaacggttgggcttcctaagaaacgcgtgcaggcgcttcttccccacacctgagtcccattggatggaccgctgggaacctg

SEQ ID NO: 560971 - DNA, 955 bp, Homo sapiens
tgttaatacggcacgaggctgtctccgtccttctatcaaggaggtgttccgctttgcctactacaagctgcttaagaaggcagatgagtgggttagacatcgcggggagtgaggacggaagatcacccatctccatccagccagatggactatgtaactggtctctccttcgagtatcatcagtggtgtcttctcatgttatcaatattatctggctgatgcactctgaggccaaggatgtgagatatagagatgattccaatggagaggtgcacccctcttacattaccactgacatatcaggcacatttctgaacaagacaagacagtataatccatgctccaatacccttaaatgagagaagttagtagtatcttatgaatgcactgattgaaacgagatggccaggatacatgagagactatatgaggaccattgagatgagattggggaagatcacactacatgacatcagacgacatgacactatcctttgaaaccacacatggataatgaagaccaagacatgcatgccacatctaatggcagatcaacatgattttccaatgtggagcatcataggagacctatcaatcaacagaatggaagaggtcccctaccagaacagataatacaagaacagccaagcacacatatggaagtaaagtgaacatgacataccccttgggcacattgaatcagcaacagtgaaacaagaaattcctcacaacattgggcgatggttccaaacataggaccgaatagaaacatgacagacccaaagacaccaaagaccccaggggtcccaatttaggcacaaaaaatagaacatgtcatacctaaatcaggtcaagcactaacaaacaaataacataccaaagaaataaagcaaatgacacaataagaaaacccgaaagacatcaacctcgacccaagaagaaccatgagataagc

SEQ ID NO: 560972 - DNA, 460 bp, Homo sapiens
gcctcgtgccgaattcggcacgaggctgaagagtaagctatgaaaagcttcagaaaaagcaaatgagggaattcagacggacaataccacaaaatcacagggaagatcggtctgatattcgagaggttcaactgcatacaactagaggaattccgtcagaaattcgctggactgggagaagcaacgcttgatttatcagcaaacaggtatcttctactggaggtcacaaaggaaggactttggctgaacaatctgagataattcaggctcagcttgtcaatcggagacagaaattagagtctgtggaactttctagcctatcagacattctacacttaagcagtaaactgacgcgggctaatgacactatctgtgcccatgagattggcaaatagagcgccttaccatgaggtcaatattaaccctgaccatatatcttcaacgtcccccctttatcctc

SEQ ID NO: 560973 - DNA, 172 bp, Homo sapiens
ggcggtcatagatgaggcagcagcaatatcagtcgaatgaggtatcaagcctcaggcccatcacatcgctgtggaggagatctgtgagaagcttaagaagaaggacagccagatatgtgagcttaagtatgacaagcagctcgcccctgagttagcagctcgcccctgagtt

SEQ ID NO: 560974 - DNA, 341 bp, Homo sapiens
gcgtcgacccaaattggaatgccagccagatagacaataaactaacaaaagaaaataaagtggccgggcgtggtggctcacgcctgtaatcccagcactttgggaggccgaggtaggcagatcacaaggtcagaagttcgagaccagcctgagcaacatggagaaaccctgtctctactaaaaatacgaaaattagccgggcatggtgacacgtgcctgtaatcccagctactcaggaggctgaggcaggagaatctctcaaacccaggaggcggaggttgcagtaagccgagatcgcgccactgcactccagcctgggtgacagagcaagactccatctc

SEQ ID NO: 560975 - DNA, 235 bp, Homo sapiens
gctgttcttgaggaccccgcgacgtacagttgcgtgctgcttgcgggcgcgcacgcctgactggtttcgtattttttggtggagcaggtttcacctgtgttggcgggcgtggtctccactcctgaccgcgagtgatctgccagcctctggctcccgagttgccgggattgcgggcagagtctcgtccactcagtgctcaatgttgcccaggctgaagtgcagtggtgtgatctca

SEQ ID NO: 560976 - DNA, 166 bp, Homo sapiens
gctcgacctaaaaatatgaaaaataggcaagcatactgatatgtgtctgtagtccctgctacttgggaggctgaggtgggaggatcactgaagcctgggaggggggcttgcggtaaccgagattgtgccactacactccagcctgggcgacacagaccgtgtcttt

SEQ ID NO: 560977 - DNA, 1323 bp, Homo sapiens
aacagaggacctattcacgcttcaactgtatgggacacagccggccaggagaaattcggctggcactgcagagcactggcctattatactccaagcccagtgtgccactcataactgctttgatgtaacatcgagagcttacttacaacgaatgtgcctaactggcatacgacgatctggtacgacgctgtgctgacaaaccattccccattgctgcttgctgctggcaaccaaaaagctggcactactctaacgcgacagcgcacacagctgacagcgcgcaacactccacttgctcttcccaaccggaacagcaagcaactcctctcagcttaacctaacgaaccaactctctcctggccaacacaggctaacctgacacacccttctgacacacaggccccttcgcttctgggctttgcttaagggacaggcctcgactctgggcacgacccctaaaccctatggcacacttttggatctggccgaatggtccttggtcttccctccgagcacccccaaccccaagacaggtttgggtgccactcgcgcacaccccacgaactacttgggcgccacggcccaaccaagcctactcggcacgcccaaccggaaacgttctaacgccacgcggcctttgccctcccaaggccaaccaaaaacccttggacgttcattacgcacgggggccacttggcaacgccgcaccttggacctcgccacccccctggcctgcaccgcacaactcgcaacaccggccgtggagacgacgacccctccaaggcaccggctttcgcaggcaaacaaggcttccctaaagcctctctctcaacttcacggcggcccacgcccctgggatttcaccctagacctggccaactcgcgctccacggcgcggcggcgtggctctcacgcccggcctggttgggctgtccccccaaccccgttaccgacttttgaatcttcaatttccttaaagacctttaaaacggccccgcgccacacacaactgggttggcccttctaccaattcccttaggtcggcgcgcctacttgtgcccttggtcacacacgccggacggcaacttggcaaggctgtgggggtgccccttctcccggacggcaaggattgcgacacacttcggttcggagcgcccaaagctcctcatcacgacgcacacacacacacatctaaaacccgttttccccccttcgcgggctctcccgggaggacacccccttgggccgactctaaattctactcagacgccctaggcgcactcctctcgggggacaacccggcccacacatcctctccgacac

SEQ ID NO: 560978 - DNA, 335 bp, Homo sapiens
tatccgccaccatcttgttgtaggctgcggagcaggctggaagccctgcatgctgcgattcaattcacgcaacgttgactgcatatccgtcggcaactgctgcatcgactggctagcgaggatcttgttcatgctatccagcgtcgtttgcaggtttttcattgtgcgctgactttcagaaagcgtactggttgcctgttcaatcatcggattcaatggcagtttgttgatcttatccaacgcttccatcagtcgttgctggatttgcgccaggccgccgctaacggtcgggataatctgataaccattaaattcacggaataccggttattgca

SEQ ID NO: 560979 - DNA, 480 bp, Homo sapiens
ggacctaatacaatatatttaatttttaattaaactcttaaacttttcttccaaaaaaaaaaaaaaaaaaaaggggaaaaaaaaaaaaaaaaaaaaaaaaaaaaaaaaaaaaaaaaaaaaaaaaaaaaaaaaaaaaagaaaaaacaaaaaaaaaaaaaaaaaaaaaaaaaaaaaaaaaaaaaaaaaaaaaaaaaaccttttgggcccctttgccccaaccaattttaaaaccgaaaaaacttaagcaagggggcccaaaaaaaacccacttggccaaattcccctaaaggggggggtataaaaaaaaaagggcccgggtttaaaaaacccggaaagggaaaaaccccggcgttcccaaaaaaaaaccccttgaaaaaaaacccccttttccaaaggggggtaaaaacaaaaaaggcccaaccaaatccccttacaaaaatttggcccccccgaagggggaaggaaaaatgacgctttttc

SEQ ID NO: 560980 - DNA, 448 bp, Homo sapiens
taaaggtctgtattagtctgttctcatgctgctaataaagacatagacatgactgggtaatttataaagtaaagaggcttaatggactcacagatccacatgactagggaggcctcacgatcatggtagaaggcaaagtagaagcaattttactgtgttacatggcagtaagcaagagggcgtgtgcaggggaactccacctttataaatctgatctcacatcagatcttgtgagacttattcactatcacaagaacagcacaggaaagacctgctcccatgattcaattacctcccactggggtccctcccatgacacgtggaattctgggagctacaattcaagatgagattagggtggggacacagccaaacggtatcaggttccacttgctctgtatcctcaccaacacttatttatcttcctcattatcgccatcctactagt

SEQ ID NO: 560981 - DNA, 159 bp, Homo sapiens
gtcgtatccgtacaggaaagagacggctttggaggctggcagcagcagaggaagaggtcgtggccgtggcgactggagcgtgcgagccccttggtggcgtcccggagataacatacacggtgccagcctgataagtgtgggcctcgtcataggcaaaag

SEQ ID NO: 560982 - DNA, 785 bp, Homo sapiens
gtcctatctccttctgccttctctggcccagtgtgtgtgggaggagggtgatggttatgggtggcaccaggttccccagctacctctctccccatgttttagataaattaacactgcctggagtcacgtgtctctttccctgcagagccccaagaccaggtcaggcatggggaggtactccagggatgccggtgacctctctgggaaggctgtagtctattctctgttagggaataacttagagtacaaacagataagctttcagacaggctttgacaatctttaagcccccatcatttggacatgctaatagcttgatttgtcccccgggcagccaacctgtgctctcagcctcgggaccagactgcccaaaggtactgctgcttggcgctctcagtatggaatggtacttggcagggacacccataggcccggcactgcagctggaacttgcttctgcctcattgcttcatgcccgacctagagcccggggcttgtctcctaccccagccctgcctcctcctccgggcagatgccagattgcttgacagaacggtggagactcggatttgcccaccagtcctgaggcagctcacgggtgccccttcctctcttgtctttgcttttctgaatcccccaccaatgtgcctcagctgctgtgctatgcggaatagcatttcttggtgaaggggctggttcccattgaaagccccctcccccaaagttacattctgcagtgccaaggataggggcatgtgactggaaggtcattcttggaagaccta

SEQ ID NO: 560983 - DNA, 191 bp, Homo sapiens
gtgcatcgagctcggaccgctctcctttctaccttttattgggacgtttctctacagcctgagctctggttctcccctccccttgtgattttctctggaaatcacagaacgttagtacttatagcagtaggaggtgcagagctgaagtttgcccagcgtctggcctgcagagtctcacggagtctcacgga

SEQ ID NO: 560984 - DNA, 229 bp, Homo sapiens
gggcgacagggcgttgtagaggtcgatggcgttcgcccggaacgacaccaggcccgcgcccgactggttcggattgaaagagttgaactggcaggccagacagaactgcttcaccaggctgccggcgtattgctggacatcgcgcggcgacgagataccccagctacccaggtcttgctgggtattggggctggtctgcaccatggtcggcgtgcggtagtcagccccg

SEQ ID NO: 560985 - DNA, 287 bp, Homo sapiens
  misc_feature (30)..(30): n is a, c, g, or t
  misc_feature (69)..(69): n is a, c, g, or t
actctagaggtactgagcacgaatgttcgngaacgaccttgaacatgcttcgccaaattggtgatgtangccgacggaagttaattcagtaccaacgattcgcttgtggtcctatccaccctagccatcttcagcccgctgcagagaacgatcccagataaaagaatctgggagacgcaaaacactcgcactggcatggcctcgactcatcttgcctacagcttcaaccaccaaaatctgatcttcccccggtgccactatcaaacaaggtacattcgggtgctcaa

SEQ ID NO: 560986 - DNA, 115 bp, Homo sapiens
tatcctcaaatcgctctgctcttaatggtcgtttgtacaacgattaatgtcctacgtgatctgagttcagaccggagtaatccaggtcggtatactatctactatcaaattcctc

SEQ ID NO: 560987 - DNA, 853 bp, Homo sapiens
agcccaaaaggcattgtgggagtactggctctttcctttccgtctggcggcagccatcaggtaagccagatggtgtgcatacaatgtacattccaggaggctatggagagaaggagtgctgtctgattgtcatgcgcttgctctcggagggtccagttgcttggaatgtcaaccggcgagtctcatcgtgttctccgaagagtggtttctcccgcccccaagcccgggcctttgataaaggcgcgccgaaatgtggcttacaagaggccaaacggcacaggtaacggttaactatatagggatccggtggtacagccggatggtgggccgaaagaacggcccagttccttaaggggttgccaattttaacgggacaagcctgtcccactcatggttgttaaacccaggctaagaagtttatgctcgaaaggcccttacagctcacggttttggccacaagtgagagccagaacgcttggtcaacgcccaacctggtggagaggggccctccattgaaaggaacggatcccctcatgagaaatccccttatacccgaaggcggttcaggcggtcagcacaaacaattccccacgatttaaccacgactttctctgtcgaggcacgcgctacatacccctcccatttgtggatccctattttccccagtatgaaggcttattccagggaaacggaaagattccggtggacgatgctccagtgtgtgatttcaccccaaaatgacccatgtgtcccaatcaaaatgcgctcatgggggatgaattgccgttggagtcgctggaagatttcttgccgaccggggccggaatagagaaggcccggtgggccatttgga

SEQ ID NO: 560988 - DNA, 162 bp, Homo sapiens
ttatgcatgcctggagtcccagatactctgtgatgctcccatgtcgagactccaccgatatctgggactccaagaatgcagtagacacatgagctgcataatttgtgtatctttggaggatactctatagctcagaattgtgcccatgcaagtttgaaactg

SEQ ID NO: 560989 - DNA, 462 bp, Homo sapiens
  misc_feature (414)..(414): n is a, c, g, or t
catgggcctagctgtgatttaaagttctcatcttctgggccctattctgcctgatgtctgatggcatcgcaaccccagagagcacttcttagctttctgattcttggaaatgaccattctaaaggcgcccacgcttttggaaagtgtggaagacattaaaagcaatctgtgaacttggccactctgcttagcaagtcaacttgaaaaaaaatcacagcaacttaagaaggtgggcctgattctctaagaaaccgcagccatctgaggatataggccactttatgcaatgatactattctgctcttcgtttctcatgaggaggggcccaagaaggatattcccaattggtaagactgatgtgtgcaggaagaaaaaaccaaccactaaatcggggttggaagtgagaagaaaggnactaaaattttatgtctgcttaataaatgcccactatttttaaaaaaa

SEQ ID NO: 560990 - DNA, 221 bp, Homo sapiens
gtccctgcatagaagaggcactgtcacccaggctagagtgcagagcatgatcactgcagccatggacacctgggttcaagcaatcctcccacctcagcctctttagtagctgggacaacaggtgtgcgccaccacacttggctttttttttttttcttttttcttttttggaaatggagtcttgctctgtggcccaggctggagtgcaagggtgagatctc

SEQ ID NO: 560991 - DNA, 299 bp, Homo sapiens
  misc_feature (19)..(19): n is a, c, g, or t
  misc_feature (74)..(74): n is a, c, g, or t
  misc_feature (135)..(135): n is a, c, g, or t
  misc_feature (239)..(239): n is a, c, g, or t
ttacaatagggttatgttncagtagacccattgtaaattgaaaataccgtaagttgaaaatacatttaatacgnctaacctactgaacatcccagcttagcctagcctatcttaaatgtgttctgaacacttaangttggcctttagctgggcaaaatcatctaatacaaaacctattttataatgaagtgtttaatatctcaaataagagtattgtaccacatatcgttatcccgggnagtatcagagtacaaaatttgaagtacagtttttaactgcaatgtgtattgcttttgccc

SEQ ID NO: 560992 - DNA, 168 bp, Homo sapiens
  misc_feature (118)..(118): n is a, c, g, or t
ctcgtcggccagtatctagccacacttacatccatgtgtcatgacatttctggagaaagcagccagtgacactgttgaataaaacacacaatagtctctgtggtcttctgcagcccancccacacagtgacctcaggttgattctctctttttaatttgcctgtaaag

SEQ ID NO: 560993 - DNA, 260 bp, Homo sapiens
catctaagggagaataggtgccagatgtcagaatatctacaatatcatgatattcttcatagtcaaggaaatacctctgaagtaagagacactgccatagaagtgggacacggatgtgatttccatattccaagtcattcaaagacagatgagtcatcaccagtgttatcgccaaggaagccttctcacccagtcatggattttatcagatcacatcttttagctgactcttcctcaccagcaacaaattctagtcatac

SEQ ID NO: 560994 - DNA, 150 bp, Homo sapiens
  misc_feature (126)..(126): n is a, c, g, or t
agaggtggaggaaagatggaggaccatcagcaacgataccgatcgacatccagacccagcaagctcttcgattggactggaggacagaaggaatgcagcctgaaatggcagagttgtatgaagatnccgagaagatcaatgatgacatac

SEQ ID NO: 560995 - DNA, 281 bp, Homo sapiens
  misc_feature (236)..(236): n is a, c, g, or t
tgcctccttagggactggtattatttcttcatcttattggcaggtgagggtgaagggcacagaccctttggaaatgtgatgaaagctctgggtctactcaccagaaaactgcacatacaatgacacaattttgtacggattttcagggggttcctggatttccctgaaaccttttcatgggtctcagagaacctctgccttaggagaaacaatcttaaatcaagagagtgtgacangagggccagacgtgatgctcacacccagcgcatcgtgatactctg

SEQ ID NO: 560996 - DNA, 199 bp, Homo sapiens
aagaccggcatagctacagccagcgagggctggaaatgaggagtgccgcggattacaaaaaccgggatagggggacccggggtaaccaccgcttcggagcttgggcggagcgggctgaccagcggggcggccagggcccggcccgcgtccccagcgccagcccggcttctccccatggcgatgggagcctcggcggccg

SEQ ID NO: 560997 - DNA, 95 bp, Homo sapiens
tggtgtatagccaggtcaaccacgtgtcttcgacatgcgtcgacggcgagcctgggcgcgtctccttgagctgttgcagacaaggtcccaaagac

SEQ ID NO: 560998 - DNA, 827 bp, Homo sapiens
  misc_feature (605)..(605): n is a, c, g, or t
ggaatttcattcagcagattgtagagtgcttagggcaggatgatcatttgcacaatgttgattctatgagcatgggatgtgttgccattggtattgtgtcatctataatattcagcaggtgtttggtggattcttcattgataccacgatctattgcagcctccctgtggttgaagctatattgccataggttctctgtattagcgtcatattgatttctgcatgtcgtgcttgtaagagagggtatgagcagattcattgatcgagttcatcatgcattcgactcgattgtttgtgtgtatcagacatgttgctatgtttctatgagttgtaagacattctgatatattagtatggcgcttgacgagctatgatcttgtatttttgttgtctatggacaatgtctatatgaggtacttcagttggacacgaagtacttttaggtgcattggttctaacgagtaattatggattccagtatgtacactatcttgacaatgattatgagagaatacggtatagaatctttgcgcttctttggttcccatatcccgtgaatgactccatcttatatttagttctacgttctctgactcattgagtangtctcgtagtgcatcaaggagttgtcaggaaaactgtatgagattaggcatggagtgaagatgtgtggcagtcatatgtgctttgcttacctagattctgctagtagtggagagagtagtgtatcaactatttcgcacactatatcagtgatatacgctatggtagtaggcgtgtagtacagtagtatcctacaatattatattgtatggatggaaggccaa

SEQ ID NO: 560999 - DNA, 118 bp, Homo sapiens
gtttgacttcttggactgtgtggccgacctccaaggggaaggaggtgaagcgggcagccctcaaacgagctggtggagtgtgttgggagcaccccgggtgtcctcaatcggagcccgt

SEQ ID NO: 561000 - DNA, 307 bp, Homo sapiens
ggatatctacatcctaatttccatttgtaaagtgtccttttttatataaaatatcttatttaaaaaatagagatggaggttgggcacaatgggtcacgtctgtaatcccagcactttgggaaggccaaggcggacagatcgtttgagcccaggagttcgagaccagcctgggcaacatagtgagattccggctttttttttttttttttttttgaaacagcctggggaacaaaaccaaaatttttcaaaaaaaaaagaattcttaaaagccccggtttatttgggtcccccccccaacccggaaaaa

SEQ ID NO: 561001 - DNA, 221 bp, Homo sapiens
gtctgcgcaccagcagatgtgcactaggggatggaatacgcgggctctgcggtcggggtccaaatcacacccatacctcatcctccaggaacatagcatatttgacgactgacaccctcgggggtttggtgcttgagggccacgccgagagacgttcaaacgcaaattcacaaggacgctgacaacagacaagtgcagactaacagttttcttgctgcatg

SEQ ID NO: 561002 - DNA, 1112 bp, Homo sapiens
gctccatctcaaaaaaaaaaaaaaaagcctgacagctagcaggttccagggatccatctgccaagtttagtgaagggctggagcctcaaatcatacagatgagggtcattttctcctccttaccttctgggagttcacgatttggaagggagtcctgaaaagtactgatagagcaagatgaagctatcagaactgaattgggacttcctcggggaaactacacctagttcatctgaagtgtccacgtaaactgcagaaaaagtttccaatggctgggaaatcttctctacataactaatcggtggccttcctaactcagaagtggcctgtgcccggctcagctggtgactactggacctcaggacctcactgggacagggcatgtgggggacccttgcaaggatgccctgggttaagggggtaacaactggatcgctaatatggttgtctattgaggtgtttacggcaaatggggcagtactacatctctggttctacccaaggtctcaggaaggtggcacgtggggtagcagatcttaccggggtacaacgtgggacacaccgtaccggaactaccacgggagattcgagagcaatgtatcatacactgtgccatacaagcccgtggatacgaagtgagagctagggggatactcaacgggggagacaccactattaaccgatttgtacccgggggacatacagagattagggcctaaatatctaacacagcgatacgacagaacgggggggatatacccggcccacagttggttgtggtgcaaacagggggcgcgagaggaaccataatggaaaaccttatcctgttgtaacccatttacgaaggggagtaggaacctctcatgggggcccacagaacgccttagcggggggcacttattccacaaaagagtgtgtgtggcactgcggggaggatatcaccccaagggggatgcattttagaagccgacaccacagtggtggaaccccaccagagggtcacgttggaataccccttatattagggggtgacgactacatttaatttgacacatgggcgaatgacaacaacccaacgccttttcaggggacacacaaacatggaacaacta

SEQ ID NO: 561003 - DNA, 628 bp, Homo sapiens
gctcggctccctgcaacctctgcctcctgggttcaagcaattatcctgcctcagcctaccagttagctgggattacatgtgtgcgccaccgcgcccggctaatttttttatttttagtagaggcggggtttcaccatgttgaccaggctggtctcaagactactgacctcaagtgatccccccccccccgcctcggcctcccaaagtgctgggattacagacgtgagccaccgtgcccagcggtttggcatttccaattgtggggcacggtgagaaaagacttgaagcaaagcaagggagtgagatccatggcaaatgtcaggggggaaccttgcaggcctatggacccagcccagtgcaaaagggcctggggtgggacgctgactcagggtacgccaggatggcacgcaggcacacgtgccgcagaggaagccaggggccaggtcctgccaggttaccaggccatggcctatccctgaacacatgggcaggcaccgagcagacgaagctgccctgactcacagcccctcaggaccccccgggccgctgccgtggcaggcagaggcgcaggtcgaaacgcagggctcaccactcaggacgcgggggccaacccccgggaccccgacgc

SEQ ID NO: 561004 - DNA, 154 bp, Homo sapiens
cctgaaaaacctgcggtcttcattagctatataacaataatctatgtcttagatcgtgctttgacttcaaattcttagaagtaactaaaggacttaacattctacttctttgattctaggttctcgtataacttttcagatcacgtcatgctta

SEQ ID NO: 561005 - DNA, 1178 bp, Homo sapiens
atttgcgggctgtgtgccaagctggccatcctgtcctgtggtccaccctggccagcccgcacaagcctgcgccgccgccgagcgtttcgtgatgccggctgctccggaggatcagtgaatggggcttcggtggtgcgctggtgctgctgctccgaagccctggcgcaccgtaagagcctggtgatgctgccctggagcctgccctggctgccctggagccccatctgcctagtgaccgggagatgctggaaatgcaacctgcctgttccccgaggatgcctgctgccccctgggaccccctgtgcactgtgcgcaccctggtcagcaagcccccggagaagacggcgcccccagattgcccagagtcctgctgtggcctgttggcatgctgccaactgactggagccctctagtgcagactctgcatgggccacatgcagctcatgcctgccaggtgccccctacggaaaccaatgaccccacaggcgcggggcccatggaagccattggcccatacataaggggttacctaggaggcccaggaagctagaggagcacaacccgtacaagaacacgaacaagaatatggagcgcatacaagagcattagcaaactatacaggccttatcaacagccatcatacagccatcataccattaggcaaatataaacccattagatagatttatccaagaggattaacccaaggtgcattagacaaagccaaatatgagaaccatatggggaattcaaagagcaagactccgacccgtaacctattccggtgggcaggcaggcacccatcagagcttgtacacttcacacgactaaggaaccaccaaagacggctgcatagaatgcatgcgaaccaaagaaaaaacattttctatcccaaggaaaaagggtacgcaaggtgcaacacctatagattgaattcgcccattactcgggtgacaccggaacagtgcccccaataagagggaagacccccaaagcgatgatttataccaaatgctgtcagcacccaggacacagcacaggcaccagaatacaacgcaggcacgacattcgacaacttcaacagagtagatatcaaaaaacacagactatccaaggagttataaacccgaaagactatgagagacaaccacaagggatgggggatagggcccacgaat

SEQ ID NO: 561006 - DNA, 400 bp, Homo sapiens
gaggatccccttcgttggcagggtctggagtctaacctgataacgatcctacattaggcttctaaaatatttgtcaggagggacaataataacatgacactggccggttacagtatattgaatatttaggaaggggatggcgagacagtcagttctcagaacaaattagatcagcttcagtctcgtcagcagggtctttggattctttgttcttccgcacttcttcaatgtgcttatccttctctcgcaaacgttccagtttggcagccatttgtgcctctcggttctctttattagcttccattttgtgggtcagtttctcttctgccattttactgaagttgttgttctcttctattgccttctgaagcacttctttctcgtgctctcgtttctcagc

SEQ ID NO: 561007 - DNA, 522 bp, Homo sapiens
ggaaaaaaattccggatcccaagcttggaacccagggattgcttcaggtggtatgggcggtggtcttggagtcatcacttttataaatagtggttcagggaccacagagagagactgcttcatcgaatgggaagtaccaaggagaaagtacaattcagtattgtctggaggcaagtggacactttgtacctgaggtttagaataggtggcctcttgccattacaatccccagccgtttcctgtgtccggaagtagtaggattgccttaagtctcagaggattactcagcgctcttgaaacgcgtattgcccactgtgacagaggcccttcttgggaaaatggatgtgtcagggatacccaatttcacatggtaattgggaggtttgtaaaaacgcattttttgatagttttgcgttgagaaggtaaaattcagcagtgtggtttgaacccccaaatctttcacatacgtgtggaagcttgggccacagataaaaatatgcagcggaagaggccgtctccttt

SEQ ID NO: 561008 - DNA, 295 bp, Homo sapiens
ttactagagtatgcaagcagcagcagaaggagtaataggacatacagggggacgagactcctcaagatggacaagtggtggtaatttggagtgcaggactggctaataaggcacgcgaggtgcaggcacttacatgagcagtcaccgaataagaaagagcaccacaagggcttttcactcccaagtagcaagcagcttgcaatggcgggctgagaacccagatttgacaatgcttctaagatacagagatgggaagctcttggaaaggagtgtaggcatctgttgtagtgatata

SEQ ID NO: 561009 - DNA, 847 bp, Homo sapiens
  misc_feature (254)..(254): n is a, c, g, or t
agcgatttcaagggcaccaaatggcactcaaccgtgtgaaagcccttttggcccccctagggctcccccttttgtgtggcctttgccttggaatttgcttgaaagctataaattaaaacgatgtatcgatcgtaattggacttttggccacacaaggggctttccctagaagacttcttggggctcgacaccaatgaatgggtgacggcgtaaatttaggaaacctcgcgacgggcccctttcttccaatattntcgacaaattccgttcgtggcttttcttgtcgcgcacattctcactgcgagtgagctagtggaacctagtgggcttgtctaggagtctgaaggatggtactctgctctacgcgttctctaccatgtcgaataaatgcgtcatgtgtctagtacgtgcatagtaaccaatccttgtcatcgcttcctgcaagaaaatcatagatcccatgtgcgagagtccatcagttgcagcacccaggacagggtttactagcagtggagtagcacgcagatcgccaggggactagcttgcagggcctgtatcgtagcataaggcttcctgagccgctggtctactgggatcagaatgttggctgtaccagtgaacgcatagttgtagggctgaacagactacagaccacagaaagagcaaagcttcagtaggttcactgcttgatggagaagtcacatcgggaagcaccatgggccttctatttcctcattgtcctttcagagaagagagcaggagttgggtgagaaaggagattcgcaagtactgaccatctgttatgtgctagacacgtcattttacacgcacgagatatggaagcata

SEQ ID NO: 561010 - DNA, 228 bp, Homo sapiens
gagtttctctagcaaaacatggagacgggtaactgtccaccatgtattttgctaactgggacttctggactggccatctggacttttctgttcttcttcagacatgtccttgctttctgcgtgtaaaccttgtccacattttaatctactggaactgagtttagattgtttgagctggaatccagactggggcccatctggtgcttagctctgtgacaatacttcctt

SEQ ID NO: 561011 - DNA, 462 bp, Homo sapiens
  misc_feature (54)..(54): n is a, c, g, or t
  misc_feature (307)..(307): n is a, c, g, or t
  misc_feature (344)..(344): n is a, c, g, or t
  misc_feature (408)..(408): n is a, c, g, or t
  misc_feature (421)..(421): n is a, c, g, or t
  misc_feature (441)..(441): n is a, c, g, or t
attatgaactccttaaaaacatgtgaaatgtcagccgggcacagtggctaacgnctgtaatcccagcactttgagaggctgaggctggcagaccccttgagtccaggaattcaagaccagcctgggcaacatggcaaaaccctgtctctacaaaaaaataacaaaaattagccgaccatggaggtgcatgcctgtagtcttaactgcttgggatgctgcagttggagcatagtttgagcccgggaggcagtggtgcgatctcagttcattgcagcttctgcttcccaggctcgggtgatcctcccgnctcagcctcccaagtggctgggactacaggcataggncaccatgcctggctgatttttgtgtgttttgtggagatggggtttcatcatgttgcccgggctnggtctttgaactnctgggggtcaagcgatccanatggttttggcctcccaaaag

SEQ ID NO: 561012 - DNA, 799 bp, Homo sapiens
  misc_feature (1)..(1): n is a, c, g, or t
nacataggcaatggacgaggcctagtgattcattaggaagagggctcgggctggtggtgagtaggggcaggcgccgaggggctgcctgctgcatagtaggctactgcacccgcccgagccctgccgccggggccgccaccgtagtagcctactaggcctactaggcaccgcctaggctagggtgctagccccctagcctaccactaccagcccctgctctcccatccatgccctgcttggagcccaccagccacatgaatgccaccatgtggtggtaaacggcatggtggcaggtgcagtgtcggtggtgcacagtgtgtgactgggggcaatgtttgagctgggcagcaggaggactggccacggaaggaggagaccgaagccagggaggaggaggaggcaccaggaggaggagcataggtcccctgcccctcgatgcatagtacactagagctaagcagctagtggcatagtactgccctgcttgggagtactatctagcgtaggctcatactatcatactatctatgtgtcaatggtagtaggtactatacgtacctagctgctataccagcgcacaacaacctcccgacagtgccacttgaccccacctacccacccagcccgcgaactagggtctaggctggtcactagaccatgcaggaactagagcctgccagctggaccgggccagttcccctgggcctgaccattggtgcaggggatctgccccttgttgagaggtggcgcgctgcagtgccagggccatatctctggccctggctcccctaggggggac

SEQ ID NO: 561013 - DNA, 1942 bp, Homo sapiens
  misc_feature (1)..(1): n is a, c, g, or t
  misc_feature (237)..(237): n is a, c, g, or t
ntttggttagctctcttagtatagcatcgtggttgccgcgccattatttcgtttatttgttccctcgtttgttgtatcatctacgacgtgttgtccttcgtcctggttgactctcttgttggttaacctacactactagtttagttgcgtttggttttttccatcgttgctgtggtggttcactccctctctcttctcgctttcgtcgctggtggtctcccgtccttcacttgtatngtagagtgctcacttgtgtgtagtattttggcccacacgagggagatctccctccgttcgttcctccgtctctcgcggtcacgtgtccgatatgtggctccttctacagataacgctcatgactctgttgggagtacctccttggttgcaataaataactctcgtgtgtatcaggaagggagtccacctcaccgggcccccttcctctcctcgaatagagatataatctctgtattaacgtggggacatcaagaacacgtattgttaggcgtgggtgtaaaataagttgaatttctctgcggagaatgtcccgctggtgtcgacaggggaggtccctcctccacgggagtagtagtactctttgagtggatggtctacaggttcctccgtctagtatataggtacaatagaggtcgctcccacctttggtcgaccgattccgtcgtgaagaaggccacaaaaaaatatattgggggcgcacctctcgccccctcggtggtagccctccgccctctggcctaattcttctatacgccttcggtggattttgtcaagaggtaaggagtagatccctctgggttaatcccagcggggcccccccctagaggtgagatccgccacctctcgggggctttatcccgaaagaacacctcctgtcctacataaaaagtccttgtggttaagagatagtagttcccgcctaagaaaaagaggtcgcgctcttcggtaatgtatagtataaggctccgctagtaaagataagagttatattagtgaaagaggctgttctaatatcggggtaatataatcctcgcgcgccccacttagagataaggaactcgcataggagagataaatgattttgggagatactttgtcccacgctgaagaagatatcgcccaccgccgcgttgaataatagaggaaagtggcttccatctaacacaacatcgtttcggccttcgaagagggagttggttccacgcagacccggcccacatcatattattgcgaagaaaagatagaggtggcgccccacacagcgagatgagatcgttggggtgtggatatctctcgcgtgaaagagataagatatatctgttgtgaggacagcgctttcgcggtagtagtgagatgagaggtgctcttgagagtggtggcacgcgagatgagattatcaatagattgggggtcacctctctagagagaggagagtgagactgtgtgacacacatagtggttgacacgcacacacaacaggtgtgaaaaatcctcgtggggagagacccacagagcggggcacccacaggttatgtctcgcaccccctaacgatatagagattgtaagtatattgtcaagagagagtgagatgatctcaaaacctgtttgtgcggagaggagaatagatcttgtatagagtgagatgcttgcagatacccgctagccagaagttgttcacgtagaagagtcgtgtggccacagatgtgggagaataaacacatcgtatgtacacttagaatagaagaaccattggccctagatgccacagagagagagaatacactcgtagaattctcacccagaaccttggacccagaaccctgcttggaacatccaaccaacctgttgtagggcccagccccccacccccagacccggctatgggtgcccacccccacacccaattaaactgatgttactagc

SEQ ID NO: 561014 - DNA, 116 bp, Homo sapiens
agttcgacgacatgccatagctgttctgtgttcacttgttatcctgcactcccatgcacgaccgttgtcacacggacgtgacagtcgacctcctgtaatacactggctcataagtc

SEQ ID NO: 561015 - DNA, 1307 bp, Homo sapiens
  misc_feature (44)..(44): n is a, c, g, or t
tggtgcatgtggctgctgcagcagctgctgatgtgcccctgtgnaactgtgctgtctgctgcccccagtgtcctgtctgctgtcctgcctgctgcccctgtggctgtgtggattgtgtgtgctgtgccatgagcttgatgctgcctgcatccctgctcatccatgactcctgcctgtgcccttagcctgcatgtcccgtccatgcctgtgtgcccacatgctgctgcactgtgtgctgattggctgaagtgctgactgtcctgtgttgcctgctgtgtgtgcttgctgtacttgcttgatttgcttgcttgcttgcttgcctggcttgctatggtgcaacatgttgtgcatttgtgtgcctctaccttcgtcgacgtgtgactgcttagcttggtggatgaactgcttgtattgttggaccatgtgctggctctgtgcagctgcccttttgctttgtaactgtccatttgcacctttgcttgtggactgcccccgtgcatgtggactgtgttgctccaatgcttttcctgctcctttggttgccaatggcagtcttcctagctgtggcagctgttacctgcatcactgtgcatgcattgagtgacacagacttgtgactcttgcagtccacgtgacgtgagcaccctgtgccctccatctaacctatacacctggaggccttggaaccagtatgcttccttgtgtggagaatgctccatgttgttcctggcaaacctgctgtgcttttcccactgactacacctgtactaacctcagagtgtcttcctggtcagcccacaatccctttcgtgacgggctgaagtgccaggtggacagtgctgtgcccctggcggtaataccttctcctttctttcaacaccttccttttccagggccttgcatgctccacctcaaggcccccgggatgcctccttggttcccagtagacacatggccctcctttccggattccgtggaggaactgagcaccaaatggacctttccagcagattcccgacttggtgccttgtgacagtcttgtggccccaaaataaaggtgagcaaaaaggggcctggaaaggagggggctgcgcaccagagagcccagaagcctggagtaggaccacagggctcttgctcctagcccgtaaaagcaaagtgggaccgagacaagaacaggagacaagcaagatgcgcgcccgagcgacagagacagcgccagcaggggaacaccgagggaataaagagagaagagagcagtagacagtggtgaagacaggcactgagaagggaagaaaagagcaggg

SEQ ID NO: 561016 - DNA, 368 bp, Homo sapiens
agatgccgactcttggagaatccccaagcaggctttatgatcactgcttattaagactttgagtcatggggtctgtatcctgtgtgcagggatttatgatacttgtgtctcagtggctttactagtacgtgtccatttctcttaagtgtatcttgccgaaattacttgaggtctatatagtatgttgcttccagaatgaatctgtcttcacttctggcatatagctgtggagcattaccagaaccagatctctgttgcggaacttctcagcatggggtccttcgatcaccctatgataatatgaactaagactgcgaaactgcttttaaagccagctgccgttattattctcaggacagcatttttct

SEQ ID NO: 561017 - DNA, 198 bp, Homo sapiens
cctggtttgttttattcccctaaccccccccccccgtttttggaccgggtttttccagtgttaaacggacgtgtaaatagtggtaaatagtgaaagcctgtccttccctaaatgtaaaaccctctgtccggggtaaggacgaccccgtcagctgtccgactcgcccccatttaataaactgagctcttgcattcccca

SEQ ID NO: 561018 - DNA, 235 bp, Homo sapiens
taggttggttgtgggtagtaattaaaaaaaaaaaagtgaaaaagggaaaaaaaaagaaagggcgaagaggaaaaaaaagggaaagacaggtgtctttaaaatgtaataggtctgctgggagtcactaccatttgagtggttccatttacgtgaaggaggaggagggggaggaggaggagggtatgggtagggcagtctgccccattgtacccatatcatattgggtagctcccgg

SEQ ID NO: 561019 - DNA, 244 bp, Homo sapiens
ggatccccagcacagaggaggggcaccacagctgcctcaggaggtggcagcggcggcctctttagcagcttttctctcttgcagcatcctcctcctctgtctgtccacctcctctatgctgtccacctctctgtgctgtcctcctctgtgctgtccatcctctgtgctgtccaccccctcttgctgtccacctcctctgtgctgtccacctcctctgtgctgtccacctcctctgtgctgtcca

SEQ ID NO: 561020 - DNA, 360 bp, Homo sapiens
tatcaggatgcagctgggcacggtggctcacgcctgtaatcccagcactttgggaggccaaggtgggcagatcacttgaggtcaggaatttgagaggagcctggccagcatggcaaaaccccatctgtacttaaaatacaaaagaaattagctgggcgtggtggtgcacacctgtaatcccagctacttgggaggctgaggtgggagaattgcttgaacctgggaggtggaggttgcagtgagctgagatcctgccactgcactccaggctgggcaacagagtgagaccatgtctcaaaaaataaaaataaaataaaataatatcaggatgcatacatcagaggctgttcctagtgtaaa

SEQ ID NO: 561021 - DNA, 1183 bp, Homo sapiens
  misc_feature (250)..(250): n is a, c, g, or t
taattggaagatatttcattccatgcaccgatcagatgtcatgttagcctattttgtttaatgtaacgggatatataagctctttataatggtggtcgttgcaggaacatttcagtaagagatgtaaactgaatggaattatgagctgagtcattctaacgatgatggttctaaacgtgatgtaggcttatttgagacggaagtaagctgtgagaatgtgactatatgacatatctcagtattataaggntgcgattaagtcgattgtgaaatatttgatgctagctctataatataatcaataaactagagaaaaggacgaggaataacgtggagcgcctgtgttcgaatataacgagagatgtatccttgggaacaattgggtaacgacatcctaccaaagagtgatgaaagtttactgaaatgagacaaccttcctgaaattttatatagggctcaatacgtaggtgagtaagagcttaagtgattgcatacgaagtgcggctttgtacttccatgcggggaacctgtttaatctctcgtcgtaagagggctgtgttggcaaacaataaattgttacaaacacaaagaaagaaatacatataaaaagagatactggaaaatcttcggaaggcgcgggacaaacgagggtgtcctcacagggcgtgtcctacataaaatttaggagttggggacctaagatcgaggcgcctcaaaatgtctacgtcaaaatgcgcgcggcacgtgataatatggcacctgcgcttagaaaaggccgcccctgtaaaccgacaactagaaaaggggacccgctgacacgcggaacatgcggaagttggcgggcaaccaccactaccatacgagtaggggtggagtggaaatatcttccgccggcaaacgacgcgcccgagattactttgggtctctcctcttttggacggacaaacttggactcaggcgtctcatcgggcgggagcggggacttttccaccaaacctactggttatttacaaaattgatggtttcaccatccgcaggttaaagaactatcgcgctttgtgtacattgagaaacaatttacccccgccatttggaaggcggcaatctccgtaattttgctacttcctcaacaaaacgaaacggggcaatctgggggtttgtcatttgaccacaaaatatttgg

SEQ ID NO: 561022 - DNA, 314 bp, Homo sapiens
  misc_feature (42)..(42): n is a, c, g, or t
  misc_feature (113)..(113): n is a, c, g, or t
cgcggccgcgcgacacggctgcgagagacgacagagggctanccaagtggaagtaattcccgaatggaaaaccagactcgtatgttctccacccataagtgggagctaagatnatgaggatgcagaggcataaaaatgacacaatggactttggggactcaaggggaaagggtgggaaggggctaaggcataaaagactacaaatcaggtgcagtgtatgctgcctgggtgatgggtacaccaacacctcacaaatcaccgctaaagaacttactcatgtaaccaaacaccacctgttccccaataacctatgc

SEQ ID NO: 561023 - DNA, 320 bp, Homo sapiens
  misc_feature (25)..(25): n is a, c, g, or t
  misc_feature (84)..(84): n is a, c, g, or t
gttttccccggttatttggggaaantggggccccttaaggggaccctcaaagggtttccaccgattttgggggggtgattttcnccttttcccaaaccgggcttttttttgggggggcccctttaaaaagctgtgggcaaaagtttttaactgggttaaaggccttttttgggggggggttttgtcctttgggctgtttttttccctggcccttaccccaaaaggtttttttttttgggggggggggcccaaggcctttgtttgagatttttttttttttgaccggtttttagggtttccattaaatgggccccccccca

SEQ ID NO: 561024 - DNA, 116 bp, Homo sapiens
agatctctgaatacataggattaatatatgaaaaaatatccctccactaaagatacatccacagttatgatttcagacggggatgctagcatggctaagcgcaataacaggggttg

SEQ ID NO: 561025 - DNA, 420 bp, Homo sapiens
tgcctgtttaagggtacgaagaagttcctgaacgccttcatgtatctgagcctccgaattctccgtgaggttgaaattcaggccctccagtatttcatcgtgagtgtcacccttggtccacaggaagaccattgcaaagcctgtagcaatgctcactggggagaagaagatattggtgctgttgcactggtgtcacacctggcggtatagtctaaaggcgaactcagccaggttgggggttatcttgttaaaggttgggtgatcctgatcatggtggaatgtatctgtcttctggacagcctctccctgggtctcctcacacagagacacagggcacagacagcacaggcctcacagcaggagtatgcccccagacacaaaacgcggcattgtcgattctctgtcacagctcagtggtgg

SEQ ID NO: 561026 - DNA, 887 bp, Homo sapiens
  misc_feature (501)..(501): n is a, c, g, or t
  misc_feature (668)..(668): n is a, c, g, or t
ctggacgagggaagaggcgggcatacacagcaagatgagaagacctatggagctttaatttattaatgcaaacagtacctaacaaacccacaggtcctaaactaccaaacctgcattacaaatttcggttggggcgacctcgtgagcagaaaccaaactccgtagtcagtacatggtaatgatcttcaccagtcagaaggcgaactactatactcaattgatccaagtgaactatgaccaacggaacaagttaccctagggataacaagcgcatatcctattctagagttccatatctaacaatagggttaaggacctcgatgtttggtatccaggtacattcccgatggtgcaggccgctattaaaggtctcgtggttcaacgatttaatagtctctacgtgatctgagtctcagacccggtagtagatccagggtcggttgtgctatctacttatagaattccttcacctgtacgaaataggacaagagcaaataaggngctacttcacaataaggcgcgcttcccccgtaaatgatatgcatctcaagcttagttattatacccacactcatccaagaacagggggttgttacaacatagacctaacccttccttgtaacataatccctagtggaggcataagtgtggtgggcgggctccatctngctacgaagaggcagagcgtcaaatcggtcttttgggtacctcttctttctgccacatagccctcgtagggaggagccctctaatggaaaggccctgaagctgcaacggcgcggtcattcctagggccgggggaaattccaataaaaaatttgctaagaaatccaaatagaagcttccaagcggatcataatcttctctcaaggattaaatctatccca

SEQ ID NO: 561027 - DNA, 476 bp, Homo sapiens
gataacaccgaaatgacatagcatttgtaagcaccatactctcatcgtaacccatccagttaggttattatccgtcaggtaacaatttccctctgaacatccgacaaccggctcctattcccgaagctgtttcacagattagtaaccacaaaaaacccggcgaatgccgggttgtcaccagtgatgccaacgactggaaagacccggccaatgctcgaaagtcctcctcgttccagcaacctcgcgcaatacttcaaccgaatgcacgtcagccggtgcatccagcaattgcattgattcaacgttcgatcaccgaacagatccgcagccatccattgaccaaattcaaccaaccagtacattttgactccacaaccactaagaactgtggagaagcctctatgccgcccatcgtgctggtgctcaacggccccaatctcaacctgctcggcactcgcgagcagggaccccactcg

SEQ ID NO: 561028 - DNA, 335 bp, Homo sapiens
cccaccctccccttaaaccctttgcctttgaaagtagattatgttccctgcaaaggtggacactacagggatttgtccctgggccagcagggacctttaaagccttttttggggccttttttttttcaccccgggggtttttaaagggactttcgggaattttggaatttcaaaactttccaaggtcccccccttcctaaattttaagaactttaattgccagtttcaattgaagggggggtttgtaaacttaacccccagggaaagccccgccccctttatgggtttcaagttttatttttgcaaaaaaaggggtttaagccgggttttttcca

SEQ ID NO: 561029 - DNA, 720 bp, Homo sapiens
attgcaagacagtacttgagtgggaccttccccagaatcatttgcaaaaaaaaaaccaaaacacaaacaccaaccaagtctcttttttgctgagattctgatctcttgtgttatgacacttattccccttttgggtagtacagaatgggtatgtgaaacattaaaactgttttctttcaggagagtagaaggagggtagagaaagcggcattaggaattctttttttggtttttttttttttggaaacagaggtctccactctgtggcctcaggcagggcagggggtgtgaccctcggcctcactggaaacctccgtttcccaaattccagggattctcctgcctcagcctcccgagtagctgagattacgggcaggtgccaccagacccagctaatttgggatcttaagacagcagggggggttccccccatgtgggccaggctattctcgaactcctggacctcaggtgaattggcccgccttgggcctcccaaggtgcggggatttccacggcttgacgccaccggcacccaggccaggaaattttggatatttatgtataatagaggatcgcgagctgacccattatatagcgtctcaaaaaccaggggtttagcccactcacgggcggttatttccaatgtacccaaaaccgcgcggggaattgggaaaccctttttttcggagaaatcacaatatccgcgggggggggaattgg

SEQ ID NO: 561030 - DNA, 273 bp, Homo sapiens
  misc_feature (219)..(219): n is a, c, g, or t
  misc_feature (261)..(261): n is a, c, g, or t
actggcaacttctatgtacctgcagaacccaaattgacatttgtcatcagaatcagaggtatcaatgaaatgagcccaaaggttcgaaagctcgcaacttcttcaccttcatcaaatcttcaacgaccttcgcaactcaacaagcttcttacagtgaggattgcagagcctatatagctgataccccaatctgaatcataaatgactaatctacaagcntgttatgcaaaataaataagaaacgacttgcttacagatgcnttttaattgtgg

SEQ ID NO: 561031 - DNA, 603 bp, Homo sapiens
  misc_feature (99)..(99): n is a, c, g, or t
  misc_feature (115)..(115): n is a, c, g, or t
  misc_feature (315)..(315): n is a, c, g, or t
  misc_feature (360)..(361): n is a, c, g, or t
  misc_feature (386)..(386): n is a, c, g, or t
  misc_feature (446)..(446): n is a, c, g, or t
agaactgcacctcgaagggggaggaaaagaggaagacagggcatcagcctcggacctcaggtggctgaaggagagaatgtatttggtgtctgccatatnctttgcatcccttcantgacactttttgtccatgtcactgatctttctgtcagggaaccatctgccgtgtgactggtggatgaagtaaagcagaccgagatgatcctcacatatgctgtatgttgctgccagatgtggccagagtgcaggagctggtatcaccgcctacacataaactcggccacagggaggaatggaccaagacccctgacctgnggcccagtcgccctcagagcccttgcccgctcggtatgaagatcnnggcgattgaggatgtaccccatccnctctgacagcactcgcaggaaggggggtcgcgtgttcgccgtctgtgaccagattctcanatatttctgttataaatgccttatgtaaaaaacctcagggggcccgtaccattcgctatggagcgattcatcactggcgcgttacacgcgtactggaaccttgcgtcccactatccctgcaacatcccttgcagtgcgatactccgtaatttgtctt

SEQ ID NO: 561032 - DNA, 435 bp, Homo sapiens
  misc_feature (200)..(200): n is a, c, g, or t
tgcaccctgaataatctttggctggtattttatttaaagagagctaaactgtttcaattacgccacaatatataccattctctactaaaacaattttaggaaatgaaaaatgtaggcaatggggatgatataggctgctctatatgaatgtctttcattataggaattttaatttaacttaaaatgatcaaggaaccagncatcttttctttgtatttcaaatgcatacaaaatttaagaatccgagttttttgatgcagagttcatgagacaatgacttaaattagttggtgggcaacttttactgaaccatctaaatcctgggttcagaacattacaactggaggataaatgaatatttctctggatccatggaaaaaatcttgttttgaagcgggctgcgaaaatggcttgaccctttggagtctaaataac

SEQ ID NO: 561033 - DNA, 173 bp, Homo sapiens
aaaatggtgattccggggattcactagggaagtatgggtggaagttcctcccttgatcgaggggtaacacgacaacaggacagtctttgagtaatctgtaagtagtgggctgacattatttttcgtgctacactgcaggactcaaattttgttagcccagagtgacatttgtt

SEQ ID NO: 561034 - DNA, 520 bp, Homo sapiens
tagtcttgggcctccttgtctttacctagcacatgagaagcatttattatgacttttttttccccccattgctgaacaaattactacagtattgctctacctcttgtttctgtgattaaaggctggccactgtggaaggtaggtcatatctggccactgtgagagactgtattacagttaccgagtggcttattaaggaaagtggtgcaacaatcaggtccatgtttcattcaaatgaccctccattcccccaacaacatcctcacatctgccaaagcaaattatgctgctgtgctcatttgatgatggaatcagcatcgcatgcaggctgaacccctactacggcagaaccaagaaagccactctttcccctctcctcctaagatgccaccacagagcagggtgccagtggtgggtggggagaaagacggagacacagaaacgtctccttttcactgtgattctcctaaggaatatacagtcacccccacaggaaaagcaagagttccatcaagattct

SEQ ID NO: 561035 - DNA, 1516 bp, Homo sapiens
gtgtgtcacttccggcctccctttatctgccatcttgcgtccccgcgtgtgtgcgcctaatctcaggtggtccacctcggtagacccctttgtgcaccaacctcttagttccctccggcgcaggccccctttatttcgctccgaactgacggatgaatagtaaacagatcatgagccaggaaaaactcgcctaaatggctaggcacatatgtgactgccatgtgggtgggcagaggaacggctcgcgacgaaggaagaaggtgtgttcagtagcaacaggcctactacgcgagatgacaaacatagacttcagattgctccttcacgcagttaggggtaaacgaatatctctgggtattgacagaggtgaatatgtttgacaagccaaggacacagtgatccactttaacgaccctaaagttcaggcatctctggcgagctgaaacgacttgtcaccattacgggccatgctgagacaaagcagctgagagacatgctacccagcatcttaaaccagcttggtgcggatagtctgactaggttcacggagactgtccgccgctgcccaaaaacttgcgtgactgcggagaagcaccaccttgcctactgcagagggctgcgaatggcttgaagttccccaatctgtgggacacaccttgcaagcagggggtcccacgaactatgaggcacctgtattgagcacactctggaggaataaacctggcagaagatctggggccgcgacatatattatgccgcgcgcacaacgtgtgctggactgcaacaaacctctattataccaccccggaggagcctacaggttcacacaacttggtctaccaaccgcccgcgacaatccaattcgtgaaaaacaagccctgcggtttgtttgtctcacatattccacactacttttcattatcatatcaaccagatcaacatctatacacacacgacctacccacaccagccacatcctcactcacatcacaccatcaatacacaacgaccgcaccactacacgctacgtctaacccactcacacgcctacaagcacaccagatgactatcaacacttctctacaccacactcgcgaggaggcatgacgaagacacatcgaccagacgcgagcatcccgcgcgccggcccggcagcagacctccccacagcacccggaacaaccagacacagacaaaccacaacacaagacgagagccgacacacaacagctagtaccgcatctaaactcaagatacctaatctatcctaatacaatcaaactataacaaaagataaacagtacaccagagactcgtaaatatcaaacatattacaactaaactaaagataaacgcgaatacaatacatcacaacaacacccacacagaagaactaacaactaaacagaacgcgcaaccaaacacacataatctaccaccacaatcaaccggtcgaaccaaacaccaaagaaacgaaaaaactacaacaacacgctctaccaccacaacacacaac

SEQ ID NO: 561036 - DNA, 151 bp, Homo sapiens
gatctgtacccccctgggaattgggcgacttcataggactgtctcctgagattgccttccacctatcacaaactcgggggcattttctatgctcttcttgcaattctgcttctacaagttcaagctgctccaacttctgtctgccgtttta

SEQ ID NO: 561037 - DNA, 191 bp, Homo sapiens
  misc_feature (188)..(188): n is a, c, g, or t
agaagtttgaaaaagtgaatgtcatgtagacatttggaaattccatttgttacatctttaacagaaactgctctttctctcctggaccgaatgtcacattcctctcgtccgatttcctcctgttgtatgttccgccagatcctgaatgagccattttttccgtaaacgggaagaatcacatagtttcntga

SEQ ID NO: 561038 - DNA, 1462 bp, Homo sapiens
tgtgtgaaaaaaaaaaaaaaaagagaggtggttatacatcttctaggggggggggggggaggcggagagaaaaaaaaaaaatgatatatatgaggaggggagaggagagagggtgggtggtgtgtaagaagaggggggggtgtggggggtgtgttttcttctctctctactacactacatatataataaaaacagcgagggaggaagggcgtcgtgtacaacccgcgcgtggggagagagaatatatatatatctcttctgggggagagacatatacatattatatattgtgtgaggggggtgagaacaaatataatatgagcgagcgcgcgttatgcttgcagtgtgtatgtatatcttatatatacaacacagacagagagagggtgcgtcaccaacaaaaagaagagatggcatctaaacatcacgaggcgtggcatgactccccttatatatatatatttaacaacaagagagaggtgtctcttatatatacaaaacaacagagtgtgttatttatatatataagtatgtaataaacaaacacaaatctctccctccctcctttcacaccacacgccgctcgccctctatattatctacaaaaataaatgtaagttgtccctctatatacaaaagaaataaatattttaatgtagatcaacagcaccagaatcaaaataaaggtaaatatcatttctccgaatagaggactataaatataactcaacacataatatcacatacacacactccgataatataactacacaatacataaacaaacacacaacaaagacaatcatcaccatacttacaaacaatagctctttaaacaatataaaacctcttataaattctatacgatatcaatatatacccagcttatctatatctaaataacaacatcacatacacacttctaactactacctccaccaacaccaaactcggatgtacatatagaattaatacatacccacacaaataactaatatatcaaatatatcaaaaccatatatgtaacaaaaacaaaacatatactttatattaaacacaacaacaacacatataacttttaataaactagtatatcaactatacctcaatatatacaaaacacatccgagcataccaactcacacataggtcgtcattctacttactctcttctattaacgcacagtagacaaacccaacccaaccttacttgccgaactataacaaaaaaaacacaattcgagtgacacaagaactacctgctaagtcaacaccgccctctctacatacacactacccctcacaaacacaaaacactaaaacaaaaaataacaaaaaacacaaacaaacagccaccaaaaacacctaacactacaacaaaactactcaacaaaacaatgtatcctacatcctcactcactctcgtactatacaatcacactcattcaatcatcaataaatt

SEQ ID NO: 561039 - DNA, 274 bp, Homo sapiens
tccgtactaggtcatcgcaacagaaagaagttgcaagtagcacctcctcatgccaacctcatccccaataggatcaattaggccaggctttgatgtcactgaggaggggaccagcacgcctctgaggacagtaggaaaaacctaggcaggtattagagcagggagctggggtccccaggtaactgagggccccaggatcgacatgattctgaaggttattgtcatgggtgcaggggagcaggcggcgacaccgtctaggcttcctgcgggccgt

SEQ ID NO: 561040 - DNA, 149 bp, Homo sapiens
attcgcggccgcgtcgacggattacatatgatagtaaagcccacctgtttggatgggagtagaggaagttgctgcttaccacctggggaggatacagcgcgaagatggcctgccacccctaagagaggcctttacagaaactaatcatg

SEQ ID NO: 561041 - DNA, 958 bp, Homo sapiens
  misc_feature (576)..(576): n is a, c, g, or t
ctcgggatgcagaaagtttcagataacgggcgacagatgaattactctccgcagtctcgttcgagtatatggtggtttgtcaccctcgtccagcctgttcacaggaaggatgagttctccaccggtgagattttttcccggacttttgtgggcaacttcctctgatgaggcgatttgagccctggttcttacagcgcacatctgggggaaagcccaaaggcctttttttcggaaattgggctcaccaaatgatcctctaatcgctgcggactgcttctgtacaccatacagggtgttggccctgaacgttctcaccgccaagggggtgcacccttctggatgtttaggcaacggtgagacattccctgtcgtggttatgaactttccccgcgctcccatatgcgaggccgctatcttgttggtgcccttgcagcccctcttggggaaatgctcccacgagtagtgtaatgagggggcacaaggaaagtggtttttccgtcaggaccacgatgtgcaacaaccgaatgtcccgctgcatctatggggtgtccccccgtttttgcccacaagaatggnaatttacgcacctgtatatcccataacagggggggcccccccccttagtaaaacacagggagctcttttatagcccctccccgtttataaatctccaggagtgtgggcgccccacccaacgtaagaagttgtagagccggggcaaacattcttgccattccccaacgcctctcaagttgtcacacacaaggaaaagggcgagattcttcttcaaagacaatcttgtcgtgcccacgcgctgatagtgagactctatttaagaaagccaaatgttattttcgtgattttatgtgggacacaatcgcgcaccccataagtatgtgcgcgcccgttatgtcataattaaaaaaaagagcaaaattttcccatcgacgacaaaaca

SEQ ID NO: 561042 - DNA, 221 bp, Homo sapiens
  misc_feature (213)..(213): n is a, c, g, or t
ctggtgccgtaggcggcggtggagtcgaggttgatcacggcactgttgtggcggcgcttgccgatgaccagcaccagcacgttggaaccgttcagaccgcgcaggctgtaggggcgggcgacgctgtcattggacgtaccggaagggcgttgggagaacgatggcaaggatttctgcagcgcaccgcgcaggctggattcgccagtctgttcnaactgctt

SEQ ID NO: 561043 - DNA, 270 bp, Homo sapiens
  misc_feature (86)..(86): n is a, c, g, or t
catccagaatcatctgaatcatctattttagaaaaactgaaattatcaaattaatcttcagccaacaaccttctcgagaacaacgnttaacatcctgctatattttccaggatttgacatcttcaacgatcgaaaatgtctatattttgtaaatggaaatagcactcatacaatagaatgctaaatattgaatgtgttttttctgtttccaaagttggtatgctaaatcaatgaaaaaataataataaaagctagatattttgtgacaaa

SEQ ID NO: 561044 - DNA, 139 bp, Homo sapiens
ctctataggatcccccaatctcgcctatctgtaagtgcttcctctccactaagtggctcttgcagtaacaagctattcatacattcccagtctttcagcagctcagatagcacagttcccacaatgcatcagggatacc

SEQ ID NO: 561045 - DNA, 289 bp, Homo sapiens
  misc_feature (15)..(15): n is a, c, g, or t
  misc_feature (25)..(25): n is a, c, g, or t
  misc_feature (144)..(144): n is a, c, g, or t
  misc_feature (263)..(263): n is a, c, g, or t
ggcggctcatgcctntaatcccagnactttgagaggccaacgcatgtggatcgcttgagcccaggaattcgagaacaccctgggcaacatggtgaaaccttgtctccacaaaaaatacaaaaattagctgggcatgggggcacnacactgcggttccagctactcgagaagctaaggtgggaggatggattgagcccaagaggtggaggctgcagtgagccgtgtactccagcagtgctgtactcgtgtacagtgtactccancctgggcaacagaatgagaccctgtc

SEQ ID NO: 561046 - DNA, 124 bp, Homo sapiens
cagaggtcaggctcgctccagagaaacaagtcatcaggccgctttgaatgaggaatttatcaaaatgcgcatggaggagacttcagagcctggatagaccatgaatgtgctcgcgcaatccaga

SEQ ID NO: 561047 - DNA, 223 bp, Homo sapiens
aacgggtgatgcggttggaccgaagtgggcaggtcacggtgtatggactcattgtgcggcgacgctgccagccgacggatgtgctggaggggctcaacctgctcatcaccatctcagggaaaaggaacaaactgcgggtgtattacctgtcctggctccggaacaagattctgcacagtgacccatatgttaagaaaaagcatggctctaccaccgtggtata

SEQ ID NO: 561048 - DNA, 1174 bp, Homo sapiens
  misc_feature (592)..(592): n is a, c, g, or t
tcataaacagaggctaacaaatccgtggcctcgaggtttatattgtgtggtacaaattagcacaggaggaccccagccccagtgcagatgtgttagcccaggggcgggggtgtggggggctcgcaccagtccttcgtggtcctcagtgttgggcagaaaaatattatacctctgtgaaaccctttgtgatgaggggccgtgggtatacgttgtggagcgaagccgtaacctgtggaactgtgaaaccgtggggctgtgcagcctgtgggccttggggttggactccttgggcgcttggggccttgtggcctttggggcgcgggccacagacgcctgtggagccccctgtgtgggcaaaatcacgggggcccacgagagccaccgcttttcccaagagcttgtgggggggtggcgcacatggataggcgcaaggttgagactcgagaggcttgtgcggcgctgtgacaacccttttggtggggacctctgtggggggttatagacctctcctgtgtgggggctcttttacgaaaggggcgccttgtgaaatacgcctctcggggcccctgtgttgccactttctaagtgggcnctcttgtgggaatttgtggttgggggccctgtgacgattctctctcttttaaggggcccccctttttgtgggcgggggcgcctctccgttgggcgccaaaaggcgcccaatgttgttctccctttcaaaaggggaaaccctgggggggggttcccaacactccccctttataagagaacgaatttcaggaaacatcatactagggcgagaaatcgagggggggcattcacgctgtggaatatcccaatttttttctgtgggcggccccatattttccgggagggagaaccacggggggatcaggaagaaacgaggggagagcggcgggcggacccccctagggcgggccctcttggggcggccccaggggtcgctcgtggggaaaccacaaataaaaaagccgggggggggaatccccgcgaaaagagggcgccccccctattctttgcggagaaagagcaatcctatagggggggggccctcaacccacgagagaaaactaacccacgggaagagcgaggccggggagagagacgaagcagaacaccggcagcaggaaaaataaaacacggcgcgaacaaa

SEQ ID NO: 561049 - DNA, 229 bp, Homo sapiens
gaaacggacacggaacgacgacgacgacgacgacgtcggacacggacacgtgacgacgacgacgacgacgacacacgacgacgacaacggacacggacacggacacacgacacaacgacgacgacgcggaccacgacgacactgaccacgaccacgacacacacacacacgacacacgggacacacgacacaacacacgacacacgacgtggacacacgacacacgaca

SEQ ID NO: 561050 - DNA, 1960 bp, Homo sapiens
  misc_feature (15)..(15): n is a, c, g, or t
  misc_feature (159)..(159): n is a, c, g, or t
  misc_feature (268)..(268): n is a, c, g, or t
  misc_feature (420)..(420): n is a, c, g, or t
cttgggaggtagagnagtcgtggatgagcagaagcgtgagagggtgttgtgtacgtagtgtctggttgtgatgctgtacttgtgtgtgtgcagcttggtgtggtgttggggagtgcttgtgagtgagtgtgaggctgctagtgtagtatgtgtaggggntgagagggtgaggttgaggcggatgagtgtcgtgtgagtgagtgtgtaggcagtgcggccgctgatgtgtgtttagtacttggttgttggatgttaggtgtttaggtgntgatagtgtgtggcgtgtgagttgtgttagtgttcttcttgtgtagagacgtttgagtgtgagctgagagtgaggagtgaggagtagtgggtagtagcttgggtgaggatgctgtgtgtagcagtgcagtgtggtgggtggtgtgcgggtgntgggtgtgtatgagtgaggtgagtggtgtagtagtagaggtggggtggtggggggtgtgggtgtgttgagagtgggagggtaggtggtggtgtgtagtagggttgtgtgtgtggtggaggaggagagtgtgaggtgtagtggtgtgtaggagtagtgagggaagagtagttgtggtgggtgggtgtgggtgtggaggtggagatgtagtgtggtgagggagtgtggtgggaggtgagaggggtatagtgggggtgtgtgtgtggttagtgtgttatggcagcagtagagagtgttggatagtgtgagagtggtggtgggtgaggtgaaggtggtagtggggaggatattgagagggtgtgggataggggtgtgtgtgtggggagtgagtagtcggtgggggtgggggtgttgtgatggtggaggtgtgggggatgtgagtgatggtgtgggtgggtgtgttgggtgggtgggttggtggatgatttgtgggtggttggtatggaggattggggtgttttggtgggttgtgtttgtagggaagattgagtgtgggtggtggggaggtggtggttggggggagttgagggggggggggagggagggaggtgtggtggttggggttgtggagggtgggggtggtgagagagtgtgggtggtgtttataagcgaggggggttatcaagcagatggttagatggttggatgtctctcgctgtgaggggtggtggtgcatgggtggacacagatggtacgcggggtagtgtggtgggggggggtcgcacgggtgtgtggagatatctttttgtgctgagagggatgtgtcgcacacacctagagggtgggggacacaaacgagagatgacagcgaggggtgtgtgtttatgatacagcggggcgggccctcggcgtaggttatggtgaggtgagcggggctcttagagggtggttatgtgagagactcacgcgggagggcggaggatatttgtgcacacacacagagagggagaaataatagactgctgagttctctcgcagacacactcttgtgtgtgggtattgtcactagcgctcctcgtgggggtatttgtcgactccctccgggggcgccccactctgttcttggttgtactttctctgtgcggggaatacctccgctctgtctctatagaagaggagagatatgtgtgagaggtgtgttctcagataaagagtgaggggggcacaccacgctggcgcccacgccgacctccaacgggggagcgggggggggctcccgagaggagtggggcggtgggcggaaagtgttgttgtgtgtaaagagaggtcaacttttctagcaccggataagaaacacatttgtgtggaccaccgaggaattgttgtaagagaggaccacactgctcaagagtgaaatagaggaggtgtggttcgcattaacacgtatgttctcctccccccccataagacacaaatttttttaattttctcccccaaaccttgtggccccaatgtggataaataaacattttttgagccaca

SEQ ID NO: 561051 - DNA, 540 bp, Homo sapiens
ttctgatgcctcttataatggcatgtgaagcaggatggtttcaaaaagatagggtggttctcaatattaaaaatgatcttggtttgcatgtagatctcaccgttcattgtaaatctgcagacgacgatcttggagtacatttggtcccttatctaggtaaatattcgttccgttttcgaccaaatttcgctggaagtacatcatacacatgcaggttttcgtggagaagggaatctcattcattaaatatatacgatgctgggagatcaagtgaaacagtttgtaggggtggtggtgattgtaactggagtataagagcagatgcagcatattggttggatccaagtccaaaacacaatgacaaacgctttacttgggcatgaactaatgtatgtgttttttttttttctttctatgaaaagaaaaaaaatctcacaatattgtgcgatcaataaggttttgaataaaggtcgcaattaatattatgtgtttcttttattttgtttatgaataattataaataattcgaggtttggaaaa

SEQ ID NO: 561052 - DNA, 150 bp, Homo sapiens
  misc_feature (8)..(8): n is a, c, g, or t
  misc_feature (45)..(45): n is a, c, g, or t
  misc_feature (47)..(47): n is a, c, g, or t
  misc_feature (129)..(129): n is a, c, g, or t
  misc_feature (148)..(148): n is a, c, g, or t
atagacgntgctttcaccaactttttcttctttaaacacgatgcntntatggcccattgtgaaacatatttcattttttgatttcttcaagcataagtatcattatcgatggcactgtagcagcttatngcctgccatatttgctgtngg

SEQ ID NO: 561053 - DNA, 342 bp, Homo sapiens
gtcgtatacgacctttcatgtgaaatctttagtgttgtgagcccttaaacgggacagataattgtgcatttggggaactcggattttaaggcagtagcttgctgatgctcccagctgaataaagcccttcattctacaactcggtgtctgaaaggttttgtctgcggctcgtcctgctacatttcttggttccctgactgggaagtgaggtgactgacggatagctgaggcagaccccttttgtgacttaagcctgacctgtggagcatccctgagggggactccagacaaactgagtgacgtgatccaaagagcgctcccggggggtggggataccagggg

SEQ ID NO: 561054 - DNA, 239 bp, Homo sapiens
ggtggggcccccagtagcacacaggatttcccagtaacgcggcatgggaacagttaaacagggggaggggaggggcagttacaaaggcagggcccggcaggcttgccacgttttgcaaccgtgcctttggggggcaggttttgaagcctcagcccgactcaaagggcctgaaccctgccgggccagtcccccgtttattgcatattgcccttaacgtagcatttttaataccctggtga

SEQ ID NO: 561055 - DNA, 404 bp, Homo sapiens
tggcaggaaaatcacttgaactgggaatcagaggtgcagtgagctgagatcacaccattgcactctagcctgggcaacaagtgcaaaactgtctcagaagagaagaaaaaaaaaaaccacgcaagcttaaaaaatcaaccataggcggccaggtgcggtggctcatgcctataatcccagcactttgggaggcgaggcaggcagatcacaaggtcaggagatcgagaccatcctaacacagtaaaaccccatctctactaaaaatacaaaaaatcagccgggcgtggtactgtgcacccgtagtcccagctactgggggaggctgaggcacaggagaatggcgtgaacccgggaggcagagcttgcagtgagccgagatcgcgccactgcactctaccttgggc

SEQ ID NO: 561056 - DNA, 661 bp, Homo sapiens
accccagatgcagaagaaccacagcttccagacgggactggcagggaagggcctgcagcagctaggggcctggccaatccagagcctgccccagagcccaaggttttaagctctgcagcgtcactccactggtctctgaacatccccgtcctccaggcctgagggttcccagggaggagaggctcctggcgactcccatgctgcagggggccctcccagcgggggccatgcccttctacaaacctgctcagctggcacaggcctgagccactccgggagctcaaggctagggaggatggccagaggaagcacctggtgctgaactaggcttgccctgctgtgaacttgcacttggagccctgacgctgctgtgctccccgaagaacctgacgactccggatctcagtgccgcccccaggagacaagcagtgactcagagctggtcgcacaactgtggacttccctcgtccaccgcccatcgtactcgaatcatctcgacaccacttaattccacccatcctttcagattctggatggaaagactgaatcttggactcagaattgtgtgccgaacagaatgactgtgactttcttagtcattacggatgatttaaggatatagtatacctggtccatttaaggaatgtcattcatggaagcg

SEQ ID NO: 561057 - DNA, 166 bp, Homo sapiens
cattcgagcggcgcagtttaggatgcaggaaaccatcatcaccaccatgaagtggtacatcgagtggcgtcggggtgttgtgcatcgtggatactcagaggcgctcgattattttacgtccagggtctagtagtgctaggtgaaaagaatcctgatatgtcgtccg

SEQ ID NO: 561058 - DNA, 756 bp, Homo sapiens
ttgatctatatagtccacatcttgaactatatttcacatgagtttaaatatcttttaaagaaaaaaacacctaaaaataaatcttaacagagaaaactgtgctgagaatatcaaggccatttttcctttcttgcgcatgcgttgtgtgttcacatgctaggtctagatagcgatagcttttagtagacagcggtaggtgcctgcagaacttgtgtatttctcatctttaaaatacacactacttatagctcttaaatcaaggtgtctgcttatttatactagcgtaggcaacacttggatttcccttcttagtattgcttcataactgcgtttacagagagctttgctttgtctttctcatgtatctccgtgtgttatagtagcacagtggcccaaaagaaagactgactggggtggaggctctggcctttgcctcaagaaacatacccctggagagcataccggggagggttctcgccccataggctcacggggacagtactctctggggcaggaaactgggacacccttttatttggagaacacactgggaaaacatggtccttaaatgtgaagcctttaaaccatacatttcaaatggtgccgaacacaaaaataaaatccagagtgggctgtgccgagaatatgggtgccgggttatgtgggaactcgaagcacgagaattattgtgtcctctgtgccaaacttttgttgtagtgatggatatggagtaaaaatcttgggccttttggcaac

SEQ ID NO: 561059 - DNA, 159 bp, Homo sapiens
  misc_feature (19)..(19): n is a, c, g, or t
  misc_feature (88)..(88): n is a, c, g, or t
  misc_feature (131)..(131): n is a, c, g, or t
gtgagcgcacctgggccgngaagtggagcctgtgcccggctggggcaggtgctgctgcagggccgttgcgtccacctctgcttccgtntggggcaggcgacttccaaatcccaaagggtcagaggccacanggtgcccctcgtcccatctggggctgag

SEQ ID NO: 561060 - DNA, 1808 bp, Homo sapiens
  misc_feature (666)..(666): n is a, c, g, or t
ggccgtgttcgacgacgctcatcttcttcgtgcctcgcttctctcggtcgtctgctgctgcctggcatccggctgccgcctttcttgctctgtcctccccgctctatcctgtgcttcctccgtcctctgtcggcttgcctctctccggcctggtggtcgcccgtctgtctggttctcatcggtgtttctgcttgcgggtctgtttggctccccgtgtgttctcttggatgccccctgttgctgctgtgggttctgttctctcgtgcctctgtggctggttgcctggctcgcctcgcggttctgttcttgtatgtcttttttgtgttttgtctgtggcggcctgctgctctcgctgtcgtctctctccttttgcgggtctcctcttctgctggtgtgttgttcatctcttctctgtcttattttcatgttgttgcctgctgctcagcttctcttggtcgtacgcgtcttccgccgtcgcgttggtggtgttgggtctgtgggttgggtctagctactcgtcgtgtcgtgattgttgtgtgagccccgtacaaatgttagtattcacattatacccccgcttatggggtgtgtccgagagagaccccaccatgttccccgagttttttagggggcgagccacccctctattataggggaaccctctcnctgtaaggtggagattctccacccaccagaggtgttggggtacccccacaagaataacttctccggtgccgcttttgtgtttataacccgggccccggccccccccgtgtttaacctttatatttaccccgcggttacctctcttaaaagaggttttataccggcggaggaggcccctctgtggtggtgtggccccgccaaattattccttcgcgccccaccgcgtaagaggtaattctccattagggccccccccaagaggatctcctcctataagagggtgtaaaaacaagaggaggtgccacctccccctcatagtcctcgggggggaatacattttttggctcaattcccccgcccaaaaacagttctgctgggtctgttccgaacacacaatactggtggtgtctttgtggggggaagagaaattggtgtgagacacccagagacctttgtgacacctcgggagccccacacccccctcagaggtttttgtgggagccacagaacttcctcatacaagaggccccagagacacccccctgtgtgggttgttgtcccccacaagaccttcagatatatacacacctgggtctcagagaatactccctttgggcccactcccgcgggagagaaaatgtgggaaagaaattttccctggtctcccccactgcccaccacatttctcgagaggccccccagagcccagaatagaaatatctttgggagaaaagaggttctcaaaagaggtccgcgggagtttatggagttttttagagaaaaacaccaacatttctccagagatatactgtggaaacatcttggtttttgggggatacccagggacaccaccatacgcatatctgggttatacccaataatgtgacccccgaccattggtattttccggccctggacattttatagtggtgctgggtaggccccgagtttctagccatctcgccagcaccagaagccccaggcacccggctgccattggggccccaacacaccagaaatccacgcccaagaaggaggcccatgccctggttccccccagaaatatgatgggatcatccttcctggcccaattaattccccgttctatccccaagagcccattaaaagattttccacgtgga

SEQ ID NO: 561061 - DNA, 534 bp, Homo sapiens
attgcaggatttcggcacaagttcttgtggtcccgcccaccaggttcctcaggtggatgaattgcatgggcatggcatgttaagtatcatctcacctgtaatcacccccctgctctctttatagcctgtgggacagagtgagatcctgcgcatacacaaaaagaccgtaagcaagcacctaagtcagaaaggcgtgcataggcaaagtgagtttctttttggtccatgctaattgttaaatgctgttccggacttccaagtagaagggtctaatagtcaattaaatatatggatctggatcttggtacattatgtagttaaaatgtcctaactttttagcccgcatattaatagtatatgtgcagctcgattggcatctgtgttaatttcggcaatgcctcagtttttctactaaagtaactgtttaccaagtctcgccaataagttgttccagtaggttattccatgcctacataaaagcctctctctcaaatgcaccacacctccatccatggccacccccctggaaatcat

SEQ ID NO: 561062 - DNA, 958 bp, Homo sapiens
tatccagagcacgaggctgctctctcatcttgatatctctttctctgctctgctacatctttgcattctatccaaccaattgtgttgaaggcacgacgtgggattagtgtctacactggggatcgcactgtgatgggaagaattgccatacttgcttctgggctggaatgaggccagacccccattgctgcagaaattgaacatatatccacatcatcacgggtgtggcagtgtcctgggtgtgtcttcttcatcctttctctcatccttgagtacacctgcgcttgacggctcgtcactcttcctcatctggtatcatcgtagccaatgtgccggaaggtggctggccacgtgtcacggtctgtctgacacttacgtgccaaactgcatggcaatggaaaccactgcttagtgaatgaacacttagacaagctgtggataccttggtgtccacgtccaccatctgctctgataaaactgtgaactctgactcagacaccgtgatgaccagtggcccacatgtggtttgacaatcaaatccatgaagctgataccgaccagagaatccgagtggtgtctctcctccgcaccagacttcagctacctggcttgctctgtccagcaattgccggtctcttgaaccaggcagcagttctcaggctaacgccaggaataaagtcctaacccttattgctttaacgcgggccacgtcggccagcgagatgccctcatgcagttcaagcagctccttaacaggtggcataggagctggtgccagggggctaccggcgaccgcgcgattgagaagaccacgattctagccaacatcgatgcagagtaccctaaagtccgcgccaacacaagagccggtgagcgcatccacaaaccccgaaaatacgaggccccaacccctgtggggaatcagggcgcgccacacagggtcacgaccgttccacca

SEQ ID NO: 561063 - DNA, 129 bp, Homo sapiens
agctattcatgttacttatactaacattagttcttctatagggcgatagctggttgtccaagatacgaatcttacgttcacactttaaattttgcccacaggaaccctctaacagtccccttgtaaaat

SEQ ID NO: 561064 - DNA, 390 bp, Homo sapiens
  misc_feature (22)..(22): n is a, c, g, or t
  misc_feature (49)..(49): n is a, c, g, or t
  misc_feature (209)..(211): n is a, c, g, or t
  misc_feature (215)..(215): n is a, c, g, or t
  misc_feature (278)..(278): n is a, c, g, or t
ttttctccccaaacttgatagngactcgcattgcgcccagctaaagcgnatggtgcgactcggctcatgcagctctgcctcctgggttcatgccattctcctgcctcagcctcctgatagctgggatacaggccccagagaatctttgacaacaaagttgagaatcatagccctggcgttcagaagaaggaaaggttctctggacatgnnnttgnttttgaaagggatgatccgtctcacctgaagtttcctatcgtgaggttcagtgtcatctagancaacggatgaacataagtgtcactgtggaattttacacacaaaagaagaggctggataaagaagataactgaatattgaaactgttcttttcattaaaaaatagcaaaaaag

SEQ ID NO: 561065 - DNA, 308 bp, Homo sapiens
atctgcagaggtcgcaactcctcctggatttgttcaggataccaagatactcttattatggagagaagacgatctgcacttcgacatataggcatagacatattaattattagggtccttatatatagacgggagagaaggtaaactgactttctttttttaacaggcaagggtatgacacatcttaggcaaacttggaagccaaagattgaggtgcatatcatgcctcctttggaaagtctagatcagccgcccaggctgtagtgcaatggcgcactcttggcagaggctgtgagaatcgctagagt

SEQ ID NO: 561066 - DNA, 858 bp, Homo sapiens
  misc_feature (5)..(6): n is a, c, g, or t
cgccnnataaaccactccaacatcatgacaaagagaacaacgacaaaataacaattaatcgcgtactttgtttctcacccagttctcaaaggtcgtttgaaacactggtttatcccgtgcgcactttctttaaacactctccacttggcacaaactcttccatgtcaaagtcccttttccctaatttcggtcgcacacagttttttgaaaagcgccgtccatatttcggcttagggtcctctatatgagatttatggacacacccaaacggggtcatggttcccaagcgtccccagggggtttcttgttgcccacaatggagcaaggtccttttttctagggggacagtactactagggtgggcctggctcctgactatcgtcaatgcggcccacatggtcacggattcccgtggggtccgcatagtagcccccacttgttcttgcgcgatacatattaagggccgaatagttcctccgagggatgtccttgaatcttgttggccacggtcaagaaggtggaaataaaaaacctgttcgcaaagcattctatccggcacttctcacctaccttccctagtaacaattacttcctctcccctaattatgacacaaacaactaccccgattccatttcatatcaccacaggtgactcgctcaatttctaaggtaatcactaataggttattccgcccatgatgttccccccatctctcgctattgatcaccccccccagcacttgttataatcttggctgcttttttctaaacgctaacaccacacgggttcatctttttccacaggttcctctaaaccgggacagacaccccttttttaaaaaggggcaaacaaaaaca

SEQ ID NO: 561067 - DNA, 479 bp, Homo sapiens
  misc_feature (27)..(27): n is a, c, g, or t
aaatcctttgcttttgtttgtcccagntggtacctccttttctacctggtgaagtacatctttgctgttgctcacagattgttcttcccattccccttgccgctttttgcctatcgatgggttgcaagagtctttgaaataagccctttttagcctttgataacaatggattaagtgtagcggatgcatattacagacatgaaattgcctcacctgcctggtcttagaagaccttggtattcagtcaacaccattggtactcatggccattgaggtgttgcggcgtcttcgcacttaccgctgtctgtctgttgaaattgaggatgtgaatccggccaagaccgtcaacatttagtgcctcctgtgcagctcttggttttggcgttttttgtgtctgcccatgtggtttgtagcacccagccaggctgtctcttttgaggatcctgtacacagttctcactatttaaacatttcaggtt

SEQ ID NO: 561068 - DNA, 134 bp, Homo sapiens
  misc_feature (124)..(124): n is a, c, g, or t
gtagagtagcgaatccacagtccaggtgcgttaccctgcgcgaagagtacaactctgttctgcggaaccacatgtgttgcctgtgctctctggctgcacttgtaacagccaatcctcacaaaangctgaggcct

SEQ ID NO: 561069 - DNA, 267 bp, Homo sapiens
gaaacatctggaccccgctgtgggaggagctggcagccttaatgccagaccctaggccacaatccagagggcatgctggcccaccactgggccgatgggccagcccgtgaggtggggctgcggcaggttcctggcctccgagccaacttctgccggcattgaactgctcgtgactgggggtgcacagctgggtccgttgcaagccattcagacccctcgtggcccccccgatatcccttcctgatttccttccttcacttgggcccc

SEQ ID NO: 561070 - DNA, 175 bp, Homo sapiens
caggcgcggggctttcctccagagctccagggctcctggctaagcccggggtttcgctgggagcgctggaaactcggcagccccgtcgaccctatcctggggcaaacctgccccctgcccacgtcccggggaatttgactgtgccgggaggagcttgaggtttaagacgcggact

SEQ ID NO: 561071 - DNA, 202 bp, Homo sapiens
acgaggatctgaatactctggcctgcaagtagaggctaattcgatgtgtgaaactgtagattcggcttaaggtaatagtcatttatagactattcaatagagtcagactggtcgaggctggtaagtgtagcggaacggttgctgactgatattgttagagtgaggcttgtactggtgtgtatccgtaggtggtctgcagtgt

SEQ ID NO: 561072 - DNA, 363 bp, Homo sapiens
cacgcggggcacacacatgtggcacatatctcgcggagaggggactgtgacagatttgtgagagactctctctctgtgagagcctgtgttgagagagatggaatggcctctgccgtttggtgtggggctcttgcggctggtcttggtcttgacccacacgaaccttggttaaggtaactctccgtgcacacacatttctgtgaccaaactcttgaggccaaacacacagggccggattgacggatccgtgaaaggcttaataagagaacggggctgagcttacacctgtgaaggacatcaacacattatataagggaacacaggcgcagattggccttttggcacggattggcccttcacggg

SEQ ID NO: 561073 - DNA, 237 bp, Homo sapiens
actgtccgcatgccagctcggctcaggctgttgatttactacgacttgacaggcataccccatcgcgctggctaatatttgtataatagtggaaaggggatctcgccacgttgcccacgcttgaagccggatcaagcaattgggttcttcggatttccgaaatagaccccaatattctgccgtttaccccggaggatgcagatgtaccttctctcaggccgttgagatcaggcatgt

SEQ ID NO: 561074 - DNA, 449 bp, Homo sapiens
attgtgtggacgaggaacccttggtagctgtcatgaggcgaatggtgacagcggtgcacggtagacacgggaagcgcagccaaagctatacttggcgagtgtgagggaagcaagagaagaacattctgttaggggcagagaagaatcccacactcacaagagatgaccaggagtaaacctgcctgcctgccaaaagtaggcaagatttcatgagtcaaagcacaagaccatttctgctcaaagcacagcaaacaatattagcatcagcataatagtgctggttccccagcccatgcccatgggagatgtgctgtgatgggtctagatggtgcctgtgtgcacagccttgtagccgacgatcacagtgcccagggctcagcaccctctgtagcaagcagccaaggagcaccctccctccctgaggggtgagtggcgccaagaggcatgct

SEQ ID NO: 561075 - DNA, 423 bp, Homo sapiens
  misc_feature (7)..(7): n is a, c, g, or t
aaattcnaagaaataaaatttccatttttcccccttccaagatttccatacctatccccacccgcaagccatcctgaaagtgttgcctcagtctgcagtccattacggaaacaggtacaccctatcagccccacagtcaagaagctggagaggacgggacgcttgttactcacgcctataatccccagaaatttgaaaggctgaggcaggtggatcacctgaggtcaggagttcaagaccagcctgactaacgtggtgaaaccctgtctgtactaaaaatacaaaaattagccgggcatggtagcgtgcacgtgtaatcccagctacttggaaggctgaggcaggagaatcacctgaacctgggaggcagaggttgtggtgagctgagatcgtgccattgcattccagcctgggtgacagagc

SEQ ID NO: 561076 - DNA, 859 bp, Homo sapiens
atgggacgggggtatagcccgccccacgtgggctggtaacaccgtgggccccatatgtaggagcagcgcgtttcccacaaaaatgttgccgcacagtttgggcgcacaacagaaaaccgctgcccattttggcgcccccctggagtactcgccgttatattaaaaagggagttgtaccaataccaccgtcctgggacgacaggtaatgcgcagacaccactgtttgccaccagtacacaggtacccgccgcgttcattcttgcagcgttactaataaggtgcaaaaggactccccccggtgccataaagattatcttcgtccacccctccctctgttttcccgcgaacaattttctgcccagacgcagtccctttggacacaagcgattgctgtttctcacacaagggcctatcgcatatagattcgtcaatcacggctcgcacacatctcggtagtcaatactccgtattcgtaacacacccccactcgcccgcacgttgttggggtcctgttgtatatataccacccagggtctttatgcgtgcgcagtgcagtctgcaccaccgctgcgtatgtatctttcttgccccccaatcagagagccctacaaatactgagaacccacaacagtgccgttctttcccccccgacagaggtaaagctttctcctccacagcaacgggcatgaagcacggcccccacgcttcttgataattgcgttctgtcagatgaacgtaggatcatgtttacgcccaccgatttatgccatggctgatcttgttccccgagcccatacctgactatcggtagcagtcctcgacgtcggacccccaaaaaaaaaaatacgacccacaagac

SEQ ID NO: 561077 - DNA, 926 bp, Homo sapiens
tgttgtgcgatcatacagcgggtcctgtgtggtggtttatataggccctttgttgtgatagtgcgcccagggggggcgccatgcgaaccttttgcgacccacagggtcaccccccggtcaattacaatgggtgctcacgccccgcgcggtttagtctggcccgactttctgcggactcccggccttgtacttctgttgggtcaagtcccctactgagtggtaagaggagtgtttgtccccacgccacgtgggaaacaacttggtttttacgcgccacacggcgctgtgttgccagcgacacccccatagtgggggaaaacacccctttttgacgcgaatgcccgatgccgccgtgacactaaaaaatttttgtggcgcccccctggccattcccaatttcaaactcctccggtgttcaagaacttccccccccgccccccgcttttctctgggacatctcacaaaaaccctggtttctcgtatggcctgtctcgcggtgaaataaattaacctatacgccgctgctatccaacaatagttttttgggtacacccccagataaccaccacaaaagcaagaaggtccccgacaaatttatgcgaaacaacaccagtacaacaatcgtttaaagagggaaaattctataatctatttacgctcttcaacactctcgataagtatttaatattccaaaagccccatctatttctcctcaaagatgtcctcacttaacaccagaatatacgacatattagatagaaagaccgcttgttcagatacaactcagctagatacacccccatcaataccccctcctcccctgaataatatctcacaccaccacccccggagacttgcgtttattttgtaaaaataacccaaaggccccccggtgtttaaaaaaaggaaaaacaacccacaaaaca

SEQ ID NO: 561078 - DNA, 417 bp, Homo sapiens
  misc_feature (29)..(29): n is a, c, g, or t
  misc_feature (178)..(178): n is a, c, g, or t
agaacgggaaatcccagggggtctccggnagtttgccagcccaccgctggtcctctttgcaacctcctctacctccccactcccattgtctgtgcccttagttccgaaatggatcagaaggctgtgtctcaggccagacacggtggctcacaacctgtaatcccagcacttggggagnccgaggtgggtggatcactttaggccaggagttcgagaccagcctggacaacatggcaaaactccgtctctactaaaactatagaagaaaattagccaggcatggtgggcgcgcctgcaatcccagctgctcgggagccttaggaaggagaatcgcttgaacctgggaggcggaggttgcagggagcctagatgataccattgcactccagcccgggcaacagagcaagactctgtctt

SEQ ID NO: 561079 - DNA, 311 bp, Homo sapiens
cctacgaacacgagaccatgcctctcgcaaaggatctcctccatccctcttccagaaggaggagaaggaggaaccacaaggaggaaccgcctggtgcagagccccaattcctaccttcatggatgtgaaatgccccagattgctattaaattcacacggccttttagccatccacaacggtagtttggtgtgtggctgctccactgtctctgcaacctacagaggaaagcaggctacagagatgtcctcagagaagcagcactaaagcactctagtaagatgagtggcaaccactcattaacacatttggt

SEQ ID NO: 561080 - DNA, 103 bp, Homo sapiens
atggctcctcccgcgaaatatgcttttgagaccagtgttgctccgtcacgtgctccgccttcgccaatgacgttcctatcagctatacgccagtcgtcaggcc

SEQ ID NO: 561081 - DNA, 608 bp, Homo sapiens
  misc_feature (1)..(1): n is a, c, g, or t
  misc_feature (67)..(67): n is a, c, g, or t
  misc_feature (69)..(70): n is a, c, g, or t
  misc_feature (83)..(83): n is a, c, g, or t
  misc_feature (360)..(360): n is a, c, g, or t
  misc_feature (384)..(384): n is a, c, g, or t
  misc_feature (429)..(429): n is a, c, g, or t
  misc_feature (521)..(521): n is a, c, g, or t
  misc_feature (523)..(523): n is a, c, g, or t
  misc_feature (542)..(542): n is a, c, g, or t
  misc_feature (550)..(551): n is a, c, g, or t
  misc_feature (553)..(553): n is a, c, g, or t
  misc_feature (557)..(557): n is a, c, g, or t
  misc_feature (562)..(562): n is a, c, g, or t
  misc_feature (566)..(566): n is a, c, g, or t
  misc_feature (570)..(570): n is a, c, g, or t
  misc_feature (572)..(572): n is a, c, g, or t
  misc_feature (576)..(576): n is a, c, g, or t
  misc_feature (582)..(582): n is a, c, g, or t
  misc_feature (585)..(585): n is a, c, g, or t
  misc_feature (587)..(587): n is a, c, g, or t
  misc_feature (592)..(592): n is a, c, g, or t
  misc_feature (598)..(598): n is a, c, g, or t
  misc_feature (605)..(606): n is a, c, g, or t
ngtaaagaattatctcagtcatttctctctcccagcttgaccttaggttaatatttcattctcgcgncnnggaaataatacgnggggggggtatgttattttaacaaacaggaaaatggacaaaaaattgatagtttgcctacattaaagtaagttaaattcatgtttcgatataattaaatcatgttagaactaagggttctatatacatttccattgtcttacttgggcttattctaaacttaaatgctagtgaacaaagtgttagggatatacacaggctgcttctctggggttattaccaactaaaaggcctcagccagccgctaccaccaataaaacagtctggggctgcctccnaatataatattgtgggggttttcnggggaatttttatactgtgtgcttttgtctgtgactttgcttttnaagatgtgttttactgtcacatttaaaaaaggttcatatacaatacaaaaatacaaaacaaacaccctaccatacaccaatctgacacagtntntgtggtggggttccaaaanatgtttgnngntgcnttttntttnattntntttnagtgtntgngntgtgntttttngggggcnntt

SEQ ID NO: 561082 - DNA, 228 bp, Homo sapiens
aggagaggatgagcatctccattagagagaagtgggtggctaaagagatggcacgggcattcctgtaacaacgcatctcatataattgaatgactattaaacaaacaacaatgtgcaatcaaagtcctcggccacattgtgaactttgggggatgctcgctccaacctgactgctgtcaacttcaccgttccagtttttaaatcctgagtcatgccacacaaaacaac

SEQ ID NO: 561083 - DNA, 790 bp, Homo sapiens
gcaggttcacgtgtgctcctgtcgtcagcctcctgtgttggctgtggattacaggggcatgacaggagtgccgtgcgctgcttgtgtatgctgatttcctagatggcaggggatacaccggcgttggtcctgctggtctcgaactcactggatctctggtgatctggcccgccatggaagcgtcgccgagagtgctgggattggcgggggatgcaggtcccctgaggcatctcagggcattgatgtgcattctgactctcacgtgcttcgtcgacagttttcagaggtcatgcacactacccctgaggtttcgtcctgaccgtaaagctctctatccttactttccgagctgcgcgtgtctggaatcgttgtgtgagtttctaaatggtgacctggctttctcgtgcatgtccatatctggagaaactaggtgaaccattcgatgctggatctggtgctgagcgacatcactgggacgctggaaggagatcaaggctccctcttctgcatctcattgggcaaagagtgtggcctaataagcgcctgtgagtcgctagcggttccgtatcgtaaggactgataagccctcgtgatgaaggctagctcgatgccagcggagcgaaacctaggaagcggtcgtgttactcacatgatgaggactagcaggattttctagggccaccaagggttcctggaaggttcgatttggaggggttagaatggtccataggaaccctcttgaggtagggctcaacagggcataccatagtaatcactgaaaccgtagatg

SEQ ID NO: 561084 - DNA, 337 bp, Homo sapiens
  misc_feature (99)..(99): n is a, c, g, or t
  misc_feature (317)..(317): n is a, c, g, or t
tttttttgagatggagtctcactctgtcactcaggctggagtgcaatggtgtgatattggctcacagcagcctccaccccccagattcaagtgattctnttgtttcagcctcccaagtagctgggattacaggcttgcatcaccacacctggctaatttttgtatttttagtagagatggggtttcaccatgttggccaggctggtcttgaactctattaaggtgatccacctgcctcagcctcccaaagtgttgggattacaagagcgagccacagcgcctggcctaaaaataattttctttatattaactttttnctattagtttcttaattgtg

SEQ ID NO: 561085 - DNA, 1013 bp, Homo sapiens
  misc_feature (736)..(736): n is a, c, g, or t
  misc_feature (739)..(739): n is a, c, g, or t
  misc_feature (742)..(742): n is a, c, g, or t
  misc_feature (746)..(746): n is a, c, g, or t
  misc_feature (748)..(748): n is a, c, g, or t
ggatcagcaaggaccgaattccttataaagctgtcatcaaacttgggaaggaattcaggctggaaaggagctcgaggagcagcacggcatccactgcaacatgacgttactcttctccttcgcccaggctgtggcctgtgccgagacgggtgtgaccctcatcttccccatttgttgggcgcatccattgattggcatgtggcaaacaccgacaaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatcctgaggtggactccagatctgcaccgccgaccagatgggatctgactgcacgtgactttgatgaatctgcgtttttacaaattgagcagacagatataatttttttcnttnaantttntntgacaatcactcaaaaaggtggggttgtctctgttaggatccaaggattaaagacaagatcattgtgaagagatgagagagataggatactgtggaagtagagaggagaagagagagaggagagaagcgaaagcagagaaggagaagaggagagtagacgaggagaggaggagagaggcgagaaggggtgaggaggagaggatggagtagaggatgatgctggttggtgagtggtagtgttggttgtgagggatgaagatgggat

SEQ ID NO: 561086 - DNA, 255 bp, Homo sapiens
  misc_feature (172)..(172): n is a, c, g, or t
tgtatatcgatgccacaaggagcacctccaaatgcagacggtaagacatttgggaggacatggtttcagccacaaataaatagcatgaaaggagaggaagggagaaggagggttactaatgaaatggaatgtttggtatccgccccgcgcaaaattcatggaagtcccaacntcctaatggtgggcagtataacggagatgggggcctctaagggaagtcattaagggtaaacatcatggtcataaggagtgggg

SEQ ID NO: 561087 - DNA, 238 bp, Homo sapiens
  misc_feature (70)..(70): n is a, c, g, or t
  misc_feature (93)..(93): n is a, c, g, or t
  misc_feature (98)..(98): n is a, c, g, or t
  misc_feature (100)..(100): n is a, c, g, or t
  misc_feature (115)..(115): n is a, c, g, or t
  misc_feature (122)..(122): n is a, c, g, or t
  misc_feature (134)..(134): n is a, c, g, or t
  misc_feature (152)..(152): n is a, c, g, or t
  misc_feature (159)..(159): n is a, c, g, or t
  misc_feature (162)..(162): n is a, c, g, or t
cctttttaacgatttaggcctggcaaaaactttggccccaaagcctcctctttccagggggtgccaaatnctggccctggccctggcatatcnccccncnctgtggggccaggcncccctancctggctcaaanattccccagggaaaatgntgtgtgntgnccgcctgcctggtggctttcccccagccccccatcccctttggaaaaaaatgtaaaataaacctgggcccaaggga

SEQ ID NO: 561088 - DNA, 463 bp, Homo sapiens
ctgacaggtttctccatgttagattaggctaggtctcgaactctcaacctcaggtgatccacccatatatggctcccaaagtgctgggattgcaggcgtgagcaccggcctgggccaatagtaacttcttttaagacttactcatatatagtggtgtctctaccaggataagaaaatttctttatgtatttattaaggtattgataatggcccacggttaacagaatagggacaataaactctggttggggtggattggaatttttaaatatcctaaacagaaagccagatttaccagtatcttggtagcgttgggacaacttaatttagttaattacaatttgagtgttacaatttcgactgatcttttctgtcagataattttaaatggtaacagatttaaggaactgagagtttttattgaaaagtcctttaaagaagaaatttattaggtaagtgtatg

SEQ ID NO: 561089 - DNA, 820 bp, Homo sapiens
  misc_feature (273)..(273): n is a, c, g, or t
  misc_feature (546)..(546): n is a, c, g, or t
  misc_feature (551)..(551): n is a, c, g, or t
  misc_feature (586)..(586): n is a, c, g, or t
  misc_feature (620)..(620): n is a, c, g, or t
  misc_feature (641)..(642): n is a, c, g, or t
  misc_feature (691)..(691): n is a, c, g, or t
  misc_feature (698)..(698): n is a, c, g, or t
cgccgggacagtcgggtgtcgccctcagcctcctggggactcgagccggggatccctgacggtttttcttgcctaagttatttgagtcacaaaggcctccttccctgccgcctgcttcagctgggttgctggggggtgggcgtggatttagggagggggctgtgatgtacaacgtctcccctgccaaaggaggggcaaagtgctgtgtcagttcctgtttcttcccatttcctggcacactctgcccctctgtccgggggacacgcgcatgtnttgccaggatggggccaccgggttgatgccaacgctccgggtgcctgtcttgtctgtgtggcttctcagatggtggagggtgctgggagctggcagggtccttccagacagtctcagcctctccccgccgccccaacaggctgtcaaacaaaaccggagagggggtgggggagccagcctcccagcgtgctgtgcccgcaggcacccgtgtgacatccgcacgtcagctccgtgacctgtgtgtgtgtgtgtgcacaagtgagtgagagattncgaangccaccctcgatttgaaatctgagcaaaacaaganactggggtcttcctctcccccgaactctcccagntagtcttccctctgttcttcnntgctccagcgccgcgcagattttgaatctcggagacaaactagtacgtnagataantttggaggtactgtatgtattgtgtatagcgattttttaaacggagaattctgtacatttagaactcttgtaaattaacaaaaccgatccttttttacaaactgtaaacacacaaacacaac

SEQ ID NO: 561090 - DNA, 140 bp, Homo sapiens
  misc_feature (1)..(1): n is a, c, g, or t
  misc_feature (8)..(9): n is a, c, g, or t
  misc_feature (63)..(63): n is a, c, g, or t
  misc_feature (80)..(80): n is a, c, g, or t
  misc_feature (88)..(89): n is a, c, g, or t
  misc_feature (91)..(91): n is a, c, g, or t
  misc_feature (99)..(99): n is a, c, g, or t
  misc_feature (128)..(128): n is a, c, g, or t
  misc_feature (130)..(133): n is a, c, g, or t
nccccggnncactgtcggcatcatgattgggggccactgtcggcccagtggcccggccctaanaagtggtgacattgggntgacatcnncntagcaagncaaggccaatgtgcatcaaccagtgagcncnnnnggggttt

SEQ ID NO: 561091 - DNA, 155 bp, Homo sapiens
agaagaaggaggagctgctgaaacagctggacgacctaaaggtggagctgtccagctgcgcgtcgccaaagtgaacaggcggtgcggcttccaagctctctaagatccgagtcgtccgaaatccattgcccgtgttttcacagtttttacccaga

SEQ ID NO: 561092 - DNA, 589 bp, Homo sapiens
  misc_feature (382)..(382): n is a, c, g, or t
gcacgcctgtaatcccagctactcgggaggctgagtcaggagaatcacttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagatngtaccactgcactccagcctgggtgacagagcaaaaccctatctcaaaaaaaaaaagaagaaaaaacatagaaaatccaaaaagaaaaaccagaaggcctggtgggcgtataaatcccggggcgggtttctcgataaatggccctgtgctgtcagcccctgcactggactgttgccttccatggtgggtgggagaccccagagcggg

SEQ ID NO: 561093 - DNA, 230 bp, Homo sapiens
tccccgggtggggagtacggaagtaaaccagttgaatagaagaaaacacgtgattgtatcaatagtgcattattagccggtcttaccttaaatgtttttctgctgtgaaacatttcaagtatttattgatttactattttctctcactatttcgcccaatcacaactcgaccaccagtcaggcttcatctcttatgtcgattttgcccatcttgaactcgtccattcccc

SEQ ID NO: 561094 - DNA, 135 bp, Homo sapiens
gcaccttactaccagacaaccttagccaaaccatttacccccattgagtataggcgatagacattgaacacctggcgcaatagatatagtaccgcaaggcacaagatgaataattataacccaggcataatatag

SEQ ID NO: 561095 - DNA, 693 bp, Homo sapiens
gacctgacacccacatcgggtacctctgtggccagggtgacagctccatccggtactttgagatcacttccgaggcccctgtccggcactatgctctcccaggtccgttcccaaggagtccccagcggggcctgggctacaagccccaacgtggcccggaggtgaacacagtgtgagatctcccaggttctaccaactgcacgagcggaggtgtgagccccattgcccaagaccagtgcctcgaaagtcggaccctgttcccggaggaccctgtgaccccaccccaccgcagggcccgaccctgccctcacggctgaggaatgctgggggtccggatctgggcccctcctctatctccctcaaggatggctacgtacccccctaagagccccggagctgagggtccaaccggggccatggaccaccgggcgccagagggccagcacccgaggcccaatggcacatccccagctcggatgcccgtgtctcggctggaggaggagatgccggaagctcccggccccggtgccggagctcccgaagcgcttggaccggctggaggagaccatcccggcccagtagagcccccccgggcctcccaccgggtcagcccttcacacccctcccctcacctccccttccccgccccctggccgagaaaaaaatcataataaaatggctttattttctggt

SEQ ID NO: 561096 - DNA, 266 bp, Homo sapiens
ttattcagtattcagagcatgaagtgaaacaccaaagtataaaaaattaaaaaaaaaaaaaaggaatccgaaatactggcgttggttgccggcctcggcgtggacgccccaaccatggtccacgcagggggtttgcctcttaccactttccgaaaacataaggccttcaaagctcttccttgggcctgctaagattaggggcatgtgctcttataaactggctaaaatgctcaagatctttgtcaccaccctaaaattaaactggg

SEQ ID NO: 561097 - DNA, 635 bp, Homo sapiens
ctagtgttgcggcgtccgttgcttttgtgtgtcacgggtttgtgtggtgtgtgtctgtgcgtgctgtctgctgattattgtgcgggggtgtgtttccgcctatcgcgcgcgcgggtagttgtgtggtcggctttgtttgtaagtgtcgcctgtctctgcccgttcgttgttatgctacgcggggtgctggctacgtacacgtcgtgcgtttttccgcccgccttttgtttttgtgttgtgtctacctcccggccggtcgcctgggttgttgttccgccgcccggttggagcgccggtccggtgtaggcgctgattccgggcgcgccgccgtgtgttgtggtttgcgcgcgccccgactgctgtgtcttacgcgctttggttgggtcgcgcgccccccctgccacgcgagtttactcgcccctctgccgctctctctctcttcctcccgggtggtgctttctctcgcccatttgttttcttttttgattcttatgatgttttcgccgcctctcctccccgtgctggttttgctcctctcctttttgtgccctcgctccctctctgcccgtcgcccccccaccactaataaaataaataaaaacaaaaaaaataataaaaaacaaacaaatagacaa

SEQ ID NO: 561098 - DNA, 178 bp, Homo sapiens
  misc_feature (63)..(63): n is a, c, g, or t
  misc_feature (96)..(96): n is a, c, g, or t
tatgcttcagaggctttggggtcatggccaaagctgctgtaaacatttgggtgaggctttcgngtagacatgacttctcagctcctggggtggaancagccaggagcgtaactgctaccttgtgcttttacgtgtggaaggacctgtcttggaaagtgcgtcgcgtaattttcctggg

SEQ ID NO: 561099 - DNA, 220 bp, Homo sapiens
atgtggtcactgcaaattggacaggaatcagcaaagagactcactgctgtcaggttgcagcggcagagagccatcctctataagcggctgaacgtgcctcctgcgattaagcagtacacccagtgcctggaccgacaaacagctactcagctgcctaagctggaccacaagtacagaccagaagaaaagcaagagaagaagcagagacttgttggccctg

SEQ ID NO: 561100 - DNA, 807 bp, Homo sapiens
ctgtgcacgtgcctggggctggcgaacccggaaacgacgccgagtcccgcgtgcgtatccatggagtgagccaactgcgccggaggaggggtttctggccgacacgtcgggattggcgtgctgcagccagagtgtcttccgacggctgcgcttcctgtgagcggtgctctgccagatctctcggacccgtgagttctgtcccattctccgctcctcatggttgtactaggaaaactgtgctggctggtggttttcgggatggctacacggttcccagcggtgggctccgtgggcccggacactcctggaatattggcgactttccccggttcgcgtggtgacccggaaaccctaggaacgcaaggcagccaaggagctgaggctgcatagtctgctcgaagctatgtgcggagggaagacccacacgatgcaccaggtcatcatggatctggccctggatggggcttacgccaccttcatcgtgacccattactggtgatgagctgctagtcctgcgacccggattgtccggtggtggcagctgcgtcgctgatctgtgtcttgcgccttggcctccagtatgttggtctcacagcgcggctgcgtgaacccctccctcacagcgtgaccgccgcggggcgattggtccgcgccgcactattgacgcggcgccgggggggctgcggcctccttcccgggcccttgcgttcccctacccggtcgggtgccccgccttttgaaccctcttcccttttttcccgagccgcccggaggacctttgtttccccgggtcccccgtgtaagtcc

SEQ ID NO: 561101 - DNA, 292 bp, Homo sapiens
gtcaccttcaaggttgggatggggtggagagaggacacacacacacacacacacacacacacacacacacagagacggacaggtgagagtgagtgagaggatgagagagtggtagcagcaggaataggtgactgaggaatcgcacagtgacactgagagagaaatggatagagaacagtggagagatgtcagagagcgaaatcagacatacacacagagagactctgccgaagagctgcacacagatctagagactagggcagacacaccgagaggggattctatagagtcg

SEQ ID NO: 561102 - DNA, 475 bp, Homo sapiens
acccccctgtggatggtatactttttctgatttctttagaaagttcttagagccaggtccatgagtaattctgagactgtcccgtgctcacttccctgttggtgacacacacacagaggggccgggagggtggcaccagagaggccctggcagctccacgctcgcccatagctcaccctgtgcacccctcccctctggctgttcctgaagtgtatcctttataataagctggtaaatggtcaagtgtaaacgatggctttaaccgtggagactactggccaatgtggggctccggatgacctcatttttgccacagcacatcccagtgacctcagccccaaacgccatcacagtgctgcaaccgcagcttgaaccttgcgaggcgatggcccggaagtgtgtgctgtgaagcccatgggaggccggtggttgggtgcaactcgactacgaccctctcccaccagacccgtcttca

SEQ ID NO: 561103 - DNA, 144 bp, Homo sapiens
cccaagagagtatcctcttttaattttacttcccatagcgtacatgcctggacatagctcttgtgcaccgttgagaataaattgttgcgagtgtttgtttgagccccagacgaaataatgttttaagtgttatcccacttacga

SEQ ID NO: 561104 - DNA, 127 bp, Homo sapiens
gtgcgggacctcgcagtattgatggagaatgtgctggggtggtgggcacagtggctgatcgcctctgccagggggtcgacgcggtgaggtgtggtgatgaggactccgcccacgcctgcagaccctc

SEQ ID NO: 561105 - DNA, 368 bp, Homo sapiens
tcctactagacaaacacaacagattagccaggcatggtggtgtgcacccgcaagtcccagctacttggcgagactgacacacgagcatagtcacttgagcccacgtaggcagagggtgcagtgagccaagactgcgccactgaactccagcctgggtgacagagagggactctgtctcacaaaaaatgaaagaaaacaagcctgaggcacgaggatcactggagcccaggagttccaggctgcagtgaaccatgattaccactgcactccagcctgagcaacagagtgaaaccctacatctttaaaaaacaaagaaaaagccaggcgcggtggttcgcacctgtaatcccagcactttgggaggccga

SEQ ID NO: 561106 - DNA, 1077 bp, Homo sapiens
ttaaatgaattgaaagggaaacgtcctagtactctgagtttccctttcaagttcatgtaatttcgaacaagtgtgtgaaagaaagaggcgagtgaaacaaatactggaattacagtgaatggaaaagggaaacatcaagagtaggtagggacgttgataaaacaggaaaccaaatgtattgaaaatgtgcgcgtaatcaaagaggaggacgaaagataactatggtaataactatggatctagtagaaggtcaacaggaaacactgtggacagatggcatagtacattatactattactataatgagtagaaaggaacgtaaataacctggacacacagacgtaaccaagacaccaaaatacacaacaacacagcagaaacacgacaaatatcaacaatgaagtcctctaaccacaggggcatagaacagaaccacacaaaaaaaaaagaacaaaaaaagagacacgacacacccaacaccaaccacaaagaaaaagggagagacaaacaaaaagagctacacaagagaggcgaaaacagggaaacggagaaacacagaaacaaggcgacaacaggggaaacaaaaataacaacaacaaaaacaaaaaaaacaaaaaaaaaaaaaaaaaaaaaaaaagagaaaaaaaaaaaaaagcaaaaaaaaaaaaaaaaaaaaaaacgaaagaaaaaaagaaaaaaaaacaaaaaaaagaaacaaatttagaacaaaaaaaaaaataaaacgtaaacaggaaaagaaagagaaagaaaacaaaaacaaaaaataagaacagagaatagaatgaaaaaattaaacaaagaattaaggaaaaaaagaaaaaaaagaaagaaagaaagaggaggaaagaaagaagaggaaaagaaggagagagacgaaaagaagaaaaaagaaagaggtgagaagggcgagaaaagaggaaacagaaagaggaggaaaggacgacgagagaaggagaggagagcaggcagagagagagaggggggagcggaacggcgggggcgaaggggaaaagagaaagaggggagaggaggagaggaggacgggagaaagaaaag

SEQ ID NO: 561107 - DNA, 688 bp, Homo sapiens
atgactcgtggacccacgtttgtggtggcaaatcaagtcaagtacagtaacaacagacactcacgctttggctctgacacttagcgcatcgattcacaacagaagatgctgaacagtggaagttcagtgcacaagactaaaacctagcacacaggcactaagagactacacttttagataagtatacatattggttatgaccacttagaagggttttctgtagtgcttccctcatcccagttgactacctccgagatgaggggttgtcggtgtactctgattggagtgaattgatagagcccactggagagttggtgctctggagtgggggagccagcagaggctctgtgcagggttggccaatctgttgtggagtctaaactgcagggcctgtgtactgatgtgtgctgcagttgttgttttatgggacctggtgtggttacagctgtttctaggtgcctagtctgtaggcaaaaaggcatggtcagaacgtttgctggcgtggatttaggtctgaggtctgccgccacgcctttcagaatgacaaatccacagttaaactacaggtctagttcccctttgacctgaaaagattcgtatattaaaaaaacactagtggcctataaaagtgaacaatttatcatgcttcccagttcgacactggtccttaataacttcttttgtgtac

SEQ ID NO: 561108 - DNA, 392 bp, Homo sapiens
acgcatcacacgtcacaggggaatccccaggctaaacgggccactccgaaccgtagcaccaacccagcacgggaggtcactcccttgaccatcagtaaaaatcacagagcagtcagcgggcaccagtaagaacaaaggaggggaggacagagcatgaaaaccaacatccatgccaatgaaatgtaattggcacgctcctcacccccaaatcttacatctcaagtgccatcctaaaacgcactcatactttatgcatccccgcagctacacacacacaacacacagcacacgcatgaacacagtacacacacgagcacagcacacacactagcataccgcacacacacaaccgcacagcacacacagaacacagatcggcacacattatggag

SEQ ID NO: 561109 - DNA, 425 bp, Homo sapiens
  misc_feature (32)..(32): n is a, c, g, or t
  misc_feature (85)..(85): n is a, c, g, or t
  misc_feature (121)..(121): n is a, c, g, or t
  misc_feature (135)..(135): n is a, c, g, or t
  misc_feature (265)..(265): n is a, c, g, or t
aaatcttttaaatctttgttacccgactttantgcgcgaagtggtcagtgtttctggctttcaaactttactaaaggctcagagnaaggaaaacccaaggcagttggtggggaggaagagnataaacaaatagcnaaagtcacatagatatcaaaccagaaaggactctgcctgagctaggattgagcctgggccaccattgtaaaatggcggaggctaaacaaagcattgccacatggttacaggtcacacttccaaggacgtnaaacaagatggaggcctgcagcaaagtttgctactgaccatacagaaagacatgcaaagcacaccagattggctaaagcttaagcccaacctcacaaatcctttttcataactaaaactttacatagaaagaagaagcagttttccttatcattcttgaa

SEQ ID NO: 561110 - DNA, 352 bp, Homo sapiens
  misc_feature (174)..(174): n is a, c, g, or t
  misc_feature (303)..(303): n is a, c, g, or t
  misc_feature (336)..(336): n is a, c, g, or t
ggcatctgtttttttgtttgttttgagatagagtctcactctgtcgccaggctggagtgcagtggcgtgatctcggctcactgcaatctttgcctcccgggttcaagcgattctcctgcctcagcctcccaagtagctgggaggtgtgcacgccaccacaccccggtaattttngtattttttgtagagatggggtttcaccatattggcaaggatggtctcaatttcctgcgcttgtgaatccgcccgcctcagcctccccaagtgctgggattccaggcgtgaccacggcgcccggccggnatctgtagattttaaaaggccccagtggttctnatgcacacccccagag

SEQ ID NO: 561111 - DNA, 369 bp, Homo sapiens
cgcgaactagtatttattccacaacagctcaagctatttgctgattcaaagaggtatttgaaatatgagacttctaatggcataatattgtttgtcagtgtacactcaatattcttctacttttattaagatggaattagtctggttactcagataggtcctttcatcacgaggttttgtagcccgttgtggtatgtcctataggcgccaagattcacttttccctgcggatattgttcttgttggatcaatcaccattgctacaaatggttcctggcaactgctgattgagcatctgagtactaacatcaatcccataaagccagtagccatagcctaggatggatattatagcacccgattgcattt

SEQ ID NO: 561112 - DNA, 538 bp, Homo sapiens
  misc_feature (528)..(528): n is a, c, g, or t
cagataagtctttaggtatattgtgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagccatgtgaaggaacacatggcgagtatcagtatctagatctcataagacacgtccttggaatatagctgcgtttacctgcacatcaatcagtaatattagcaaatctccaaatgttagtcacaatgggttgtctcccttggacattctttaatcatgatattacagttccggaactgggtggtcctttttaaacaaaaccgtgtttgcaaaaccgagggtaatactccctcctaaagcttttggtaataaagggttacnaatggttttt

SEQ ID NO: 561113 - DNA, 1217 bp, Homo sapiens
  misc_feature (297)..(297): n is a, c, g, or t
  misc_feature (405)..(405): n is a, c, g, or t
gtggcggcctgggaccctgtacacgtatcctgaataactggtagggccttctaaaggctcatcatcgtctgctcagtacagcgggagctcaggtccgcgtgctcatccggcaccgagcccagcttgccagttatgggccaagaagcgagaacgcaaccgccgtggacatttctcgcgctaatagtttcactgccggtgacagggtcccagtccatttgcagggtgagtgatggattctgtgtgtattgagagcgacgtccatttgcactgctactgtgagcaacttgatggatgctngcgagtgcaagtactccagaagagcaagcaagccccagtgttagttgcacgtggagtgatcgctttgcttgatatcctgatactagtgcccccattccatgtaacctnggtgtagttcccacagacttggggcgatcatggtcacccagaaaacgaggacgaggccacttggagtagagtgccacacatggcagtgaaagtgaggggccgacaattctgtgggctgtcctggcatcgcttaacttgaagtaccgaggaccttccatcgggctgcggcggaaacgaagtgaccaagttttggcgttggagcagtcacaacgtaatgtacttggcaatcgacgtagtcaggtaggctcgtattacagcaggggtttctatcgaagcctttcgtttttcccaggcccaagggaacttttgccccaagtagcgcaaaacggctaggttattcatccaaccgtggacgatataagcccagccccacaatggtttcgctgtgggctgggttcttcttgggcgcgacagatgagaaagcctggtggcttgagagaaaccgaatggggcgcccacgtttgtggagttgccgtagccctacgtttgtggcagggaggacccccaaagtcttaaagcaaaagctgcacgcatgaacccacacggcgcatagagggaacggaaaagggtgctttccaatacgggggacactgaacggacatggcgcagaaagggccccctcacgcgggttggactgccgggaaacagagaagggaagcaacacaaacaacagggccaggcgttggcccccgtgggcttccccttgaagggacgcgaacagatttggggaattgacaagttcgttggacagcaaaggctcgctgcgagcattgggctgacggacaccagaatgtgtgccattgggacagcgc

SEQ ID NO: 561114 - DNA, 440 bp, Homo sapiens
acgatggaatatgtgtccatgaaaacagtaaacaaaagagctggagtggttgcagtatagactaaagagactttaagttaaaaattgttactggagaagaaaaggacattttataatgactaaagggtcactccatcaaacaattataagcatatatgtacttaacaacagagcccagaaatgcatgcagcagaacttgacacatttgaaggtattcataggcgattcatcagtaacagaaggaaacacttcctaactcattatttggagccagaattaccctgataccaaagccagacaactcacaagaaaactacagaaagctatatcccttatgaatatatatacaaatatcttcaacaagatactagcaaaccaaatccagcagcatataaaaaggatcatacaccatgacaaagtgtgattaatcccaggaatgc

SEQ ID NO: 561115 - DNA, 265 bp, Homo sapiens
accagttgtccgagttattagaaaactatatatagaactaccatatgacccaacaattgcactcttgggcatatatgcgaacaaaactttccttgaaaaagacatatgcacccgcttgttcactgcagctctattcaccatagccaagacatggaaacaacccaaatgtccatcgtcagatggttgaattagtaagatgtggtatataaacacaatgaaatactactcagccatccaaaagaatgacataactcggacaactcgt

SEQ ID NO: 561116 - DNA, 116 bp, Homo sapiens
aggagtttatacggagctgttcatgacacttaagtgagacatgagtgcaatgtaaaaggcccagtacctagccgtgcatggattgcttcattaccttttccatacgagaaaccaca

SEQ ID NO: 561117 - DNA, 428 bp, Homo sapiens
tactgttagttttattattttgttaaaaagatttttataatggctaatatctgaaagctatatttgatatttttgctatagttttcaaataaatgtttatggaatacctataagtgaggtactttaggtgattttttttggcatttatagatatagattccttcattattttaaagctcaccaaggttattctatatttgtaattattaatgctttatctgataatatcatcagggcatgtataccttatatttaatgtgatttttttaagcattgatgtttgattattaaaacttccataaatattaactttattctaagacctccgttaaatataatccttaattcccatgagccatggttttggtaattgattgaactgacactgctgcttcattaccaaagagcctaggtcatttgtaataggg

SEQ ID NO: 561118 - DNA, 399 bp, Homo sapiens
  misc_feature (14)..(14): n is a, c, g, or t
  misc_feature (169)..(169): n is a, c, g, or t
ttctcagagggggnagtcaatggggccagaagactgccccagagtgatggcaagtctaacaactccttccaggcagctggagacattagtcaggcactgtgacacaggggcaggtacgcagggcttgcacggaggcttcttggagaccagtgtgagttcaggaggaccntggtgaggggctggaggacagccccaaagactggtgtattacagccactgatgctgcaggtaggtaaacaaagtgagcttcactctccgaactgcccagagatgggcccaatggctaatgttatagtgaaccaagaatggccagggggcaggagcctcagctctgccctctcccacagcagattctagtagccgatttgccaggtcctcggagccttctggaccccaaac

SEQ ID NO: 561119 - DNA, 1222 bp, Homo sapiens
gtctttgcttggccgaatggcgttccgtctccagggctgtaccggctgctacgtgcctagctctgtcgcagcttccaccgacaacttcgacccggcaaaggcacatgcaaaggcggctcgagatattcagggcgtgagacgagtcaggattaggacttgtgccttgtcggtctactatgaagaagatgactcagggcactttcatcagatacagtagacggagcaagggacactgagagctatgttcatgggactgctgtctgagtgtctagctagtagaaagaatcgtgttgggctttccggctgatcttgcttgtctcttcgagcaaccatgggatgctaattgcaattgctgctccttatggaatcaaaggtactcaattgatcaagaatgggacagttgcatgcaggaatgactcgttcagtccactgttaatcctatttagaatacacttcatttctacagatgcgtgtctatccattcacagcctttatactaatgggcgacagttccgtagacacccgagggctcttcctgcaattactacacgtttaagctatcgcaattgttgggcccatatgaaagaatactagtctgtctctcgattattattgaatccccggattaagagagaactggccccgaagggattctactcgtgcacctaatgggggccatacagaacttgacctcccttacaaattgtattgggaaaggtccaggaggaggacacaaacgggacttctgggccccctctgaaagccattggaccacaaagccaaaatttttcgaccctttttgaaggtaccattggtcttgcactgaaggtgccccggttgtggtccttttcaacaaattttccacatcctggattcaattgttccttaatggtgggacaacttgacaccagaagtccaggctggttgcagcattacagcattgaaattggctccaagcctatgccagcagccactcccattgggggaagaatcctacagtaggcttgatggaccaggagtgggattgacactgaagccaagacttttaggttaacttcccacacattccatttaggaaatccttagtaaaacaacaggcagcagaaacattccagtaaataagcagcggtccgccgacaggcagactatttcagcggccagagccggaggaagaacccccggtcccccgtacggaggccctgttccaaatctttcaaccacc

SEQ ID NO: 561120 - DNA, 410 bp, Homo sapiens
  misc_feature (51)..(51): n is a, c, g, or t
  misc_feature (74)..(74): n is a, c, g, or t
  misc_feature (82)..(82): n is a, c, g, or t
  misc_feature (96)..(96): n is a, c, g, or t
  misc_feature (150)..(151): n is a, c, g, or t
  misc_feature (168)..(168): n is a, c, g, or t
  misc_feature (183)..(183): n is a, c, g, or t
  misc_feature (252)..(252): n is a, c, g, or t
cttttatacaatgataaggacatatcatttgtttacaaagaaagtctaaantttccgggacattcaaagggctnacacagtnaaggtcatgcaagncctagaatagtgaatcatgacaggcctcattcattttctcctttacctccaccnngcccatctccttaacgngaaggcatctcaagnccaggagcttgtcactagtctgatatttcattcagggatattgggcctgttagcacgtactggcttggnggggggtgactcaaccctaactgtggggaagggttttctgggggggctcactgctgcgaaatgcatgccctgtattcatattgtgttatacggtgaacatgccacatgctttcatttaagtccgtgtgcgtaacacccggaccagggatctcagctat

SEQ ID NO: 561121 - DNA, 321 bp, Homo sapiens
ggtcgacgtttgcaatgagctatgattgcaaacttgaactcctgggctcagatgatcctcctgctttagcctcccagagtgctgggattgcaggtatgtgccactgcacttggctaagcatgtatttttaaaaccagtctttgggccgggtacagtgggtcatgcctgcaatcccagcactatgggaggctgaggcaggcggatcacaaggtcaggagttcaagaccagcctggccaacatggtgaaatgccatctctactaaaaatagaaaaattagccaggcgtggtggtgcacacctgtaatcccagctacttggtcg

SEQ ID NO: 561122 - DNA, 538 bp, Homo sapiens
  misc_feature (1)..(1): n is a, c, g, or t
ncggtgaacactccgccttacaggctcctctctacccaatactataatatatcgtatagcgcattccctaagatttgctccttaagtttcattctctccctttatattctaaacatttccattcctattcatatttcagttttcatcatctaaaccaatcctatttccttgcttctagctctcagctctaaaattccattgcctggctttttactatactagacatcgccaaccacataccaagcaatgcaatgtaaggcactcgtaccccatatcattttcatcttcccctctgaacgttctgcctctcctaagagctacttctatattcaattgtaaaagttaggtcagaaggaaaagtcaggtcagaggaagggatgctgatattacggtccgttctgctaccttgtaatacagcacagtgcactggtgaaatgaatgggcatggggagactagaggaggatagattacattaccacgatcccataaagaaaagagaaccacctgtcatatatgcgatacatgagacaggccaga

SEQ ID NO: 561123 - DNA, 960 bp, Homo sapiens
  misc_feature (343)..(343): n is a, c, g, or t
tcgttggatagtgatgagagtcgtacaagagccctatgttagtgctgtgtgactgcctcgggacggcgtttacttatgggctccccgcgcgcgctttgggagccgccactttacacaatatattccggccgcccaaatttcctggttgccctttcacggtatcccgggctgttttaaatgtgccccccctcaccccccggtatattcgtctgttaaggccccccgaatgtaggggttcccccccaaaatggtgtttgtacacccacccgcccgcagttgggtcttaatactttgccgccgcttgggggtatatccctcccagatattgggccgcggccttgtntcatagtgcagctcttccttggccccccccccacgggggggcccacccctaggacgggttcgcccaagaatgctgggtagccaattgttcgacgggccctgctccccggtccctccaatgatgtccacggcgatgtgggcgcgcactcgtttgtctgaacttttcctctgtgcctacccagttccatcgagcaatgggcgacacaccctcgcggcttcatataaaagattctttgtccgcgccctcttttcaggattgcacttatgccacgacgccccccggcgtaaccttggtcaaccctcgtggccaggccatgggccactgtttctaccacgagggcttcaagtaggcttgccagagtgcaccacccacatacatggggttaattattccccactaatgcgggaggttaccagacacccagcggacattcctccgggctgtatactggaggtgtgcccaccgaggacccactttcgctccctctagagcgcccccagtagcccaaagtggtgttttccgctcattcatggaagactcaatagccattgtgcgtacctacaaggggttttatatccccgggggaaaaccgcccccccaaacacaccaacataaca

SEQ ID NO: 561124 - DNA, 305 bp, Homo sapiens
ctcttgggttcgggtgattctcctgcttcggcctcccgggtggctgggactacaggcgcgtgccaccacgcccagctaattgttttcgtatttttagtagagacggggtttcacagtgttggctaggatggcctcgatctcctgacctcatgatcctcccgccttggcctcccgaggtgctgggattgcaggtgtgagccaccgcatctggctgaggctgggaacattcttgagtgagaattcttttatggtgcaggggaagaaatgggcatgagatcagcctttgagctcactttgttctgcgc

SEQ ID NO: 561125 - DNA, 201 bp, Homo sapiens
cccttcaccagccacacaccacacccagctaattttgtgttttagtagagacagtatttcgccgtgttggccaagctggtgtcgaactcctgaactcaaattatctgcctgcttcggtctctcaaagtgctgggattataagcatgagctgccatgaatgcagtgaaaaggaaacaattctacactgctggtggaagggag

SEQ ID NO: 561126 - DNA, 124 bp, Homo sapiens
ttttttcccttttttaaccccaaaaccaaaaggggagggtttttcttcccgggaattgttttttttttccaaaaaacccggggcgggacccttttttttttatttcttttaaaattttgtccca

SEQ ID NO: 561127 - DNA, 461 bp, Homo sapiens
  misc_feature (453)..(453): n is a, c, g, or t
atctgaatagacatttctccaaagacataaaaatagccaacacgatatatgaaaagatgctcaacatctccaatcagatgaaatctgattgcaattagagaaatgtaaatcagaactacaatgagatatcatctcatcccagaatgctggcaaggatgtgggaaaaggggaaaccttgtacactgttggtgggaatgtaaattaccacagccactatgaagaacagtatggaaattcctcaaaaaaactaaaaacagaattaccatatgatccagcaatcccgccattggatatacatgcaaaagaaaggaactcagtatatcaaagagatacctgaactctcatgtttattgcagcactattcgccatagccaagatatggaatcaacctaagtgtccaccagtggataaaggaaatattatacacactcatatatatataatttccccaantacacgct

SEQ ID NO: 561128 - DNA, 468 bp, Homo sapiens
cacgaggcgtctcctacactgtcgcgaaaacagctggcggcgtgaccgcacggcgatgacgaaaaacgtgtcggaggaggacgggccatgcgattcagggacgagttttcgcaacacatgaggcgggtcgccgcggcgtcggatgcgcgcgctggcgcgctcgcgctggcgggcgaggagcgcatcgccgattcctggcggcgctcgatggagctctaccgggtggatcccgaagtgccggcggcaccgcgcatcctcagtgcggcggaggtgcgcgagcgctgcggacgcatcgaatccttcctgcagctcgcacgcctgggcgtcgggaagctgcacagccagatcaaggacgccggctactgcgtgctgatgaccgacgccgacggcagcacggtcgatttccgcgggctgccgaacatagatcacgaattcaagtcgcgcggtttccgtgtcggtgcctgctgg

SEQ ID NO: 561129 - DNA, 155 bp, Homo sapiens
  misc_feature (1)..(1): n is a, c, g, or t
nctaggagatgtgtgatcacaacagagagaggcacctggatctttgacgtggtcacgtgaaagatgcaatgcacagcttgccactcgactttccacattttggattggcacggcaacaaaccatggattctcttccccgaggaaagggtatcggg

SEQ ID NO: 561130 - DNA, 186 bp, Homo sapiens
tacgccacctccaacgtgttcagcgccagcggcgaccagaaccagtacaacgacatgaacggcgtgatgttctgcgaaaccccatggctgctggatgccaacggcccgctgcgccgccaggtcaccgcacaatggccaccagccggcggcagcctcggacgcttgtatgccatgggcgtcgacgcg

SEQ ID NO: 561131 - DNA, 368 bp, Homo sapiens
tccgtgggattagcctttatggttgcacccgccgcgcccacgtgcaaggaatttagctcggcttaggccccgcagctcaggtgccgcgcccacgtcacgtgacgcgagggcggggacgcgctcgggagcgagcgtgggagcctggaagcctcggtgggtcccgaggatgcagcgagcccgggcccgtcccctgtgctggcgggatctggcgtttgcgggcaccccgcaccaaatcccggtctcggtggtaagggaggtgcagtgtcctgaaatgcctgcaacagctgtgtgcaataattcgtgcatagaatgcgcccagtaaatatgtgttgcgtgcaaaaaagaaaaaaagaaaagccgtgcggccg

SEQ ID NO: 561132 - DNA, 740 bp, Homo sapiens
  misc_feature (186)..(186): n is a, c, g, or t
  misc_feature (388)..(388): n is a, c, g, or t
  misc_feature (740)..(740): n is a, c, g, or t
ggaggcgcacagcgctggcacagcgtagtgctgccggcccagactccactccccaggctgtgcacataggaggagctctacggtgactttgaagacttggaaacaggggacgtgcacaagggaaaatcaggccccaatactcagaatgaagatatagagaaagaagttaaggaagaaataaacccngagcgaaggaacgataagtgccaagacaaaagcatttggactaagaagagaaaattgcatggacgatgtttgatgtggaagtatgatgataggcagaaagctacatactttgtgatggatcttgaaaggaggaaatggcggaaacgaagcagtagactgaatcattgcagtaatttgaaagcatcagagatgatgtaagccntgtagttcgatgtgatgtaggcgtttctccgactctggggatggtacgtcatcgcagttgcagtattgtaaagatgttcccatgtgcaaatattgtcgtaaacaacattggcaccccccgttgtgaccccgagtgtattccctgggatgggctctggagcaaatcagacggcatgcggacaattcgttgagactatcggatgcaagaatagcgatcgttgaacaggacataggatcagatctgcgctgataaagcagaaatctcgtccagaggtccccgggagaaatcctaatccaatgattttcccctgctagcgcgtgggaggggaagggtattccaggtaacaattccn

SEQ ID NO: 561133 - DNA, 880 bp, Homo sapiens
gagagagagagagagagagagagagagagagagagagagagagagagagagagagagagaggtgtgcacggtggtttggtggggaacactctccccgagtgtgtgtttcctctctctcggcgcgcgccccaaccccggggtgttttggtgtgtgtgggacaagagactctgtgtgggagagagacgccaacgagagcgcgtgtggttattccgtgacgtcgtgtgtgtcctcctatttgcatgctagttggtatctgtcacactagtcgtgggacgatgtaggaatatcatcgtcggcaaacacattctttcataaaagcaagagtcgtctgtgtgcgcccggggggcacacccgatgtgtttggtagagagagcgcccctcgtgacacccccaagggcaagagaagaagatatagtgatcatcatatttagtgtgagagactctataaacacccgcggtagtagtgtgctgtgctactactacaggggcgcgcgtcgtcctctctatgtcgtgtgcagcgcaccgacgtgaggtattgtcagtgcgtctaatgagagaacgggtgatcaccacaaagtgtgctgctactatattaggagggactacggctctccccccacgctacgtcgtatgtgtgtatgtgtgtgggccgataatctgacgctgtctctctcataaatactctctgtgagcgaggatagtgtcttcaaccacaggcggcgcgcgagaaacgcgcgcgcaaatatcaagagaaaaatctgtcctatctcgcctcatgatatctcacgagagagagtattggccccgcggacagtactcctctccttttttctgggaagaaagaaaacacacaagctgcgccagagtggacacggatcc

SEQ ID NO: 561134 - DNA, 859 bp, Homo sapiens
acatatgaaccacatgttgagaacctgcttggatcattttgcaacgatggtcattcgtagaaggcagaggaaccactcatgctggtatccactaagtatcactctaaatgttccgtaagtaatctggctaacaccttcttaaacatggttagttgctatgtacaaggaatctctttattggtacaccactctgtggtggctggctagctagtgcctaccgaagcatagttcgcctctatagaaggctatccttagatcatgtctcatatggaaacattcttgcttgtcttagaccttacttgaatctttgacctgataataaagtagagcattatacattgaaagcgtctgatcaacggccctgaaatttcccatctctgaatgtctttgtatgaaactgcagtttgcttatatagctaatcactagcatcggtaattgttccatgaacttcagccgtgtgatactcctgcaatggaagtgttatgtgatcgaagcaaatgtgagtcgtattattgttcaatggtggtcagagtgactttaatctgatcatgcgtgatccgctcatccctgtatatagagtagagtgtagtcattttaactttacttgtcatatcatatagctaagcttaggtctaatgctatagtctctagcatattgagttcggtggtaatcgacgtcatacacggtctttttttttcacaggtccccgggattgcattgtgcagctggctagtcatctggcgtcggctgaaagcactccttgggaacaccttcgagagtccgcctttttatgggggaacaaaccactaaaaacataagaaaatgggggggcgcacgcgcaggaaagtcatagaccg

SEQ ID NO: 561135 - DNA, 223 bp, Homo sapiens
atttatcctgtgtgtaacagacagattcaattatagcttaaaaatgtacaattattattgactgtagtaaccttgtagtgctatcaaatactaggtcttagtcattctacctttttgtgcccattaacattccccaattccccctcatcctgcccgcactacctttcccagcctctggtaaacattcttctactctctatctctagaagtacagttgtatata

SEQ ID NO: 561136 - DNA, 294 bp, Homo sapiens
cccccccttttttttttttgggggggtaaaaagggggggggctttttttttttgggggggccccccgggtttttgggacccccggggccccggggggtttgggttttttaggccaaaaaacccgggaaaaaagccctttttttgggggggcccccccaatttggcgggggggggggggggggggggtttttcccgggttcccccccccccccggggttttagggggggggggttggggccccccccccctttttccccggggtttttttgggccttaaaattttttttccccca

SEQ ID NO: 561137 - DNA, 82 bp, Homo sapiens
ggggccgcgctttacatgggcctgcgctttacaggtgccgcgctttacagggtgccgcgctttacaggggccgcgctttaca

SEQ ID NO: 561138 - DNA, 240 bp, Homo sapiens
gagatggcgtcatagcacaccagcctgggcaacagggcaagactctgtctcaaaaaaaattaaaaaaagaaattttttttaaaagcccagtttttttaatggactaaagatttgaacaaaacacttcacaaacgaagatacacggttggctaataagcccatgaaaagatgctcaacgtcactagtcatcagagaatgcaaattaaaaccacaatgagaagctcctacactcctgctaga

SEQ ID NO: 561139 - DNA, 1150 bp, Homo sapiens
cgatggaaataagggattggggtgcatgagatatgaggttggggtacttgtccctcctctagaaaagtgggacttggtacgagtgaaggagaaggggttgaggggtacttgccccctcccagaaaagcagagaaggggtagagacaagaagacaaggggttcggttacttgccctgtccctggaaaagcagacgaaggggtacgagacaaggagagaaggggttggggtatttgccccttccccagaaaagcgggacttgcccctaagggtgaaggaccaaggcaggcgtccttgtgtggtctgacacccttgaaacgtgggcgtataatcagagaggtgtccctgcagtgattaaacaccaagggaaggctgccttcccagtccgtgaccggtgccggagtctttgggctccacggcataaaaacgtgctctccttatgctctctaccagaaacctgcaccaggccattcgcaacttcaagcagccaaggcgagaccattgcacgctgtggtgccaacgcatcgaacaggcacgaacagagcattgcgcgcgatacgtgcacgggaagcgctcggacgcacagacgacgctaacacaacgattgccccgctcacccgcgacctcgaaaacctcgggcgacgacctgtccactccgcgccctcgcgctgggcgctcctggacggacccttgaccgccggcccggctggactccccctccacagcgcgccacaacgagcccggaggacgcggccgacttgactctcctaacgggggaaggatccccctggaatcccaagctcaacggggcaccgcaatcttccatgcgcgcagatccagcgcctgcacgcagaacgcaagcaacacgaggcgcatacgcggctcgagcaccatggcgcacgagcaacgacacccctgcgcacgacaaggcgcggaggcacggacttcccgaacacacgacagctcacgccgcccctggacccaatcgagccggcgcggcgccccgtcgcaacacgcgccacgcgcacacgagaacgaagaacctacagcgaaccagcgcagtacgtccccactgcgacgccgagagacgtgacgcgcaccgacgggcgcaacgagcgcgcacccaacgagaccacgaagaacaaaggaacc

SEQ ID NO: 561140 - DNA, 107 bp, Homo sapiens
  misc_feature (22)..(22): n is a, c, g, or t
gatcctaaacaaagctctgatngctggggggcccttgcctcgaccaccgtgatgagcccctgtggaggtgaagacattggtggctgaccacgtcgcctcttatgcca

SEQ ID NO: 561141 - DNA, 694 bp, Homo sapiens
  misc_feature (13)..(14): n is a, c, g, or t
  misc_feature (17)..(20): n is a, c, g, or t
  misc_feature (22)..(22): n is a, c, g, or t
  misc_feature (24)..(24): n is a, c, g, or t
  misc_feature (31)..(31): n is a, c, g, or t
  misc_feature (165)..(165): n is a, c, g, or t
  misc_feature (167)..(167): n is a, c, g, or t
  misc_feature (354)..(354): n is a, c, g, or t
  misc_feature (357)..(357): n is a, c, g, or t
ctaagtagaggcnngannnngnancggccgnggctgaggcggctggagcggaagccttgacttcatctcagctccagagcccgccctctcttcctgcagcctgggaacttcagccggctggagccccaccatggctgcaatccgaaagaagctggtgatcgttgngngatggtgcctgtgggaagacctgcctcctcatcgtcttcagcaaggatcagtttccggaggtctacgtccctactgtctttgagaactatattgcggacattgatggtggacggcaagcaggtggagctggctctgtgggacacagcagggcaggaagactatgatcgactgcggcctctctcctanccnggacactgatgtcatcctcatgtgcttctccatctgacagccctgacagcctggaaaacattcctgagaagtggaccccagaggtgaagcacttctgccccaacgtgcccatcatccttggtgtgtgtgaatacagaaggacctgagtgcaagactgagcacaccatgtgagagagctggccaatgatgaatgcagtgatgccctgttcggtctgagtgaaggcctgggacatggcgaacctggatcatgtgcctttggctaccttgagtgctcagcccaatgacaaggcgggagtgcgggaggtgtatgagatggccactcgggctgtcctccagg

SEQ ID NO: 561142 - DNA, 132 bp, Homo sapiens
ccgagttttggtggttggaaagaaaagtacgaagcactggagaaatattggtagaataaagcaatagggaggaaataaaaagagatgaaggcaaattactaatttaaatgaaagaaatgttgccttggcatc

SEQ ID NO: 561143 - DNA, 108 bp, Homo sapiens
gctgcggacacggccgtgtattactctgcgagagacgcgggaatccgagatacagcaatgattattaacgggattcagtactacggtatggacgtctggggccaaggg

SEQ ID NO: 561144 - DNA, 909 bp, Homo sapiens
  misc_feature (32)..(32): n is a, c, g, or t
  misc_feature (99)..(99): n is a, c, g, or t
  misc_feature (118)..(118): n is a, c, g, or t
  misc_feature (134)..(134): n is a, c, g, or t
  misc_feature (138)..(138): n is a, c, g, or t
  misc_feature (140)..(140): n is a, c, g, or t
  misc_feature (143)..(143): n is a, c, g, or t
  misc_feature (159)..(159): n is a, c, g, or t
  misc_feature (161)..(162): n is a, c, g, or t
  misc_feature (183)..(183): n is a, c, g, or t
  misc_feature (193)..(193): n is a, c, g, or t
  misc_feature (207)..(208): n is a, c, g, or t
  misc_feature (253)..(253): n is a, c, g, or t
  misc_feature (259)..(259): n is a, c, g, or t
  misc_feature (265)..(265): n is a, c, g, or t
  misc_feature (267)..(268): n is a, c, g, or t
  misc_feature (295)..(295): n is a, c, g, or t
  misc_feature (299)..(299): n is a, c, g, or t
  misc_feature (309)..(309): n is a, c, g, or t
  misc_feature (317)..(317): n is a, c, g, or t
  misc_feature (332)..(332): n is a, c, g, or t
  misc_feature (336)..(338): n is a, c, g, or t
  misc_feature (340)..(341): n is a, c, g, or t
  misc_feature (344)..(344): n is a, c, g, or t
  misc_feature (346)..(347): n is a, c, g, or t
  misc_feature (352)..(352): n is a, c, g, or t
  misc_feature (356)..(356): n is a, c, g, or t
  misc_feature (358)..(364): n is a, c, g, or t
  misc_feature (367)..(371): n is a, c, g, or t
  misc_feature (375)..(375): n is a, c, g, or t
  misc_feature (394)..(394): n is a, c, g, or t
  misc_feature (398)..(398): n is a, c, g, or t
  misc_feature (406)..(406): n is a, c, g, or t
  misc_feature (412)..(412): n is a, c, g, or t
  misc_feature (438)..(438): n is a, c, g, or t
  misc_feature (475)..(475): n is a, c, g, or t
  misc_feature (479)..(479): n is a, c, g, or t
  misc_feature (483)..(483): n is a, c, g, or t
  misc_feature (492)..(492): n is a, c, g, or t
  misc_feature (519)..(519): n is a, c, g, or t
  misc_feature (522)..(522): n is a, c, g, or t
  misc_feature (662)..(662): n is a, c, g, or t
  misc_feature (704)..(706): n is a, c, g, or t
  misc_feature (709)..(709): n is a, c, g, or t
  misc_feature (711)..(711): n is a, c, g, or t
  misc_feature (714)..(714): n is a, c, g, or t
  misc_feature (720)..(720): n is a, c, g, or t
  misc_feature (726)..(726): n is a, c, g, or t
  misc_feature (734)..(734): n is a, c, g, or t
  misc_feature (812)..(812): n is a, c, g, or t
  misc_feature (900)..(900): n is a, c, g, or t
tcgagctcctagcatctttggggcgtcgagcngcacgccgaggtggctataaaatgcccgacagcgattgtggccgccgcgatcaaacaccacccactntttgataacacacagaacnaaatcaattgcaaagnagcncnttncgatacacacccaccntnnctccagtgataaaaagtgagngctgggatcngggcacccaggttnngcttctttatgcctgcactcatttcacataacgctgttcccccanatgccngtgccncnntaaggcgttgactgtgtgttatagagnacanttcactcttntgagtagncctcgtaacctaatncctnnncnnccnannacctngtcntnnnnnnnaannnnnggcnggggggggcgggcgggcgnatcnggaggggncttttnagaggccaccattgcttgtttgggcnttctttccaaaaaactttgtccaaaaccaaaaaaggntctntccncaaaactgnaactgagtcctttctcgggcctctctngtnctacgggtctggaaccagaaaaactcctttgtcggggaacaaatctgttgggtcttttattctgggcttctagggtcatcaccataacatgtcctttgtccagattttttactggggcctataaatactctggggccatnttttttaccacctctccaggcttgatctttttttttataaannncancngcnccaccngcaaanccactggncatacccttggattggttgaagagctttggtcatactgaacttcattggaagttcgaggattaggaacaccgagagcnataacttcactgatatcccgattttcatttctctgaagtttcgacctcttatcaggagctgccctggaaagattccggtcatgctgtntctcttttc

SEQ ID NO: 561145 - DNA, 232 bp, Homo sapiens
ggtcagacatgcgatacagaagagccgcgcgagctgacgatgagccaaagcctgttgagcggggaggaacgctgtcgctcagcctgtttaacgaagactactgggataacaatcgccgttcgcagtctgtcagcctcagctacaacaacagctgggaagcggtcagttacgggctgaattacacgttcaaccagaacggttacgacagtaacggcaatcgcagcagtattcg

SEQ ID NO: 561146 - DNA, 443 bp, Homo sapiens
atggtcaactgacagtgctgtaagatcaggagagtggaaccaggagctcagagtcctgactgcggactatccctggaggctcgtttaattttattgtgctcatctcaggaacaaaagcattttttagttaaataatttaacatcaaaacaacatgcaaccaaaaacttctgacatttatagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaatagga

SEQ ID NO: 561147 - DNA, 533 bp, Homo sapiens
ggccgaacagaggctcttctgcttcttaacaccgacagcagacttctttccatttcttagctaccacaggcttcttgccgtgcaaccggcgccttctcatctgattcggcttgtagtgccgctgctgcatcatctgccattatccatccggagcttgtgattcctggccgggcgaagaatggtgttccggcgcatggtctttgcctatgggtttagcttcaacatgattctcaagtttttcagtgggttcttctttaggactctgcgatggatcttcttgcgtggtgctcgaagggctctttggatctctgggcttttcaagattctgctaagatctgtattaatcatcttgtgcatgggaagattgtagttactcttgagggaagcggctttacgccaagtgccgtacaattcatctaacttccggaaagcactttcagtccaaatgcagaaacgtcccacatgcccaccaggagcaagcttcaaaatgttcagcttgcttacattaagcagagtaattccagggatgtttc

SEQ ID NO: 561148 - DNA, 828 bp, Homo sapiens
taagtaaagatggagtttcactctgtttcccaggcgtggtcttgaactccgtgggccatgccgtggccagggacatgaattggtacaaagaaatttccctcccgtgccgtgcacaattttcacccgatggacgtcacgcttagtccaagagcgaagtttccgtggtgaaatgcggccagattacttcgaatatatttccatgtggattcattgggcctccgttccataagcctttcgcccattttcaccagagaaacacgtggcgagacctaagtccgtttgagaatagctagcattttggagtgcctcaagaacagtcagcattttaaagttcagctttagaaaactttgttaaacctttgtgtgtcacaatacggagttgaggcaattgagccaggattctagccctagtccgatggtatagaaaacgaccatttggattcaggtatcaatttgccatattcacaggttggactggtcccttttacagaaggctaaagtcagaggaatgggggctgggccactccctgggagctctcagatctacagacaagctgtgtgaatgcatagatgtaatctggtgtcaaatactaatacagtggagattgggataatgttaccattaagttcctctaaaaagtgtgtatgcctctacttaagagccaaaatacaagtgaactacagtgtgtccagataaggtcaccaatctgatgctgtcagtttgaccgagctggttagcttagggccatgctggaattggtagaataatagggatcagtttcaaatcctactactcccttgtacgggagtctgaggccagagttagga

SEQ ID NO: 561149 - DNA, 257 bp, Homo sapiens
tgtagggagatgagctgccctgtgacatgcggactcccatctgacaagcagtgacaacgcttcatgtgctgcctgtgagcatcctcttataaccgagtgtggactcctatcaatgctctcctcaaggggccagctcatgacgccgggctttctgaagagaccaatgcatatcccttatgacaccacagcattacagagcagtttaaacgagacaagaagagtagtacacatcctgtggcctggagccttgatccagc

SEQ ID NO: 561150 - DNA, 402 bp, Homo sapiens
gagggccgagtccacccgccggcccgtgtcagcacgacggtcatagctgaacagtgcgcaggatacgaggacgcggacaggcagatcggctacacaccgaacaatcagaccagtacaccaactggaatggtcaaacaattgaagtcaactgtctcagtggtgcaattaacataagggttcaaatatgtaagcaatctattaatttctttaaagtcatgttcaggcacggtgctgtttcaaaaaacactcattagcttggtccacacatgtacgttcatccaaaagttacccaaggtcattaggacgttgaatgcagctttaaacaataaaaaaatggtattaggtttacttctcgcaacacggcgagcccccaaccttgtaaactcacccttctgacacaaa

SEQ ID NO: 561151 - DNA, 104 bp, Homo sapiens
tctgggttgcaagaaagtccagtcagaatggaccagctttctctctccttgtcccagcacttcttgtcagcacaggcaacactcaggctttgtcatgagcaggg

SEQ ID NO: 561152 - DNA, 1771 bp, Homo sapiens
ggttgttttccgtctcctcgccttccgtggtctgtggtgggggtgacggctcgtgcgtcggcttgtgtcttgttcttgggctgttcggtccggctttgtgctgcggcgggcggtgtagtcgctctgagggctgggtgtggtcgcgatcgttgtttgtgtctctttgacttccttctcatggtgtggtgtgctcgcccgactgtgtggtgtgttgtttatgtgtggcggctgtcttttgttccttcgttcgctagccgccggccgctgccggttggtcagcccgcggccgcgctatgtttgtgtgacgccgctgcggggtcctgccttgtggcggcatggtggtctgcgtggcgtgtggttggtcgcgtgctgtgttgttgtgttgctcggcgtgtggtgggtgggagggggtccaccgactgtaggggctggcaatgtgtgtcgttgatggtgtgttatcgtctgctcggatcatattcttctgctgtgagtgtgtgtggtatgcggctgagggtgaggtgcggcgtggatgttgagtcttgtgtgatttgtcatccacccgcccgtccagttaggcgtgtttggtgccgcgggctcccccctgtgtgtttttacagctgtcctcccccctgttgtgtgttggttcctcagtacaccaccaaccacctgccgcgagtgtattgttttgtggggcgcctccccccctctgtgtttgagagtctgctcctcgtcgttagggggtgccccccccccccagagtgtggggcgccccccactaagtgtacccacccgggcgttcttgtgtttttatcacccgccgcccgccgcccccccttgttgtacgttttttattatgcccgcgtcgcgctcttacaaggtgtgttggtcgggataggacgcccctcctcgtgaggggggcgccaccacaggtgtgggccgcgcagccgcaactacttctcccacgacgtcgtctgtgatgggggggcggctcgctctcacacactataccaccgcgccacgccaactctgtgtttcccctcacacacacacaagcaagagagggatgtccctctctctctgggaggagaaaatactcgctgcccacagagagagaaaagtctctcccccccgcggtgtcttcacacacagagaaactctcgcgtgtgtgtgtgtggggtgtctcacaagaacacaccaccgcgcagagagggtctctttgtgaggggcgcccctcaccactctgtgcccacacaagatatatagccccccctctctcactgtggggttgagagtgggcgccccctctctgagaggggcgcggtctctctctcttctgggcgcgtgtgtggtgaccccacacagaaagtgagagagagactcccagcgagaggacaccactgtgtgtctcacactctcgcgcgcgcgagagactgagtgttgtcgcccgctcacacctccgccgcagagtgcaccacccgcgcgctgtgtgagaagagacacccccacacagagaacacacagtgtgtggggtgacacacccggcgccccccgcggtctagggacacctccccacaaccgggggacaactgcgcccaccacgggccgaggccccgcccctctgacgcacaacaaacaggcgcgccgtcccacacaggccctccaaggcccccacaggcccccgccacccaaacacccttccccaaattttgggggggggccccgggccccccccccccccacaggaaaaaaagttttttttcccttcccccca

SEQ ID NO: 561153 - DNA, 658 bp, Homo sapiens
ctagttctagatcgcgacggcgcctttttttggaaatcatagataatatcttggccatatttaaaatctattcaaaatattaaataatagttcagatatgaaaaaaatactgcaataaaacggtcaggggtattccatggtgctcccttccctataggaaagtacctgtccgcccaaaagacggatggacggccttcttccagctctacataaagcgcaagcccatgggctcacccgggtcctgcttaacatatattagggctatgtttctaaaaagctgtagtgaccttgtaagtcaaccatggttcaaatcacatatttacatatggatcaattcttatgatagaaagacagacataaatgattcccatagtaaatacttccagttgccataaaaaacaaaaacaaagaaaccaacgtttgggggaccaacagggtaatggtacacaaatatcctttatgtatacaaacaacttcattcgggtataatcttaattggaaagacctaggtacagtattatttcagtgataatgacccctaagatttatcccaaatttaccggtaaaataataaccgagtagaccgaatctgatatattttaaactctgcccatggcttgaaacccttggaggaacccatgctacatcaattggtact

SEQ ID NO: 561154 - DNA, 120 bp, Homo sapiens
atagcggataggggcctccggggtaaagtaggttgacggggtcggaggtgtagagagggagccgtggaggtccaggtgactgcttagaaaactgcacagatatctgatgaaattagcgaa

SEQ ID NO: 561155 - DNA, 108 bp, Homo sapiens
tttagcttacaagtggctccgctactcttatatctcctactcaaattaacaagagatgaagacctccttggtgactggggaggcagatgaagggagagcaggaaccat

SEQ ID NO: 561156 - DNA, 249 bp, Homo sapiens
gctgaaaaattagccgacggccatcttcagatttacaataagtgatacatatgtttatctttcactgtctgactaacttcacttagtatgataatctctaggtccatccatgtggctacaaatggcattatttccattcttgatatggctgagtaatattccattgtatatatgtaccacatcttctctatccactcctctgacaatggacatttaggttgcttccatgacttggttatagtgctgcaa

SEQ ID NO: 561157 - DNA, 119 bp, Homo sapiens
tctccgtgtacgtcggtggccttcaccttctgtgtctcaccactcgtatggaccacgtacgaaagcaaactcctctgctgaattctcaatcttaaatttgttgagcagcagcagcagga

SEQ ID NO: 561158 - DNA, 462 bp, Homo sapiens
tcactgcaaccgccacctcgcaggttcaggtgattctcctgcctcagcctgctgagtagctgggattacaggcgtgggccaacactcccggctgccaaggcaggcatgtaaatgtaataaataagggagataagcaagaaccctgttggacctggtagaagcaaacatataatagtactattacgttgtgtaaaatattagcgccttctatattcatgtcctcccagaattatcaaaaaaactactctatagccgatctggcttatatctcaggagtaataaaattagttaatagggttggcgtcgtggtactctgtgtattcctgcccttatcccaccccaagttgatgtcacatgataacttgatctagtctaagaatgtttatagtgataacgagaagttcagattctggcttaaaatatataattgttttttaatctgtaaaccaaagagaatgagtt

SEQ ID NO: 561159 - DNA, 554 bp, Homo sapiens
tgatagtttgttttaatagccaggagttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttgaaaaatgttttgctgtctttgctttgtttgtatt

SEQ ID NO: 561160 - DNA, 964 bp, Homo sapiens
  misc_feature (458)..(458): n is a, c, g, or t
cggggacaggcggaggcgcgggcaggtccgggcggatcgggcgctggcagcagtagcagcgtgcgcgggcccttcagagtggccgcagtccgagctattgtccctcgtcatcctgttccaacgcgagggctggctgtgaggtggcgggagccatcatgtgggcgccatggcaagagacgggcaggacagaccctgggcccagaggtccagccaattggacaagcagttcctggtatgcagcatctgcctggatcggctaccagtgccccaaggtgtcttccttgcctgctggaccttctgtgatgatgatgtcttccaaagatctatatcccttgctccatgatgccttgactgctatccttgtaccatgtatgccagtgcggatcggtccaatcctccgagagccagggacgtctcggcactggcgggaacaacgtatgcgttcgatcagcaggtcntcatggcaggcaactgcacgcatggcacctgagtgggggcccgcgtactcgcggaggagactcgagctccctacagctgtgagtaggactgtgccgtctctctctgcctgtcccaggcatgaaggcaagacgatggagtgttactggtagaggccttgtgacgacggacctatgtgtggtgagtgccgtgccgtggagcaatctgtagacgcatgagcaacaaggctgactgacgggatcgctggctggacgcacgtcgaacggcaggggcctgacaaagcgccaaggtcagaggctgtgcgttggcccgataggcacgagctggtccagctatgcaaatggccgcgagtcgggggagcagtcgcgccgagcaggctggagggaggcggaaggcagagggcccgtggggccgagatcaggggcgaggagttcggaaggaccctggaagcaaggccacctggagcaggcgcacggcacggcttccggatcccgcgacctggagacca

SEQ ID NO: 561161 - DNA, 365 bp, Homo sapiens
gcagtctgtggcaagaattgttggaacagagacttgccatgctggttctgcatcaacagtctctctagctcagcaatctgagaatacacacggataaagtgctatcagttcaatggaaattggcaggttttcagagggtgtgactgcagaagactattgttcaatttcaaaaatgaaaccctccagaagcaatttcaaagttatacaaatctttcacgtatactgagagtgcaggtgaagatcatccattttccacataaaaataaattgttaaggacttttaaatgaacacccctacctaaaatgcagtgttctgtttggaaatctgtacattatacaagtgaagagcataataaatcttgaaa

SEQ ID NO: 561162 - DNA, 849 bp, Homo sapiens
tgtgcccatctcatgcctgtaatcctagcactttggaaggccgaggtgggtggatgacctgaggtcaggagatggagaccagcctgaccaacatggcaaaaccctgtctctactaaaaatacaaaaattagccaggcgtggtggtgcacacctgtaatcccagctacttgggagactgagacaggagaatgcttgaacccaagaggcagaggttgcagcagtgagccgagatcacgccactgtattcagcctggatgataagctgagactctgtctcaaaaaaaaaaaaagggcaatatagcaaaacggactctcggggttcggcggctgggatatcagaaatctgactccatgaaagtgcttcatcacaatactggacttcggtggtatacgcttggacgtcgtgtccacaacatggtcggacaacttcctcgatacactggagatatccttctcgtacatctggctttcggtgaacgataacattctctggaggatctcagctcttggggtgactgcatatgcagtggtgacccagcaccgttcccatcaatctcgtcaccagacctcgaggttgtgggcacagtatttcagattgaccacccgtccaaccagctgggtatacccacattaacaacccaaacgtgactcatgcatttatacctttccctttatgaccaattctccaataaatatggttctctgctcatactgtgagacccaccaaccgtcgtagtacccgagcgtaatgctgacacacgatgtgcctggcgccacccatacggcgatacgacccgcgcgacacgcccaaactcctcacaaaaaaccaaggcgcgcaacaccaggccc

SEQ ID NO: 561163 - DNA, 178 bp, Homo sapiens
ctcataatcgcccacggggtgacatacctccattactattctgactagcagaaacaaactacgaacgcactcacgagacgcatcataagtcctctactcaagagacttcaaacgtctactacccactaaatagctttttagatgacttctatgtacgcctcgctaaacctcagcctta

SEQ ID NO: 561164 - DNA, 336 bp, Homo sapiens
cgggggccccacgttttgccaattcctccagccaaaggaaaggcccggggtccggggtgttgggctttaagggttttgtgattggatggaaaaaaactgctggggaggaaactggaagtttttgcattccttcaacagaacatttaaagaagggctctatatatatatataaatatatatataaatatatatatatccttctatttggggggactttaggaaaaagccctttggtcccggtaaaaatgaattgtgaccccatcccttcccgcatgagcccagtgagtcccagcaggtatcagcccccctgaaggattaaaaagctcctccccgcca

SEQ ID NO: 561165 - DNA, 723 bp, Homo sapiens
attgctagattgtatggtaagagtacacttagttttgtaaaaatttggcaaattgtcttccaaagtggctgtaccattttgcattgccatcagcaataaatgagagtttttattgctccacatcctcaccagcatttggtgttctggattttggccattctcatagatgtgttatgttcagcagtctgttttaacaaaccctcatggtgattctggtgcactaaacattgaaaaccatgactgtggacagatcttctctcatagaagtagccctcccagctggtcctgattcaatctgctgaccttgtaatgaaacagaataaagaggaggacaatggggaggaaagcagtgtttattgagcgaccacaacatgccaggcactgtatcattataatttcattttattcttccatagaagctaagaaatttttactcttgtccccattttaaagattttttgaaatgagattccaagccatagtaatgtttaagcttacagacctactaagtagtgagttcacattagggaattttgaaaagtacaaaagttataaagaagaattttaggaatttacccaccaccccattcaaaacaacattattatttagtgtaaagtcctcacagtatttttttttttcctggtgtaaaaactcctttgggatttcaggctgctctgtgggtctctcatagaattttaggccccacagtggggtcctttgcc

SEQ ID NO: 561166 - DNA, 478 bp, Homo sapiens
  misc_feature (66)..(67): n is a, c, g, or t
  misc_feature (72)..(72): n is a, c, g, or t
  misc_feature (95)..(95): n is a, c, g, or t
tcaagagcggagggaggcgggagcaagggtgacttcccctcccagctctctccgccggaggaggcnngtacncgccccaccaatcagaggcgggngcgggaccttgcgcctcacgtcatccgcaagaaccgtccctcctccctccgcgaaaaaaaaatcctagcaacttaaactccagcccggcctcccgataggcggagctcgggagaatgtcatccaatccacatccaagaaggagaaaaaaagggagtctcgcctagccagtggaagacaagagaaggcggggctccgggagagccggaggtgggtgggagagaggaaaggggtccgcccctcagctcccctgcaggcgggttgcacaagcgccggcggagtagatagtaaacagtctgggccgaggagtgcaggcaagggccgcccggcgctcggtggactgggcccctgcgccgcctctcccggcgtcgccccgcccggccgg

SEQ ID NO: 561167 - DNA, 752 bp, Homo sapiens
gcatcctgctttgttccattgctggcgaggagctgcgatcctttggaggagaagggatgtcaggtttttggaattttcagcttttgtgctctggtttctccccacctttgtggttttatctacccttggtctttgatgatggcgacctacagatggggttttggggtggatgtcttttttgttgatgttgatgctattcctttctgtgtgttagttttccttctaacagtcaggtccctcagcttcaggtctgttggagtttgctggaagtccactccagaccctcaaacagggatttcttggtgttgcctattctctcccatgtgtttaaatccagggagaggtgtatatatgctttcttcctatttgttggtagtatgttggctagtatttttgcaagaaaagaaattgaaaaagtaaatatattatatcaaaatattgggaaaatggggcccttaatacacaagatctgtgtctgcactgcgtcaagaactctcttcacaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcgtggtggcgcgcgcctgtagtcccagctacacgggaggctgaggcaggagaatggcgtgaaccgggaggcggagcttgcagtgagtcgagatcggccactgactccag

SEQ ID NO: 561168 - DNA, 158 bp, Homo sapiens
aggagatgggcgacggcggaggtgcaaggcaggcacggcgcacaagacgagggcggcctgggcggggtggattagaggtcactctcgccgtacatgcgccgtggagaaggacatgtagtccagagcacctggcactggagtcggtggccggtacctgg

SEQ ID NO: 561169 - DNA, 335 bp, Homo sapiens
ctccccagccgagcatacttccacagagacctcgcggaagaagaagtagacatggtctctatgctccaaggcctggactaagtgtggctttggcggagcagagtgggggctggggcccaaggcttctgttcactacagcatcactggcctggtaaatccgcagctgtggctcagtacaggctgccctctcactagccgcggcacacagggctgaatgagttcgttccgcaggcaaggagcgtcctgggactcccagggaacaagaacacgaatatcgttgtaccactcatccgtcagctttccccgtacagcacagttctccacatctgtactgg

SEQ ID NO: 561170 - DNA, 1074 bp, Homo sapiens
  misc_feature (29)..(29): n is a, c, g, or t
  misc_feature (31)..(31): n is a, c, g, or t
  misc_feature (34)..(34): n is a, c, g, or t
  misc_feature (36)..(37): n is a, c, g, or t
  misc_feature (631)..(631): n is a, c, g, or t
ggcggccgccgccttcgccaggaccgtcngnggncnnagctctgtgacggcgctctctgtgtgtctcgcacctgccctgtgtggattcctggctttaactaaacgcagcctctcatcctcagcacgcgtgtcagaggaggaggagctggaggccctctcagtggccagcacctgccagcttgtctgggactctccagcagctgccgggacatcgtgtgtgtgtcacctgtcactccctggacggcaagtgccagctgaagcgcagagccctcgcccgcctactatgagttcatcggcgtcaggactgccaggacgtgctgcacctgtaccgcctgctctgggcctctgcagttctgaacgtcctgggcctgttcctgggcatcatcaccgccgccgtcctgggggccttcaaggacatggtgcctctgtcccagctggcctatggcccagccgtcccaccacagaccctctacaaccccgcccagcagatcctggcctacgcaggcttccgcctgacgcccgagcccgtcccgacctgctcgtcctaccctctgccccttcagccctgcagccgcttcccagttgcgccctcctctgccctggcttcgtctgaggacctgcagcccccttntccaagcagctctggctctgggcttcccggccaggctccaccgtgctacgcacccacctactttcccccgggggagaagccacccccctacgcaccctgatagaggcgtggagtaaaagataacttgtttgttttttttttaaaaaaaaaggcagcctctagaaatcccgcttctgtggccaacctcctagagaacccgggagaatgttccagaagtctgtcccctcctttcctccctgggcacactggtgagggaggctggaaccaggcagggagtggggccctccagacccaggctggtgacaccttggcttgggctctgctcacaccaaatggcgctgaaagttcccacccggcctcctcctctgagagcaattgttctggtgttttcacatcccttaattaattagctattattatgattttgcaaagacagagaaaaa

SEQ ID NO: 561171 - DNA, 334 bp, Homo sapiens
ttttcacaatgtttcaacatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagtgcaagactagcctggccaacgtggtgaaactttgtctctactaaaaatacaaaaaacttagtcaggtgtagtggtgcacacatataatcccagctagccaggaggctgaggcaggagaattgcatgag

SEQ ID NO: 561172 - DNA, 236 bp, Homo sapiens
cgcttaccttccagccaacgcaaaccctccaaggtggagaatggcttacacagaaacatggcccgtgcttggagccaggtgggtttatcctagtgtatgcgatctcctccaagcagctctttcccttctgtaagcacagctgtgtgctggcagcctcgcctcaggagactatggggttataggggtgggtgagtcatgggttggctcggccaggtggtgtccttgggagattcccg

SEQ ID NO: 561173 - DNA, 440 bp, Homo sapiens
gtatgcatgtatgtgcatgtattcatgtgtgtgtgcatgtgtgtgtgacagtgtctatgtgtgcactactgtgtgacagtgtctgtgtacactactatgtgacagtgtctgcgcatcactgtgtgacagtgtctgtgcattactgtgtgacagtgtctatgtgtgcactactgtgtgatagtgtctacatgcactactgtgtgacagtgtctatatgtgctttactgtgtgacagtgtttgtgtgcattacagtctgacagtgtctgtgtgtgcgttactatgtggcaaggtctatgtgtgacagtgtctatgtgcacattactgtatgacagtgtctgtgtattactgaaattacagaaaaaaacagcggagggggaagccctggagggaattgtgcctggaattctgtcgacgcgcccgcgaatgtagtagtaggcgg

SEQ ID NO: 561174 - DNA, 889 bp, Homo sapiens
  misc_feature (274)..(274): n is a, c, g, or t
  misc_feature (317)..(317): n is a, c, g, or t
ggatctatctcacgtcagctgcccctattatataggagctgattcatgcatcttgcatgtactactagcgcgtgtccacttactgcgatagaacgcgtctcatgcgtgtgttgcatgagtgctctgatcttgctccattatatgctatcatccgagcgtcacagaagaggatgcatcaacgttatcctacgtataccaatcatcgatcacggacatctaggaggatctgctgcagctcgtggaagtatgccctggcctgcttgtggtcactaangtttacctgcattgagagccctggcctcattcccacgtaacgnctagtctgtatgtcacacttatgcgaaaacaacgtcaagagctacgaggcagaataccgcatgcgctcgtgtaacctctacctccaaaagaatgctacacttttggtggctccatctccacacttggtgctcatcgtcgaataccgcctcaactgaagtttcatcgatccaccgcagcataatctgcgtctggggaacaataagacttcttttcccacagcatttcacatgaccaaggtaccctattgcgcacaacgcaaatattaagtaatacacattatgcccaatccctggatgtcgtgtagcgcttggcgggagcgtgctcctttggccacaggttctttggacgagacccctgtacacgctatggttaccgctcccagcgtgggttggcgaacagtactctctcactaattatctgacctcattacactatgagtattaaccacttcttagcagaaaagcaaccggttgactttggcgaacgttgccattggcagccaagggtctcccacaataaatttgaagtgccttgtgagcaaaagtctatggaatagacaaaaataaccacg

SEQ ID NO: 561175 - DNA, 131 bp, Homo sapiens
gcagagctgccacactcaagatctgctcttgtgaatgtggatgggcttcgagcctggattaagaagaaaggattagatttgggtaaacggacgaagccccatgatatacggtgtgccttcaatgagaccaa

SEQ ID NO: 561176 - DNA, 158 bp, Homo sapiens
catagatagttagttattcgttaagcagtaagtcatgaaactccacttatagaaaacaatagcaacagcaggaccactaagtcctaaatataccagagtaaaaacaagtttacgaatattcaaatctgtctgtcattctctaccttctaaacatggga

SEQ ID NO: 561177 - DNA, 132 bp, Homo sapiens
ctgacactgctgcggctgctgaacctggatctgctgttcttgctgggtttgtggctaacactggtggtgactggacaggcaagttcaagcaaagacccagcccacttcagtgctgtctctggcccagagagg

SEQ ID NO: 561178 - DNA, 710 bp, Homo sapiens
ccacgcgtccgcagggtttcaccatgttggttggccagtatggtctcgatatcttgaccttgtgatctgcctgccttggcctcccagattgctgggattgcaggtgtgagccaccacgcctggcctggagaacttttttttttttttttctggtaaatccaaatgtacacctagaaaaacggcgtttctggaaacattccttagtctgggggctcacctaatagtcgtcactcaagccttatcaggaggtaaggattctgtctgaactcaggatccattgggatcggggggcctacctatgggcaatgagaggaatcatatataactggtcactggtccatcctctgagtcttggtagtttggtggagtaaaatacatactggtgccgcatatagaagaaatggagaattggtggttaccctaaatggtcagataattgggggtttcccagtctctccagctctaaagaatctctggcggggtatccctttatgtctgggaaggagactggtacagcttcgggtatctgagaccgtggtggtgccctataacatcgtagttagggctagtgcgtccttaactagtttagggatacctttcgggtggcaattacgagttaccccacagatcttcagaggcaagagttttcagaacttatggaagacctttgggtcattgtggaaaccttcattcaaccaaaagagtgcccc

SEQ ID NO: 561179 - DNA, 464 bp, Homo sapiens
ggcacgcgtggcgaagagagtccgtccagagctccagccatcactgcacttcccaggtgccaagacataacatcactgggtggggagagaactgtcatgaggattattccccctccacacaatcctgagcttctctccctctctcaatgaagaagtgcgtttatgactgatcgcacaacaccatgttggttctgattgcagaaaacacaccttataaatttctgatagccttcctgtaatagagagtgtgacaatatacttcacactgcgtttcggtgtggtaattgatcgtttcagtccagggacgatttggaataaattatacccatcaaaaggatatcacagctcatcctggtggcaggctttacacgtcgacatcgcgttcgtctcccggagagagcagattgcacccggcgggcgcatgaggatgcggagggagcgggcaggggaaaaggaggcggccg

SEQ ID NO: 561180 - DNA, 855 bp, Homo sapiens
tcgccttacctgccatcctgccgtgtgcggcacggccgcattcatctcgctatcgatgtcgctggacggttgattcgtgaggtcgtggcggtactgcgcctgagagtcgatgattgcagggcctcggcggaccgttgcagagggagaagagtggctgttgctgatgagcgaaggggccccctttcagaggatcatctcgtgggatcttggcatacatattcgaaaccttagaagcgcaagtagatcctggctcatcaagcatgtgatatcatctcgttgccgggaatttcctgcatgaaccagtcaacggtacgttatgatcacctagtcgatctgagtgcaccccagggacgagagaggactatggatcgaaggaaaaatggattacaggggaacatctcaggactgatttgcgcctgtaccgtgagtcggtcgctgcgtaggctgtcggagacatttgaagctggtatctccaacgaatggggcagacctcgagagcattgccctttctggcgttacacaacttggggtgtgcacctatcaagctaaacttgtcggtgttaaccgagaatggagttccagctgagccagcctacagcagaagacgatctgcaggaaacttgtgcaacggaagtcacgcacgttacatttcacggaagaattggtggtaccaaccccggacagagttagccatttgtgtccccaaattctcgtggcttggcaattggtgacaaaccatgctggaagccgaagtgtctaacattgcctttgggttcccaacgggcatgggaaaatctcaacccgtcaagggattgcccttgccagttggcaaccccggcttggattgaggcgcca

SEQ ID NO: 561181 - DNA, 239 bp, Homo sapiens
ctggaaacactttatctaagagggtggggaggggggaatctttgccaactataggtcagttctttccttcttgtaagttacacccagtgtatgtatttgcatttatttcgtcgattgcagaatcattgctttgagtgattgtcattgcctacatcttgctctcttttttccttcttgcttgctttcttgctttctttttcaatttccttcttctttccccttcttttctttcatttaaa

SEQ ID NO: 561182 - DNA, 335 bp, Homo sapiens
aaaaacacccctcccaaggatagtagaccacaccacagagtgacacacgacgatccaccaccacgagtggtgtctataatatgagagcacacacacacaccaccagagtcgatgaggaaagacagtatcataaatcctcaacacacactcagcatgcaagaacaaattaggagtgtgtgtgctgccacgggcacccttttattataggtgggtatatataattatgtggtgtgctcaacaaacacaatagagatacactcaccacatggtgaatttattatagtggatcatgagcatatacaccatttatgttgtttttgtgtgtgtggtgtggc

SEQ ID NO: 561183 - DNA, 405 bp, Homo sapiens
  misc_feature (17)..(17): n is a, c, g, or t
  misc_feature (20)..(20): n is a, c, g, or t
gacagcacagtgctgtnagntacaggcagagcaattatcacgtgccaggtcatcttccttgttctttttattcggagacagagtcttgctctgtcattcaggctggagtacagtggcgccatttcagctcaccgcagcctccacctcccaggttcaagcagttctcctgcctcaacctcccgagtaactgggattacaggtgtgtgccaccacacccgactaatttttttatttttggtagagacggggtttcaccatgttggccaggctggtcttgaactcctgacctcaggtgatccacccacctcggcctcccaaagtactgggattataggcgtgagccacggcatccagcctcatccttcttttaaccaataaacatgatgctgtatcttaaaaagagca

SEQ ID NO: 561184 - DNA, 517 bp, Homo sapiens
  misc_feature (125)..(125): n is a, c, g, or t
  misc_feature (334)..(334): n is a, c, g, or t
  misc_feature (372)..(372): n is a, c, g, or t
  misc_feature (386)..(386): n is a, c, g, or t
  misc_feature (390)..(390): n is a, c, g, or t
  misc_feature (402)..(402): n is a, c, g, or t
  misc_feature (414)..(414): n is a, c, g, or t
  misc_feature (458)..(458): n is a, c, g, or t
  misc_feature (469)..(469): n is a, c, g, or t
  misc_feature (477)..(477): n is a, c, g, or t
  misc_feature (491)..(491): n is a, c, g, or t
  misc_feature (494)..(494): n is a, c, g, or t
gggaattcggcacgagggagcagcagacgtattgggcagcccaggtgctgcaccttgcttgacgacccgttgagaagctgccatatcttcaggccatgggttcaccagccctgaaggcacctgtnaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagggncccatgtcagcaaaacggtgaccagcaaaatcctcttnccttattctaaaanttgncccttggggagncttcaggggagnaaggcatttgtttccttccctgggtgtgaactctttcttttggnatttccatccnctatcctnggaaacttaaaggnttnttctgttaacttgaaggcttgtt

SEQ ID NO: 561185 - DNA, 335 bp, Homo sapiens
ggtaatatctgagaatcggcttccacttacaagtgagaacaagtggtgtcagttttctgctggggttagtttgctgagaataatggcttccagctctatccgtgtccctgcaggcgacaagatctcatacctctttatggctgcatagtattccatggtatctgtctgacaggtaattttcccactgatttaccactcatcatgtgggcactggtgacacagactatctgtgcccggcactcgggccaatcccaacaccattccctacgtctggcaccaagaccaccctcaacccccgttaccctgacacccttctctctgcaccgcgaccaccc

SEQ ID NO: 561186 - DNA, 129 bp, Homo sapiens
caaatcacttttctttgtagtgaggtttatatatatcagagcagttacttacgcttagtcatagagaactctttagtggcttaatgtcagctttcatagtggcatccatagataatacaaaaggtcgac

SEQ ID NO: 561187 - DNA, 389 bp, Homo sapiens
tgggccgccagaatcacctctgccagttattggtggtcagcataaggactcacatcctccagttacaagatggaaccgaggggtgaccacctctgagatttccttgactttgtcatagcttgttcctgttttttaaaatctctctcacatctgcctttcttatccccattcttgatgtaaacctccttccgagtcatctattcctcctcctcacatacaaacagagcatctgatcgtacctgtgcagagagcagctcttccttttgttcgctggcaaagtggtagttggaggaagcctcaaagctcgagttgttccctcggtgcaggggagacaaatgggcctgatagtctggccatatttcagcttattcttgagcttgatcagggca

SEQ ID NO: 561188 - DNA, 794 bp, Homo sapiens
aaccctacttgcctaaatgaggaatgtctttcctaccatctaaaactacgaaggtttctggcctgggctaaggtttgtagttgacagtaaaaccctgatgacaccacttggtttcccgtgcaacgctctacattacatatttcacaactcttgtcccatctctagctaggcacactcgcgaacaaacttcttcaactgcaaaactacctctggctaccatgctcctacacgctctttaaaccttcagctcttcaaaacattcccctggcgaaatagccataagtattcactatcaagttcagcttgctgactctcttgctgtatacaacttcacttctccttgctgctcttcagggctaacactcacattctccggtaacagcggctttcacgccttccgtgcaaaaccgctcccggctgtgctaagcatgaccacacaaccagacctcagctaacgctgcccagtcctcactactaggcacaacacacccttcaccaggacacatctaacaagttaccagggcccaggcaccagctggctcacgccctgtaactcccagccacactagcggcagcgcctgaggcagcacggactcccaagctacaggcaactccgagacgagccccgcgccacacatacgtggagacgccggtcacaccaacaccttagcaacaacatcaacccgccgcccgcgccggatcccccactcgcgacgatccacacctcaaccggcccaggctggccctgcatatcacgcagcccgagccctccactgaacctgactggcccactg

SEQ ID NO: 561189 - DNA, 325 bp, Homo sapiens
  misc_feature (89)..(89): n is a, c, g, or t
  misc_feature (95)..(95): n is a, c, g, or t
  misc_feature (219)..(219): n is a, c, g, or t
cagcggcgggccagggccgatttcccgcttccattcgaaccgacaaacgcccaactatcacccgcgtttaacgttagctgaggcaattncagcgnttttgtgtcgctaagacgaaacgtgccttgcaaaatttgcaacgatgacattttatatcccactttgtgcagcgattactgacagggatacgtgtttcataacaaattgtcaacacgcttagcncagcgtggcgataatcacgcctgtcggcattaaagtaggccgtgacattctgtccttctgaagagaagtcgcttcatttaccggcacatgtggcggacaagtgttt

SEQ ID NO: 561190 - DNA, 229 bp, Homo sapiens
cctgctgagtgcaatgctctgtcttttctttcacaaacttgatatatttctcaggggtatcacttccccactgtgtgtgtttttctaaggtgttcagactcatactgccatgaacggtgctggcgattgtctaattgaaacctgtgatgagattgacgctctgtgaaccgcagaggatgcccccacgctctcactatcacatgaactgctgcagcactgacttgacagc

SEQ ID NO: 561191 - DNA, 162 bp, Homo sapiens
cttatcatgatgttgtatcatagctactgtagctgccgatctacttgcatagaaggactctgtcctgttacatcagtcatgccccccagtatctgagttacaccacatggtttgatctactgtccatcaaagtaactgcttgatcagaacccttggggcccc

SEQ ID NO: 561192 - DNA, 414 bp, Homo sapiens
  misc_feature (241)..(241): n is a, c, g, or t
cagatgctgctttgttgttgctgctctttgccagccttctctgctggagtttggactattgagagggaggtcttcattgttgagtccccaacatctagcacgtgaatggcacataatagacattcaagaaatatgtctgtgaacaggctgggcgcggtgactcatgcctgtaatcccagcactttgggagtccaaggcaggtggatcacgaggtcaggagttcaagaccagcctggccaanatggtgaaacccatctctactaatacattagccgggcgtggcggcgggtacctgtaatcccagctactcgggaggccaaggaagaggtgcttgaacccgggaggcggaagttgcagtgagctgagattgcgccactgcactccagcctgggctagagagagcgacttcatcct

SEQ ID NO: 561193 - DNA, 759 bp, Homo sapiens
agcggtgggttcccagagtgctccgcggcgtgtggagcgaggccttgttcccgcgttgagccgccgcgccgcgccgctcctcagcttcagcctccgcgccaggccggcccgctcgacgactgtgcaggagtgtctgatgtcgtcaacgggactataggagggagatagcaacgggacaccaaagtgagaagaagtgtatggcacatgtatgccacgccactcagctcgtatcgcaccgcacacagtctcactgatcactacatgataactaaaaacgtcgcacagcgtggcacaccggcaagaaaggggccacaacgagcccaggggcggcggcacggggggccgacggccggcacccacacgcgcggcgacaactgacggcacacgccgcgcacctccgggcacaccgcggcaccgcgcgcgcacctgcgggccgacgcgcgcccgtcgcgagacgcagccccccaggccgcggggcacgggcacggcacgcgacgcggccccgcagcagcgcgcagccccagccgcccggacgagaacgcagccgccgagccccgaccccgacgggcacggccgcgcggcgaggcgcgcgcgcgccgtgcgggcgcggacccccagcgcgccgagcaggcgggaccggacgcggcgagcgcagaccgcgctgcccgcgcagggcgcgcgcgcgccagccggacgcgcgcgagccgagagccggcgcgggcgcacgcgcgcgccccgccgcgccacgaccacgcaccg

SEQ ID NO: 561194 - DNA, 656 bp, Homo sapiens
ttgtggtgctagtttctactaatgccagtaccagatgtccatcctacgatcgctgcagcgatagcacgctctcggcggcgtcatgactgagcagatagacccttctgtaggcatcctcgatggggccacgaactggcctcgtggtaacgccagatcggcgtacgtacgcgcctgtcgagattcacctggaacaatatagtccgtcatcgcggcactacttctggacgataataaggacccattcattcattgtgcgtagatttgatcatgggggattgatgactcaagctaatggtaacttccatcatgtctggagcgtcttgcgggggctcacgtcccacattttggtcaagtagaatagctagagtgaatactccatacagaatgagtccagttttagaccctcgtcaaggtcatccttgggaatggaaccccctagctagcacttctagggagatatcgtcactaaatctgggggcaggtcagcgaaactggaaaggagcagaaattgagtgtggagggcccaattagcccaatggaatcgctgcttggagtttggttgcgactttcttgcctctgtgactaacccgggcatgaatatgttcttcttgagattctctgaagactagtaaaccgattcaagcttatggaattac

SEQ ID NO: 561195 - DNA, 172 bp, Homo sapiens
tgcagaaagcccaaaggaagggtgggacttttggggccccttttttttggaaggggcccaggggaggtttggaaaggaacaacctaggcaacgtggcaaactgcgtctctaccaaaaataccaaaaaagtttttaaaaaggggggcccccctttttgggggggggagaagag

SEQ ID NO: 561196 - DNA, 337 bp, Homo sapiens
  misc_feature (321)..(321): n is a, c, g, or t
gcctgctgccatagcagcacctttagctaggttggcccgagtaaggcctttttgctttcctgccctggtgaatggccttagctttttaggccactgggggttgttggctgggtttcccattttccaaagggaaatctccctgttgggatggaagatgggcctggccttgggaaaggaattggccattggttgccatggtgaccagggaccacgttgctgccctgtgaatgctgagtgagcgagtaagggaggaggggcgattgagggttaacctctgtcttggggaggctgatttctaaaacactggctggccctctcatnctcactcctcctgggg

SEQ ID NO: 561197 - DNA, 249 bp, Homo sapiens
tctatagatccccctcgtcagcgaggacaacgactactggtacgggcaggcggccggagcgcgggtgggcgacgagtaccgcttcgttctcatgaacggagggcaagtgatctcccgcatcgacccttacgcccgccacgtgacgaactcgatcggcaatggcattatcaccgaccccaattcttacgactgggagggtgatgacttcactgctccaccgacgaacgaactcgtcatctacgagatgca

SEQ ID NO: 561198 - DNA, 700 bp, Homo sapiens
  misc_feature (25)..(25): n is a, c, g, or t
  misc_feature (65)..(65): n is a, c, g, or t
  misc_feature (157)..(157): n is a, c, g, or t
  misc_feature (181)..(181): n is a, c, g, or t
  misc_feature (302)..(303): n is a, c, g, or t
  misc_feature (314)..(314): n is a, c, g, or t
  misc_feature (316)..(316): n is a, c, g, or t
  misc_feature (325)..(325): n is a, c, g, or t
  misc_feature (415)..(415): n is a, c, g, or t
  misc_feature (459)..(459): n is a, c, g, or t
  misc_feature (470)..(470): n is a, c, g, or t
  misc_feature (474)..(474): n is a, c, g, or t
  misc_feature (494)..(494): n is a, c, g, or t
  misc_feature (503)..(503): n is a, c, g, or t
  misc_feature (517)..(517): n is a, c, g, or t
  misc_feature (527)..(527): n is a, c, g, or t
  misc_feature (565)..(565): n is a, c, g, or t
  misc_feature (614)..(614): n is a, c, g, or t
  misc_feature (700)..(700): n is a, c, g, or t
aggcatgtgacctagtattatcgcnagcatctatctcgctaagaatgagggcattttcccgtggnctgcagttccgtttaatggctattagaggaatggttggtctttgtgagggtctcacgtccaggatcctcatcaaagcgtgctaggcccttancagagagggtagatcctgctcgcnggctccctcaccttctctcccatcccagataggcagaacaggggctacacaggtttctggagagctgtccagatagaggatcacaaacatgagctccacctgggaaacacagacagccccnntcccccccccncnacaagagcnggcaacctgggtccaaattcagaggacaccacagccggcagagggctgcagcatgccaggtaggacggaagtcgctgggggtggggatgngccccagcccctagagcctggaatagcacccggcgtgggctacngccctgccccncccncctcgcagctgctcggctcncccatggcnctgcctatgctgcnggcttttgcngcctaggctgtgcacatgaagcctccatttccaggtcnaggggtcaggcaaggagatctccttcagggctgggccctgcatcaccanctttgctggtgggaattaaatatagcacagggagacacagttgccaggcagaagcaggaggtgctgtgaatagaaaagtgcccttn

SEQ ID NO: 561199 - DNA, 1050 bp, Homo sapiens
  misc_feature (41)..(41): n is a, c, g, or t
  misc_feature (58)..(58): n is a, c, g, or t
  misc_feature (406)..(406): n is a, c, g, or t
  misc_feature (414)..(414): n is a, c, g, or t
  misc_feature (713)..(713): n is a, c, g, or t
  misc_feature (962)..(962): n is a, c, g, or t
  misc_feature (986)..(986): n is a, c, g, or t
  misc_feature (995)..(995): n is a, c, g, or t
  misc_feature (1050)..(1050): n is a, c, g, or t
ggcatttcgggcatacacccgtataagaatcacagcactanagatacatagacagacntacctgtgttgcttcatttgggtttagtagtgtgcatgattctatcgtcatgtagatcgtagtcatagctctctgactcatgaagagccagctcccgtcgctatgctatctcactatgcattgtatatatggcgccctctggacatgcgtcagaacacgtctgtagccaagtaagtgagtgctcttctccgtcgtctggcctactgtggcacttattgttgtagtggtagggaggcgtaagagaatgatccgctagagagacgagcataatatgattggggccttatatcagtataacgcataagccgaatatattacttttattaaacttagtgctcgtttgtgcgntgtcattntcctcggacagcagtgataatcttttatatgagagccatgagagacctgtagtataataagctgagctcgagtagtaccacattggctccttctcccgtggctacagattcaatgcgatcacactcaccctcccgcgcctagactcgctccttcttgtttgtcgttcacctctgttctcttcgtctttgtcttctcttcgcaccctcgcctcttgcctcgccgctgttgtccagtagtcctctcactgtattcgatccattttcgcacgctgtaccgtctgtctcgcttcctctctatngagtgatagggcgtgtaggcaagagtaagtgagctgttctaatcttgctacatctcatctctaccctggggtccactgagagcttgcgcagttctatcgtggtagtggtcacatgtgagtgttacagtgctgagatagcgtatagtggtcgaggtgtgacggcacttgttgtgctcttgtctttctctctcgtgcttcactgaatgatcttgcagtgatgttgacttgcgtgtgtggcacactatgttnccacaccgcaaaccgctgcactcngaggacacntcatttgtatcctcttgagcccacgagagaactatcaataacatgtaactgacgn

SEQ ID NO: 561200 - DNA, 826 bp, Homo sapiens
agcggagtagagcgcttgctgctgcagtacttagtggtcgcgctccactgacagataggagcgaccgaccgaccatggcgcccggcagatggcccgcgggccgatcgtccgtactggaggttgcgctcgtcggaggcgccagacgctgctctcgtgcttgctacatcccagtggccgcgcgctgcaggagcctcccggagcatgcttgttcatcagtaacacaaacaaaacctgtgaagagtgcctagaagaacgtctccttgtctttggtgcaaacacgtaacataggcgttgtctggtactaccctagttagcaatgcgtcttgccgagccggacttccctttgtaaattgagctctgcacgctggggagtttgttcgggtgaactttgaggcgctgatcatcaccatgtcggtagtcgggggaaccctcctccgtgaggcattgccagtcatgcttgctgctgctgctgtgcaggaggaagaggcagccggaagccggcacaggcaggtgcaggagaaggccagtgcgtgagcgggaggagaggcggatacggcaggaggaacggagagcagagatgaagacaagatcgagtgatgaaagtcgagaacaatgaactagtggtctgttgtaaagaagaaaacccgtatgctagatttgaacaagcatagctaaatgcgctccagctacatcagatcccgactgcttcctgtgaggtgcacgctccagtagcccagccagccgggagaccacgtggccatttgcggtctcctgacctttggcagtgaacctgtcagccttccggacatgggcgggagagctgccc

SEQ ID NO: 561201 - DNA, 184 bp, Homo sapiens
ttttatgtatttttttttgttttatatgattatgatggaagatcagaatgctgtctggcagtctgatccatccatctctctcttgctgaggggaaagagagatgggccaggcagagaacagaactggaggcagtccatctagggaatgggactgtgacggccctaccttgtgaaatgtctggac

SEQ ID NO: 561202 - DNA, 410 bp, Homo sapiens
ttacaatccccacgatcactgaggtaggaccccacagggttctcagggaacttccttaccctgtcctcaagtctccggccaaggccaggccctgtggacgtcatgcctggcatcctgttcggaatacccttgtggaccctgcctttaaccaaaactccaggacccccagagaattccagaattatattaaatgttaatattatttactagagggctgggcgcagcggctcatgcctgtaatcccagcactttgggaggccgaggcaggtggatcacatgaggtcaggagttagagaccagcctgaccaacatggtggaaacccccccgctactaaaaatacaaaaattagccaggtgtggtggcgcatacctgtaatcccagatactcaggaggctgaggcgggagactc

SEQ ID NO: 561203 - DNA, 708 bp, Homo sapiens
gtgtgtgagtgagagagcgagtgagtgagtgagtgagtgtgtgtgtgggggggactcgggttggatgtgtcggtgacttccccctccacttcgacccttcgcctcccgtcgccgctgcaggggccggtcccctgggccgtcaggaaactgagcgatacacgatgacgatcgcaggcggaggcacgcgacgctgacaccaacgggctccatcgatcgagtgcacatggacacgaaaacggtagcggaccaccatcgcgcaggacagaccttcacagctctgcgggactcagatcgccaatcacgtccacgggagcagaaggccctcacagggcaccaaactccgagagaccgaaagccagcagaagtagtagtccaggaactagtgccgacaggacagaaacccacacaccgcaaccaggcacgaagcactatgacagaaccgtcagacgccggccagacaatgcctcgtttactgcgaaggaccaatacgacagccaccgatgccgacagcagggcagcaaaagtgccgaagagcatccgcatactgcgcgccaaaagcatcggccagggcacgcacaacgatacacaccgcatccccgctccgaggagcagaagcacgcaacctcacatactcaccccatggcggacagacagcgcggcacacggcgaaccgagtcataccttgagccggcgaaagagaggggtgga

SEQ ID NO: 561204 - DNA, 148 bp, Homo sapiens
gacgatccccgtaccgatgtcacttaatgtgtcaatttcatcatacactttaccatttattttcataaatgctttcatgagctagcattattgttatgatacttaaatggtcataatcaatcagaactgtttatattctgcctaatat

SEQ ID NO: 561205 - DNA, 344 bp, Homo sapiens
ttgaaggggggatttttaaattttcccctgacccaatgggcaaagttcccctgaaattcaatttttgtccaaaatttccccgattaaacccagggaaattcccctttccacaacgggttaggggtattttttaagccaaaattaatcgggaaacccgtcatttttccccctgggggaaaaagtttttttttaaggacagcctttttggtggccttttgttttttgttttgccttgttttgttttaaggaagggtttccctttgccccggccaaattttcagttaacccaaattttgttttttttgcccccccccctagggggcaaacttaaactgcctttccca

SEQ ID NO: 561206 - DNA, 323 bp, Homo sapiens
gagcacaagttaaattgtttctcagaaattataacagtccgtcaggcgcggtggctcatgcttagtaatcccagcacttttggaggctgaggcaggtggatcacctgagattaggagttcgagaccagcctggccaaaatggcaaaacctcgtctctactaaaaatacaaaaatgagcttggtatgatagcacatgcctgtaatctcagctactcaggaggctgaggcaggagaatcacttgaacccaggaggcggaggttgcagtgagccaaggctgggccattgcacttcagcctgggtgacagagtgagactccatctca

SEQ ID NO: 561207 - DNA, 219 bp, Homo sapiens
  misc_feature (115)..(115): n is a, c, g, or t
  misc_feature (152)..(152): n is a, c, g, or t
  misc_feature (157)..(157): n is a, c, g, or t
  misc_feature (181)..(181): n is a, c, g, or t
  misc_feature (212)..(212): n is a, c, g, or t
gaagttgaagagctttttgcctattgaaggtgcattgagaaataaacttctttcctgccaccagaaattgcagttggttaacggcctgcaacttcattcccatgaaatgcagttnaatagccacagaaaatgtcacattaagcaaagcagcnagggnctcatcgtgtttgagactcgagtnctctcagaccttggattcattccctggtgtncttgaag

SEQ ID NO: 561208 - DNA, 304 bp, Homo sapiens
caataaaaactacatagaatgcaaccgagcagccgaatccaaacgctgagccaacacgtccaggtcatcatcaaataaatcagcgtacacatccagagtcatcgcagccgacgcatgcccaagcatccgctgaaccgccttcacatttgcacccgactgcacagcgagacttgcagccgtatggcgtaattcgtgtggagtaacccgaggaatcccagactcccttaacgccattccccaccagccgtcacgcgcattcggccacgaccgcaacgaggaccgctttaaatgcgactgatgagcg

SEQ ID NO: 561209 - DNA, 102 bp, Homo sapiens
acgcacgcttatgccattgccctattagtacgatgtctgaccgtacctagcgtaccttcgaactcctccgttacactttgtgtgagtgagtaccaccatgag

SEQ ID NO: 561210 - DNA, 336 bp, Homo sapiens
gctaaatttgagggaatgttatcctctcgccgcctcccccggcgccggatattagagacaataacacaggggtaatgtacacccactgctttattgggagtaatatcatcctctcccttcttggatattaggaacaatatcacactgtgcgtgtacacctgtcgtgaaattcaatggaatgtcatcctgtgtctccctggatatgatgaacaatatcacgggggatgtacaacttccgagatattgggagtgatatcatcctctcccctctggaagttagggacaatatcacaggggtagtgtacagcttctgggatgttgggactaatatcatcc

SEQ ID NO: 561211 - DNA, 553 bp, Homo sapiens
  misc_feature (91)..(91): n is a, c, g, or t
  misc_feature (499)..(499): n is a, c, g, or t
gaatacttcatggtgttctctgtatttcctgaatttgaatgttggcctgtcttgctaggttggggaagttctcgtggataatatcctgaanagtgttttccaacttggttccattctccctgtcactttcaggtacaccaatcaaacgtaggctaggtcttttcacatagtctcatatttcttggacgctttgttccttttcattcttttttctctaatctgtcttcacgctttatttcattaagttgatcttcaatctctgatatcctttctcccacttgatcgattaggccattgatacttgtgtatgcttcacgaagttcttgggctgtgtttttcagctccatcaggtcatttatgttcttctctcaactggttattctagttagcaatttctctaatcttttttcaaggttcttaactccttgcattgggttagaacatgccctttactcggaagaatttgttatatctgcctctgaagctattctgtcaatcntccaacttatcctgtcaattttgttcctgtggtgagaattgtgatcttggagaa

SEQ ID NO: 561212 - DNA, 244 bp, Homo sapiens
  misc_feature (21)..(21): n is a, c, g, or t
gggctgggtgcatgccagggncccaatcaagcatttttatcttctgaaatctttgaattcctgcctttcttggatgtttggtcttttgatataatttagcatgggccaacatttggtccagatttgtattagccaagccctcctaaaatagtaataacagtatctggcgatttgagcttttacgtagaatgtagaatctctggtgagtgaacatatcaataaagacaacctgaaccaaaattaa

SEQ ID NO: 561213 - DNA, 144 bp, Homo sapiens
  misc_feature (9)..(9): n is a, c, g, or t
  misc_feature (66)..(66): n is a, c, g, or t
  misc_feature (104)..(104): n is a, c, g, or t
cagacattncctcttactgtgaccgacagcccgtgatggatgtggcctttgtacagttcttggcancagtttctgggaaagtctcttgtttggacacctgtggnaccttgctggtgactctacagtcctgagccgccaggtgag

SEQ ID NO: 561214 - DNA, 196 bp, Homo sapiens
gccacttgttaagaagtcagcgctgagcaggcagctgcaaatatagcgtactgccgcgcggcaaggtttcatgcgatagcctgcacgatcaccccgtggccgcccactggccgtgcgccagattatcggcccccagcagctccagcgtctgcagctgcagcggcacgccctggccttgcgccaccaactgaatatg

SEQ ID NO: 561215 - DNA, 112 bp, Homo sapiens
ctgacctgaggggaacgggcttccaactgaggaaacactgttctgggtgctatgtggctcatgcctgtactctcagtcaccttgtgtgaggctgacggaagcggaggactgc

SEQ ID NO: 561216 - DNA, 336 bp, Homo sapiens
  misc_feature (14)..(14): n is a, c, g, or t
  misc_feature (149)..(149): n is a, c, g, or t
  misc_feature (217)..(217): n is a, c, g, or t
  misc_feature (262)..(262): n is a, c, g, or t
ggcggcatagcctngagacctctggccagcgccaggcaggcagcgggggtggcagaggcctgggctggagtcttctggctctgctctccctggggacaggagggagcctgggggtgtgggtggggagccggccgccgtgacccagcgcntggctctgcccgtaggagtggacagtgcaatgaaggaagaagtgcagaggctgcagtccagggttganctgctggaggagaagctgcagctggtgctggccccactgcacagnctggcctcaggcacttggagcatgggctcccgggaccccggcagcctcctggttgcactcctttccagcagttc

SEQ ID NO: 561217 - DNA, 201 bp, Homo sapiens
tgcaagccttgtcactcttggccactggcccgacattttaccgcgttattgctgtgcacctgtaatcccagctacttgggacgctgaggcaggagaatcctatgaacccgggaggcagagtttgcagtgtgctgagatcgcgccattgcactccagcgcattgtacaagtgcgagacgcttgtctcaatctttgaacaaac

SEQ ID NO: 561218 - DNA, 160 bp, Homo sapiens
cacaccctatagatagtgacatattgcccaaagcatcacagattcaatgtaattcttatcaaaataccacatcgttttccacagaattataaaattgagatgaggtcttgatgtgttgctcaggctggtcttgaactcctgggctcaagcgatccaccca

SEQ ID NO: 561219 - DNA, 536 bp, Homo sapiens
gctgagggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagaaa

SEQ ID NO: 561220 - DNA, 369 bp, Homo sapiens
  misc_feature (3)..(3): n is a, c, g, or t
  misc_feature (19)..(19): n is a, c, g, or t
  misc_feature (52)..(52): n is a, c, g, or t
  misc_feature (89)..(89): n is a, c, g, or t
tantccaattccaattccnattcccattcccattgcaatggagttgattccnattcccattcccattccattccggattattcccattnccattgcattccattcccattccattcccctgcactcgtgttgattccattcccttccatttcattccattccattccattctattccgattaattccattccattccattccattccattccattccattgcaatcgagttgattccattccattcctttccattccagtccattgccttgcattccactcgggttgattccattcccttctttcaactccattacattcccttccattccactcggaatgattgattccattccattccattccattt

SEQ ID NO: 561221 - DNA, 204 bp, Homo sapiens
  misc_feature (104)..(104): n is a, c, g, or t
  misc_feature (111)..(111): n is a, c, g, or t
  misc_feature (141)..(141): n is a, c, g, or t
  misc_feature (173)..(173): n is a, c, g, or t
  misc_feature (184)..(184): n is a, c, g, or t
acctactcaggaggctgaggcaggagaatagcttgaacccaggaagcggaggttgcagtgagccgaggtcatgccactgcactccagcatgggcaatagagcgngactctntccccccggaaaaaaagaacaagggctaanttcaaatcaaattttccctgtaccctaagaanaataattaggncgggagatgtttgactaagt

SEQ ID NO: 561222 - DNA, 372 bp, Homo sapiens
ccgtatgtggcaggattgggcacatcttcactcgcctgcactcaagcggatgtggcatcaggcactgctgcgctcaggagatagagtgcgcatggaccccccctgcaccaacacaacagctgcttccacctacctcaacaacccgtacggttcgttggccgttgggccaacgcaccgtggctcacgcctgtaatcccagcactctgggatgccgaggcaggtggatcacctgaggtcaggagttcgagaccagcctggtcaacatggtgaaaccctgtctctactaataatactaaaatcagaggttgcttgcagtgagccaagatcataccattgcactgcagcctgggcaacagagcgagactctgtctc

SEQ ID NO: 561223 - DNA, 469 bp, Homo sapiens
aaaactggggatcccttagggaacgggttgcctcatacctgaacataagctgggctgctgaaattggatttttagctaatgaaaaaggggttgggctaggcctctaaaaatggtttaatgataaagttttggggccaaatagaaaaaaaaaaaatttgccttcccggccggattttggatattttttttgcctttaaaaatgctattctgggaaatttgggaaatcccggggcctttcatggatatcgggggctttaaaaggattccccaacccctgttgggtttggataaaaaatagacaaagatcatattttttggggggggataagctctggaaaaaagccatccccttatgaaggtgccgggatactccctttttaaccttcccctcccaaaaagccggcttttttttggccctaaacccgattttaaatattaatttggtggtaatttaataatagggctgcca

SEQ ID NO: 561224 - DNA, 225 bp, Homo sapiens
catatggataagccaaatgaccaagcaagattagacatacagaaaatccatgcaggtcccatacacaaagcatggtgcaatagattatgaagcaattgtgaagctaagggatggctttactggagcagatctgaaaaatgttggtaacatgaagcaggtatgtaacgcaatacagggctgcatccatacattttagtagtcctaggcaaagcactacatgcaaag

SEQ ID NO: 561225 - DNA, 133 bp, Homo sapiens
ggcagtttggtctcgaactcctgactcagatgatccacccactttggcctcccaaagtgctgggattacaggcgtgagccaccacgcctggccatttttgaggatttatcactgtatgcagacccctgtctcc

SEQ ID NO: 561226 - DNA, 405 bp, Homo sapiens
cacgagggcgacgatggcgccgcagcagaaggcgaacagcagcaccagcgcgggcgacaggccgtggtgctgacgggaagtgggtgtgttcatggtggtcctcacgatggttcggtgcggaccgtcgcccggggcaacgatctgtaaatgctctggcgtcaccagcgtcaggctggccggttcaggtgaagcaacggtacggcgcaaagcctcgccggagaatccgtcgggtacgcaacgcagcgttgcgcagaatcgaacgctgccgctcaggcttcggtgtccagcacctcacgcagaaaggcaatgaacgcggcgacccgtcgcgagccgcgctgattgggcatatacaccacgctgattgcaacgctcatcgcacccggtgccacctcgtattgcgccagc

SEQ ID NO: 561227 - DNA, 493 bp, Homo sapiens
  misc_feature (445)..(445): n is a, c, g, or t
  misc_feature (462)..(462): n is a, c, g, or t
tctcgtcttcatttctgtgtcctttgttcttagaggtccagcctgtgtggccctgtgacccgcagatattgggagatacacagctaagactccaggaccccctggaagcctagaaatggtgagagtgccgagtctgacatcccgagagagggggaggggctggtcggaaccgtgagaagtggccgtggcggacttaggtctcccggcagtcagctccacaatctgcgcccggaattctccttgcccagctcggcttcagtccccttcagccataagatggcgactgtgctgacagccgggccccggcgttcctgtcttccctccgcagtgactgtgcctgacgtgtagccctgtctggggagctctgcacgcgcaatttccgcagtctctcccagattgttgcaagaaccatggggaggggccttcagatgggagttttgctctnttcgcccaggttggaantgcatgggaacattttgggttaacagcaatt

SEQ ID NO: 561228 - DNA, 921 bp, Homo sapiens
ggcaaggaggcaaggaccccgatctctacccacggatggggagagggcaggaggagacccagccaagtgccttttcctcagcacatgagggagggggcttgatttcccattccctcccggcgacaagctccagggacagggctgtccctcatgggcgagccagacacttcactcagacacaacttcattcctgactgcatccagtcgatggggatcatcacttaccacacccccacaagattcaagacacaaagtctatccagacatgcaccccagtatcgtgtaatcccgtgatgataagcatggtagactggcgcatgatcatccgaggaaccgaagaagccctacagcctggatgtagtacatcccatgcacacctgtgaagaaataagccttaaagatactaaagatgactgaactatcaagaaaaaaaagaaaaggggcgagagcacgaaccaccaaagaatacccatgccaggaggaccacaaagaaaataccgcacgaattccccagaccattaccatgagacacaacacggggagccccataatacggtagagcacgtaattaataaagacaaggacaaagggacagcacagaatcaaccaaacgccaggaaacaggggacaaaccgagacaacaacaaggaaacaccaacgcgaagaaagcgaacccactaacacccatgcagagagcagacacaaatcagaccgccagacagcaccaaaaaacagaacaaataacaagcgaccactaacgcggtaccagacatacaacaaccactacaacagtgaaccccactcggcagttcaccacgcacccgcaacaaaaggccgagcgaggagtgacaacgcaatcaggacacaacgagcaactaagactcacaggcacacccaccagccaacagagacccaaaacga

SEQ ID NO: 561229 - DNA, 171 bp, Homo sapiens
  misc_feature (2)..(2): n is a, c, g, or t
antagcactgcaggcgtcaacaatttgctgaatacataaatggcgatttggccaggcacagtggctcacgcctgttatcccaggactttgggaggcagaggcgggcagatcacaatggtcaggagattgagaccatcctggctaacatggtaaaaccctgtctctactaca

SEQ ID NO: 561230 - DNA, 240 bp, Homo sapiens
tacagtatcccgacaagaaatttttgctttgcgaggatattatgctgtgcagataggcgggtgccttgcttagaagctatgctcttttaccaaggtcttgactaggacaacctctggcgaaacaggaccatgacctgaacagaaatgtctaagattcctcggatgctatgaggtgggtagcctggaaaaggagatgaggcagggagactagaaacccaacacataatggggtatcctaag

SEQ ID NO: 561231 - DNA, 202 bp, Homo sapiens
gcacctgaccgctgtaccctcccagggaaagcgataatggcatcatggatgcctgcagcctgagcagcagcctccacctcatcattcccagctgtgacacggccgtgacggatattgacgccgatggctgcattaaagaggacagcgtcttggggcacaactgcaatgtgagaccgcagagaggcctgacacacctgcgaaa

SEQ ID NO: 561232 - DNA, 412 bp, Homo sapiens
agccctgggccggctgtctcgctgcgatgctctgctggtcgcggacggaccctgcctccccagcttatcccaggccagaggctgcatgccactgtccccggcagcgccaacccctgcttggctgttatggtgctggtaataagcctcgcagcccaggtccagagcccccggcgagccggtcccataaccggccccctgcccctgcccctgctcctgctcctccccttcgggccccctcctcctgcaaaacccgctcccgaagcgcgctgccgtctgcagccacgcgggggcgcgcgggagctctgcgggcgctggaacctgcagacccggcctcggtcagctgggaggggcccgccccggcacaaagcacccatgggaataaaggccaagccgcgacagtcagcacggggaa

SEQ ID NO: 561233 - DNA, 881 bp, Homo sapiens
tctgggaggcggttcccccgcggcttagacccgtgttttccacccgggtgcagaccgccgtggtatggtgtgagaccccccttgcgcttcttgttgccccaagacgggcacccctcgtgggcccgcgattcaccaccggggttagtggctgcgtttccccggagagacatccggtggtgttcccccccgcgggtgagcgcccagcgtttatgctgttgccgccggagcagtggcgcgtgcttagagaccctcccccacgcatgtgttcccccccccctcctcttggaggggcggggcacctcttgtgctcctgtgtgtgtgcctccacccccccgggtgggcggagtcattttttcttccgtggtagtttctgcacccccgctgctgtttatctctggtgggcgcgggggcggacaatcacccatgcgggggggcggctcaatcctattggggcgaaaaaatggatcgatcccccccctccggtgggcgcccccactgcgtgggcccgctcctccacacataggcacccccccctgctgtgttctcttgtgtgaccccgctgttgcgcgatgtgacgggggtggacaccccatcagcaatcggtggggtgccgccgcgcccccctcgccccgaggatgggggccccccatcttttgctgcggcggtattttttttggcagaccgccccccgcgggccgccggtttttgtatatctccccctcggcggtctttcccccaacagcgcgcggggtgtctccctctgtcccacccggcgggcgacacgcatttggggtttcccccctccccttttttaaagcccccaaacaccccccatttttttttttttcccccccccccccaaaaaaaagtggggcccccca

SEQ ID NO: 561234 - DNA, 217 bp, Homo sapiens
atcatcattatagttagcagatattttctcctattctgtaggttctctacactcagctgattttttcctttgactgttcataaacttttcagttagatatactcccatttgtctaattttatgctatctgcttttggtcttatccaaaaaaaagtaattgcccaatatcgtgtcatgactctttcctgatgtgtttacttccaggagtatgatagta

SEQ ID NO: 561235 - DNA, 464 bp, Homo sapiens
  misc_feature (50)..(50): n is a, c, g, or t
  misc_feature (68)..(68): n is a, c, g, or t
cccaaaaaaacccccagtgttttaacaaacctgtttaggaatgtcctaanttttgtcaatcaaacccnggatgttattccttcccttccccaactcactgtgctccctaaaggcagcaacccattcatctttccctttgcctctggatacacccgaatgaccccaggtaacatcatcaggcccgggtgcagtggctccctataatccccaatattttgggaggccgaggagagaggatcacttaagcccaggagtctgagaccagcctgggcaacatagcaagacccccatctctgcaaaaaaataagaaaattagcttggcatggtggcacgtgcctgtagtcccagctacatgggaggctgaggtgggaggatcacttgagcccaggaagtccagaacgtagtgagccttgattataccactgcactccagcctgggtgacagagcgagactctgtctcaga

SEQ ID NO: 561236 - DNA, 786 bp, Homo sapiens
ggcgggggaccatgctgcgtgtggcaggctggcgccgaagagcccctgtgtggctgctggtggctgagcgaggtgcccgccgggggggctgctggcttgcgctttgggctccgggtatgcggccttactttcctcttgcgatctcggctgagcttgccggttgcttgcttcggccaggtggtaccgtaagcggggttctcagtcgtggcggtaagccccaacggcagggtccttccccgggcgggagagaactcccaggtcggggtgccccaggagggccccacaggttgctgccctgttcgccccttcccggtgggttggcttaggccccttccccgcgtggggcgcctgtattgcccccgccttgtggttcccgcgggtagctcccatgtcgcgtgagataggcccttttcacgctatacgtctcttgtggacattcctttggtcgggagggttacccccgcagggagcagtgggcgtccgcttgaggagagagctccccaagggtctttccacaagggttgttggcccccggggttagtgtgaaaagggacgcccgggcaccggggacccacgggtcaccgtgggtatatcaaccgctgatgcgtcgaaaaacccctcgttttggaaacgccggggcacgaggatttccacggcaaagaggccccgtgtgtgctcaaaagtaaaagacaagtcgcaaaagggaaccggcaaggtgacccgggccccaaaagataacgggaacgcactcgtgcatccggcagaccagcgagtgcgcgcacccga

SEQ ID NO: 561237 - DNA, 866 bp, Homo sapiens
gaggaggaagccagctctgtgcctggaggagactcgccgcatgtcaggtctctgggtgtgccaagggcccacggagaaaactgacgacccgtttctgaaatccttatgggagacaatcttgtgcctccgggagatccattctcccaccttgaaacgcacgggagggccatgccctccgaaaaagcgctgcactcctcgctccgggtggggattatccggaagaactcccaacggtggtagtgaccactctaccttcggatgctcctcctgattcagacggcctgaagtcgaacatactcactctggagaaggacggggaacctacaattttctccagacccgtaatgaccaggtccttggagtgactagcggtatttggcctccaatttttcccggtgggttggcatttcaatattaataggttcacccctggggtgacgaaaccgcatttggaacgaagttatgtctcactaaaggtgcatacaccttgcttggatggccttgggggtccttgaacctgaggaaggtgggtggcgttacacgggtgctcattgaattgtacatcggggcacggttatcgacttccatgaatttgtcggatcgacggtcctacagaagtgggggcgaagatcgggggtggtaaggaccttttggagatgaaggggcagtggccgtgggtatcagggtggaattagccaaagggaaaacaagtgtctggtgaggaggtatccggaggtaggcaaccatagtgactgttggggtgatgccggtttgtggtatagttaatttgctataagtgttgagggcccataaagttgttggaaaataagttataaaaaaaaggattgtagaggagagagggagat

SEQ ID NO: 561238 - DNA, 110 bp, Homo sapiens
atgccctgaaggggcgagagttatagccaaatcactgtaaaaagctgcattagaggatagcagtggcagctccgagttacaagaaattatgagaaaccgtcgaattcgag

SEQ ID NO: 561239 - DNA, 122 bp, Homo sapiens
ctgcgcggctatggtataatacgcctcacactcattctcaaccccctgacaaaacacattgtctccctctatcctgaactagctacatgaggccttatttttaccagccacagacacctacc

SEQ ID NO: 561240 - DNA, 316 bp, Homo sapiens
agaaggttcccagtaaccaaagaaataattagtgaatgttaaagtaaagggaataacatcctgattgtgggccccgcatcttcccttgaaggggggacctgccaacttcagggcctgtcccctcagaactccaaggactttggacaaatggtccgaaagatcccatatttggggttttggtcctgtgaagaattaggagaaactggaatatggcagctggcagatccccccatccttccttttacccatgggccaactggggggttcaactggagagaggccctgcttcaagaattaacccccccagtggacaaga

SEQ ID NO: 561241 - DNA, 562 bp, Homo sapiens
  misc_feature (13)..(13): n is a, c, g, or t
  misc_feature (36)..(36): n is a, c, g, or t
ggttccccccaanggaaggcccttcagcttaccagnggatctttctgcagcaccctacaagctagaatagagttggggccaatattcaacattcttaaagaattttcaacccagaatttcatatctagcctaaataagcttcataagtgaaggagaaataaaaccctttacagataagcaaatgctgagagattctgtcaccaccaggcctgccttataagagctactgaaggaagcactgaatatggaaggggaaactggtaccagccactgcaaaaacataccaaaatctaaagaccatcgacactttgaagaaactacatcaactaacaggcaaaataaccagctagcatcataatgacaggatcaaattcacagataacaatattaaccttaaatgtaaaggggctaaatgacccaattaaaagacacaggctggcaaattggataaagagtcaaaacccatcagtgtgctgtattcaggagacccatctcacatgcaaagacacacgtaggctcaaaataaagggatggaggaatatttactacgcaaatggatagc

SEQ ID NO: 561242 - DNA, 361 bp, Homo sapiens
ccaatttggggaaattttggcccccaaaataaaaatggcccatattttttggtaaaacccccaggtaccattttttagggcgggggcggggggtccccccctgtattcccacccttttggaggcccaggggggcgggttccaagggtcaggggttaaaaccccttttgggtaccccgggggaaccccgtttttttttaaaaaacaaaaaattaaccgggggccggggggggggcccggggttcccccttattgggggggttggggcgggaaaagggcttaaccccgggggggggggcttccgggggcccaaacagggcccctgccccccgggcgggggggaaaagccaagccccgttccca

SEQ ID NO: 561243 - DNA, 728 bp, Homo sapiens
  misc_feature (116)..(117): n is a, c, g, or t
  misc_feature (119)..(119): n is a, c, g, or t
  misc_feature (125)..(125): n is a, c, g, or t
  misc_feature (129)..(131): n is a, c, g, or t
  misc_feature (147)..(148): n is a, c, g, or t
  misc_feature (166)..(166): n is a, c, g, or t
  misc_feature (213)..(213): n is a, c, g, or t
  misc_feature (256)..(256): n is a, c, g, or t
tgtattggcggtgctgacggacagaaactacacggtcaccggggaggagccccacgtgcagctctaatcacacccctgccagccccacccagacacccctccttccagccacgctnncntctccnagcnnnagcctcctcgggaganncactagaccaaccacggncgtcaccccacaagccacatcagggctgcctcccacagccacactgngatcgacagccacaaaacccacagtgacccaggccacaaccanggccacggcatcgaccgccagcccagccacgacgtccacagctcagtccacaacacggaccacaatgacactaccaaccccagccacatcagggacaagccccacgctgccaaaatcgaccaatcaggaactgccaggaacaacggccacccagacgacaggcccacgtccaaccccagcaagcaccacaggcccaaccaccccacagccaggacaacccacgaggcccacatgccacagagaccactcaaacaagaacgactactgaatacacaacaccccaaagcccagacatcacacactccccgcctacggcggggagtcccgtcccttccacaggtcctgtcactgcaacatctttccatgccaccactacctatccaaccccagcacaccctgagaccacacttcccacctcacggtccacctttctccacctccttggtgacccaagtactcacgtgggggaagg

SEQ ID NO: 561244 - DNA, 1708 bp, Homo sapiens
  misc_feature (74)..(74): n is a, c, g, or t
  misc_feature (223)..(223): n is a, c, g, or t
  misc_feature (363)..(363): n is a, c, g, or t
  misc_feature (1639)..(1639): n is a, c, g, or t
  misc_feature (1708)..(1708): n is a, c, g, or t
gcagaaaatgtcgacattactgctgaagggacgcgcatggttatctgtgaatgggccccacggagggaagcccntgccggcaggggcacttcagagtcagcagtcaatgctgaggaacctcaggcctctgtcgtgtgggaagagacagagaagacacagcaggctccgggctgtgacaagatgcggctgggagtacacagcacaaggaacttggcgtactcgnttcgggagctacttctgataggtcgagtggtagcatgagagcactagagtcaatggagttgttaaccacgttgcgcgcgttaccggattaatcaaagacttgatgtgtcttgcttggtactcgactcaacgtgtccccantacagaccgttttggtttatccaatgcgatggaaagtggggggcttcattccttttggtttggaacatagtacgcggtaaaatggatactaattgtgagtttggcacaaagatagtcaacgaatacgccgacgaagggcgcttttcggggcagttgcacgaaacgcgaaggagctcgattgggtctctaggtgggccaagtttagtgctttcgaaatgatcccgaagcgacaacgtgatcgaacttgtgacactacccgttttggcagaaggcgacgagagttgggatccatatggtaggcgctctctcgatatgtgccaacgagaatgtgccaccgaacgcggctcttttgcactgtgcgagggcgacaacggaccaaactaacacctaagggtctcaaaaaggaaatccaaaacgcgggattcaagtttctaacgcgccaaaaaaagttcggtccaagggaggacgtcggtgaatacatgcgttgagttggattccttaccttgggaacaaccaagagaacggggaagacccctgggatattcaacacgttcggatggcggcccttggagattcggaacaaggttactaagcgaacttgccgtagacacggaagggtttaaagccccttgcggtccggtaaacccattggaagattaaggcaacacgcgaatttgactcaacggcaatttggaacaccaccctctataaaaaggggagaaccccctttgaaacggtgtttcggtttcggcagttcactttctcagaacaaatctccggaagtgttggcgcccaacttataaaaaaaaaaggaagcaccttgaatttcctgggagtgtcgatcttcgcgagcagaataagggagctcactttccagcacatttggcaaactgctgggacttacccatccccggtcgaacgaagagaccctcctgaagtgtgatctcgtgcaggcaatttttcggcgcgggccgaaaacaacccactgagggggcggtcacaaacgcgtgtgtaacgactgtgtcggacaacggccacactcgtcgtggccctacattatgagaagattggtgggcccaactttctcgtggttaaaaaacgccagaacacgtgttaattagaggtcttgttgagtcgcctgggagaaagcgctggccgtgtgaaaaacactttcctgtgtgcgcgaaggagtcaatcgcccgccttggtatatatttttgcgaacgacgacgcagacggagttcatctcacccttgtattccgaaagtgaaaaggntcccaggttggctacccccgctctagtaatagatcactgtgccgacagacataatcagccgagaagcan

SEQ ID NO: 561245 - DNA, 435 bp, Homo sapiens
cagaggcacaatgaggattaggaccggggaattgcagtcccagttgcagtggctcaaggcttgtaatgccagcaattggggagggcgaggcgggctgatcacttgaagtcaggagttggggaccagcctggccaacatggtgaaactccgtctccactgaaaatacaaaaattagccaggcatggtggtatgtgcctgtaatcccagctaattttttggtattttaagtagagacgggtttcactgtgtaagccaggatggtcttgatctcctgaccttgtgatccgcccgcctcggcctcccaaagtactggaattacaggcgtgagccactgtgcctggccctttttttttctcctaggacagggtctggcgtcaatggcccaggctgcagtccagtagtgtgatcatggctcactgcagcctcaacctccta

SEQ ID NO: 561246 - DNA, 445 bp, Homo sapiens
atgccgctgtagctgctgaacatttgctacattcagtagtcttaagaggctcacaagctggagaggcttagcctgtccaccttcccacccatgtgtggtctggaagaaggtgaccatctcgttcaagaaaaaaagatccttccaaagctgtatttcgcatatcctaataccactgctattgctgccactggccaggcccagatgccgaatgtcctgagcgagtttcggaggaagggagaacaatgtgtctgtccccgcaggagacacgcccgctcatgtccccgccccccgggcccagaaggataaaggccgtgcagtataggggaacatacggttcttctctttgttcaggccaaggccccaatatcggcctgttcggtgactgggctgatgggcacaggctctgccctttgaccctatctttaggctcgtcacattgaggccg

SEQ ID NO: 561247 - DNA, 785 bp, Homo sapiens
  misc_feature (513)..(513): n is a, c, g, or t
ccatgcccctccagaaggacctaggagagtaggtgagctttccaaagtgagagacgaatctttctttcttgttttctttaaaggggcaggatgggtatgcttggggtctttctccttctgtgtgccccggtagggagggagagactagagggcaagggcagaaggtgattgagtaacactgaacgcaggaatcctggaagatcagccctcagcggactggtctcagaagatgctcagtaacgaaatctcggttctcttcggatggaacatgatataattagtcgatactaaaggagctctaagaaatatggctaaggacacgccgttaatgttcgaagctttgaatagaggatctaggagcgatattgttactctttctcaagtcccacacatgtaagacgtcctcgtgtgattgagaatcttcatcgtggggtcaagagggctaagatgtccatcgattgtaggttgagtgaggacttagattgggtaccgagtaagatcgaggctgcctgngcgagggcgggttatcttcttatgccatcatgtgtggctttgctttccagtctggcctgtcctttccagctgccttttggtctgagcctgctagtggaggggccaagagttagtctgtgagtaagagcaggtgattcggggactagctgggtgtggcaggacaggagcggatggatctcttgggacaggttcccccggggtgtataacacaaggagcaggattgtgctggagcaggaaacagtagtgctgttgagttggcaaaaaggctggc

SEQ ID NO: 561248 - DNA, 378 bp, Homo sapiens
ccctgaggatcccttcgattggcggcacttacacgtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggcgctgcctggagggggtgggggggacaacagcgggactgcctaagctgccccgcccccgaccccgcaccgcccccccacccccccccccccccccccaacccccccccaccccccgcccaccccccc

SEQ ID NO: 561249 - DNA, 988 bp, Homo sapiens
  misc_feature (988)..(988): n is a, c, g, or t
ggcggaactagcggcggcctgagcagccatgtcaggctgctatttgtgcggaggcaggacgagcagtgtccggagcccaggatccgtgctggtttctttccaagtgatgaaatcgcagttcaccaaccatggtattcatcatcttccgttctcttcttcagtgccaacatgtaagaaacgttcttcaatatggtggggaaattactgttagtagatccaacacacagtgtaccagacatggcatcgcatgattccaccaaccctaggactcaacctaagtggagcgattcgatctcgtgtcgggggttcccatgcaagcgacgcgaacctaaagggccgatgccacgatagtgaatggacgagacccaacttcgtcgttcccggtgcaaaaacctgctgcctgtttatcccatgacaattggcgccaatgtatcagcttttctacgtctattacagcgcacgccaaggcatgtgctcattgtctttcccgtcttgagtcaatactaagcacttactgaccatgatagaccactttgcatacaggcacgagaatttgtcccaaaagcttagaacttccatctactgtgaggacaccaaaggggcgacatggcacctccctttagggagctggaacttgcccttggaaacgggacaggcactggtaccttatttgcgcatgggcccctttacagcggtgtgcgcgtttggcacgttcaattggcccttgcattagcgccttggttagcacccaatttcgctcctttccacttggagcttcgacgggatcgactgaattcaccactttgttccccacttgccccatgtggcgtcctctagattgccgcaccccaccttggaggcacggcccttctttatactcttaccgcttacccgccgggtggctcttggcctcgtacctttgagggggacacgctttgcttcgattcgccccgagtggccgcctttttggggcttccgcagagtattn

SEQ ID NO: 561250 - DNA, 819 bp, Homo sapiens
gtttccgggagaccttgctgcccgtttttttggagccgcaatgagggcccagtgcacctaggcgtgggatgctctgggcgtgatcttctgcttcaactgcaagagaccccctttccggggtttaagcccatctcctgcctcaagccttcctcgagttcgctgggaacacggtctttgtattcattgatagactttctgtttgttttctgagaacagagtttcagctgtcacccccgagctgtgagatgtctctggggtggaatctcggcgtctacatgcaaacatttgggcatccccgggggtttacaaggagttttctccgcgctctaagcctcccctgaggtatcacctgggagtttatcacggggggctcccgcgcaccaatgcctggcgtaaatttattattttttttgaggacaggaagtctcgcgtcttgtctgcccgcaggcttggaagtgacacagtggtgcggtcttggctcaactgcaaaggtccgcctcccaggttcacgccacttttcctgcctcagcctcctgagtagctgggaactatcacggcgcccgccaccacgcccagctaatttttttgtaatttttagtagagagtggggtttcacctgtgttagccaaagagtggtctcgatctcctcacctcgtgagtccaacccgcctcggcctcctaaagatgctgggattacaggcgtgagtcattgcatccggcgaccttctccctttttgtttaagtgtttgccagaaagtcaccccagcagcagccggtatggtgcctgtacattatggagcttcaaaaaatgtcaaatga

SEQ ID NO: 561251 - DNA, 603 bp, Homo sapiens
  misc_feature (38)..(38): n is a, c, g, or t
  misc_feature (123)..(123): n is a, c, g, or t
  misc_feature (134)..(134): n is a, c, g, or t
gacggacgtgttgcgtcgtgctgttcaagaggatcccnttcagcacatttagtgatagttttaagtggtaagacaccccaccttcagctggtacctgaaagcttaatctcgttataaataatncacggtaattnaggggaagtatgtccggtggctaaaggatcctcaaaccggccatccccaaggaaaatcatgtataagtatggctaaatgagggtcggtatctccttggtttggaaggtggctagatgttggcggtaaactggaaggggagaataatatccttaaagtttacaccccctataagcctaaagccatttaaatggataaacggagagagactattagatttggctctagggtataaaatccattatcggatcatattcctggacctcccccggattccaattaaaggtgcggaatcagcacataaagtatcctaaagactggttccaggtagtccaccaatgatccgggtaagaccaatggctcacatacttacacacgcacacacatagatttcatgggtttaaaaaaaacccaatttggttcctttagaaaatggatggcggggctctccagcatatatccgcaagatct

SEQ ID NO: 561252 - DNA, 436 bp, Homo sapiens
  misc_feature (18)..(18): n is a, c, g, or t
  misc_feature (34)..(34): n is a, c, g, or t
  misc_feature (47)..(47): n is a, c, g, or t
  misc_feature (153)..(153): n is a, c, g, or t
cctttgggagaccagtgnccttgttgttcgcccncattccgtgaggnagatccacctatgatctcaggtcctcagaccaacccagcccaaggaacatcttgccaatttcaaatcggataggagtgtcaggcctctgagtccaagctaagccantcaaatcccctgtgacctgcacgtgaacatccagatgacctgaagcaactgaagatccacaaaagaagtgaaagtagccttaactgatgacattccaccattgtgatttgttcctgccccacgctaactgataccatatattcttcccccgcccttgagaatgtactttgtacacctatcccaaacctataagaactaatgataatcctaccaccctttgctgactctctttttggactcagcccgcctgcacccaggtgaaataaacagccctgttgctcac

SEQ ID NO: 561253 - DNA, 581 bp, Homo sapiens
cagtccttaataagctaggtgtctgaacatgatgatgtagtgttattaaaagacctttaatccgttctacttttcttgaagaaggaggaccgtaagggatataaaggtttcactgaatactaagagcctgaaaaactgcttggttgatttgactaataaaggctggtctgttatcagactgtaaagaggtgggaaggctaaactgaggaatagtgtctgacagaagggaagaaatgactgtggtggccttctcagaccctgtaggaaaggcctttactttattcagtgaaagtgtctatttaagactaagaggtatttaagtttcctgaatcagggcatgttgagtaaaggtaatttgccagtcctgggtggggcaaatcctccagcctgatgtgtagggaagggagggggcctgaataatccctgaggagtagtagaatagcagatggaaccactgaacagttatttccttgaggatagatttccacgatggaacggaaatgcaaggttctgagaggtgggctagtggcttgactatagcataacttgccttgctgtgtgtggcgattaagctggtggac

SEQ ID NO: 561254 - DNA, 442 bp, Homo sapiens
actagtgcaatggtttgggcacagtggctcatgcttgtaatcccagcactttcggaggctggggtgggagcatcgcttgaagccagaagtttgagacaagcctgggcaacatggtgagtccctgtctctatcaaaaaaaaaaaaaaaaatttacccgggcttggtggtgcttgcttacggccccagctccttggaaggtttgcggtgggacttatcatagacctaaggggaaaaaactaacaagcacaagataggttatgttagcccctaggaagttttgaccctaggatttccaggctgcagtgagccatgagttgtactactgcactcgaggtttgggtgacagattgagaccttgtctctggaaaaaaaaaaaaggcccaaaaaacttacatgtgacgggaatttccccgaaccccaacaagaaaaaaaatttttttgc

SEQ ID NO: 561255 - DNA, 772 bp, Homo sapiens
ccaaaggtataccggcatatgacatggatcccccttgggaaccagctgatctctttccagagggcactatccgaccagtgcatgatgatatcctcatcgctcaactgcggcctggccaagaaattgacctgctcatgcactgtgtcacagggccttggccaagatcatgcccagttttcacccagtggccaccaaccccagttacaggctcctgcccagacatccaccctgcttgagcccctggaaggggaggccaactgaggagttgagccggtgcttctcaccctggtgttattgaggtgcacggaagtcccaggtaaaaaggtggcccgagttgcccacccccggctggataccttcagccgagaaatcttcccgggatgagaagctaaagaagcgttgtgaggcttgcccgggttcgagatcacttatatcttctctgttgagtcaacgcggggtgttgcccccaccgatgtgctggtgagtgaagccactccaagtaactgatggggaaagtgcccgcgcttcttggatgaactagactgcggttcagatggactgagcttggatgcttctgaggccacgctgaagctttgggttctgactgacccaccctacaaggactgctgaaccgagagccccgtgtgactagggatcctgagttttctgggaccattccagctttaatccataccttttgttaaatgtgccataaaatgagactttttacgcctttataaggccttagatgtaaataaactcaccccaacca

SEQ ID NO: 561256 - DNA, 338 bp, Homo sapiens
catctaggacctggtaaacgccgtttgaatcaagctgaaaactacagccatcatttcctggcagaggcatcaggccatccatgtcaaattcttggctggaatcattcgcagatgttgctttgtgtcgcgcgaggagaggttagcatggctagcctctctccatgctggctctgggggtggcgggtagatctcccaatcttcgccgtctctaggattgtcatccgggccttgtgaagacagcgcgatatagcggcggcgcaaatcaacaatttttttggatgtttcttgtgatggcgcccactcagtcgtacgtgcggttccgtatcaagaagctattt

SEQ ID NO: 561257 - DNA, 445 bp, Homo sapiens
attcatgtccttatgtaattctctctctttgactgccaatgtgacctgtgactgacttctaaccaacagaatatgatggcagggcgtaatgtctcactcctataatcccagcactttgggaggccgaggcagacagatcacttaaactcaggagttcaggccagttgcaatagctcacatctgtaatctcagcactttgggaggccaaggcaggcagatcacgaggtcaagagatggagaccaccccggccaacctggtgaaaccccatctttactaaaaatacaaaaattagcccggcatggtggtgggcgccagtaatcccagctactcgggaggctgaggtaggagaatagcttgaacccaggaggcagaggttgcagtgagccaagaacgcgctactgcactccaggctggcaacagagcgagactccatctcaaaaaaaa

SEQ ID NO: 561258 - DNA, 415 bp, Homo sapiens
ccttaaaagggggaaggagacagaagaagatgaaggaagaggaggaagaacggaggaggacggacgaggaagaacgagaaggtgggaggaacgaggacggaggaagaggaggacggaagaggagggaggaggagacggacaggaaaagagggaggaagaggaggaagaagaggaggaggaggagagcaaggagaagagggaggacgtggcagtggcagtggcggccatggttgtgatggtggtggtagtggcagtggcagtggcggccgtggtagctgtgatggccgtggtggctgtggcagcaaaagcagtcggtctctccttccccatagggagcatgtccttatgatccgctgcagcaaagccaggtgtgcagactcaggatccgtcttgacttgggtctagtgccctttgg

SEQ ID NO: 561259 - DNA, 710 bp, Homo sapiens
  misc_feature (2)..(2): n is a, c, g, or t
  misc_feature (165)..(165): n is a, c, g, or t
  misc_feature (252)..(252): n is a, c, g, or t
  misc_feature (344)..(344): n is a, c, g, or t
  misc_feature (364)..(364): n is a, c, g, or t
  misc_feature (417)..(417): n is a, c, g, or t
  misc_feature (431)..(431): n is a, c, g, or t
  misc_feature (444)..(444): n is a, c, g, or t
  misc_feature (474)..(474): n is a, c, g, or t
  misc_feature (516)..(516): n is a, c, g, or t
  misc_feature (535)..(535): n is a, c, g, or t
  misc_feature (570)..(570): n is a, c, g, or t
  misc_feature (582)..(582): n is a, c, g, or t
  misc_feature (662)..(662): n is a, c, g, or t
tngggggcggagacccatcaccacgcagcctcgacccgccccctcctccagggctgcagccccgcccagtggctgaagaaagcaaacgccttgcagggcgaaggttcccaggatgcagtaagggggggtggccccaggctggcggggaggtggagtaagggggcnctttccgcggaagggtgagggactatgagaagctggggggcaggcgggcagccgcggtcttctccaccacgaagccgtagtaatacncctcctcaatgtccgccagaaacttgatggtacaggtccccaaaagcagaaaaggccagggggctgcagcccttgccctcaaatcgtgggtngagtgtaaagggaaccccancccatggctgaaatgccataaaggctggaggcctcgtagatggagtaattccnccccagagtggatncccgaaaccccanccttgaccgctgtccgccccaggagcgccnccccttacttggctggctggctgcatccagagagaggccctncatgtcccggctgagaccncggggcttgggcactggcctcggggccttggcctncttgcaccaganggcaaacccgcccatgtcccctatccgaaggtatccaggcactgtcttggtctccccactcaccgggacatcaaacacanccgtgtccgtcgctcccaggggcaacaccctcacacacatgcgtctct

SEQ ID NO: 561260 - DNA, 443 bp, Homo sapiens
  misc_feature (85)..(85): n is a, c, g, or t
  misc_feature (166)..(166): n is a, c, g, or t
  misc_feature (377)..(377): n is a, c, g, or t
  misc_feature (415)..(415): n is a, c, g, or t
attcgcggccgcgtcgacgtgaaaattgttttctgaaactctgtttgtcaaataactctctggagagaaagttcagagggtgagngcctgccaaagctgaccagcagcacacaggccaaatcgttctttcgtcattgtcctggtcacttccccacccctgttcgcnacccccaaacaccttttttcttctctctctctctctctgtgtgtgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtctcagatttatntacctgatctcctcatctgttttccactggaagccttntgctcgcgtcacccttcttcatttgtcg

SEQ ID NO: 561261 - DNA, 190 bp, Homo sapiens
agtcgccgaacggcgggactcagctgtgccagctcgagcaccgtctcgcgcgggatcagcaggcagaaggtgtcctgcgtggcatggtaggtggcggtgaccgcccgctgccccagcagggcaccgaccggaaagacgtcgcccgcctcgtactggaagccggcagccgccatttccgccaggccggtta

SEQ ID NO: 561262 - DNA, 396 bp, Homo sapiens
tggctattctgggtcttttgtggtaccatatgaattttacatatattttacaaaatttatattaagtatttcactggcttctgagaccagctcggctgtggagaccctaacccagtggcgctagaggaattaaagacacacacacacaaatacagaggtgtgaagtgaggaatcgggtgcccagccttcagagctgagagccctgaacagagatttacccacatatttattaacagcaaaccagtcattagcattgtttctatagatattaaattaaccaaaagtatctcttatgggaaacgaagggataggacgaattaattgaataggttgggctagttaactgcagcaggaacactcccttaagacagatggctcaggcttctgtttgtgtct

SEQ ID NO: 561263 - DNA, 146 bp, Homo sapiens
  misc_feature (3)..(3): n is a, c, g, or t
tgncaggagggggtggctgggaggctcttcctccaagagcaggtgcagcacatatcaacaggcagagaagaccctcaatccaagaggtaggggcaggtcaggtggagtgctgcctccttcccctggtgcccacacaaagctccaag

SEQ ID NO: 561264 - DNA, 698 bp, Homo sapiens
ttttttggtaacccaatggtgtgattatttctggggaaaaaattattaaaaacggaggcctttatcccaataaaagggaaaaataccaagacggcaaataaacccgcgggttcacaggcttattcaaccacttcttatactcaggggccatttgttggttcacggtgttatccgagggctgcggaattacatatggcagactatttgcgcagtgttaaatacatcccgaaatccagttcggcccaatggttgcggccattcctataacatttgctgaaatataatatcactctacgaaatatacgtgttattattctaacaaactctttacagtctcgcacaagtgttctataggatcaaacccccaattttttcctatcaccatattatatgttccagccaagagtgaagtgtgggatcattctgttcttgccataaaatgtcccccatctataatatctttctttccgacaacacatcagtgggctctcgttcctgggcgtgttggggacattatgagcgtgccaaagaataaacctcccgcctaaaaaaaattcttaccctgtggggttttccccccccaagagaagaactctttcgttgaagcaaaaactaccatcttttaaccacgactttccccaggggcgttcttctaccaaagcgcggaagaataatctccctaacaacgttgctccgga

SEQ ID NO: 561265 - DNA, 339 bp, Homo sapiens
ttgtcatgaaatgtcccggtgtatatgcacagggatggaggttgtgcccatatacacgttaaccaaatagctctttctctatctcttatccccttatcgatatgagatttattgagctccacattgtagtatctaagttacaggatatcatggagaagagtcaacatcacccaagtgcactccttctctgggcgaaagggctagtgcgcttttggttttacataggatacttgtatcttgttaggtgcgaagcacaacctcattattatatccacttggagattaggaatggtttacagatatgtatttgggtgccaaattgacaaaaggtggacttgt

SEQ ID NO: 561266 - DNA, 339 bp, Homo sapiens
tccaagagcgagatgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggccccaaaggcctggcttttgctgagatccaggcccgtcagcatctccgctttggaaa

SEQ ID NO: 561267 - DNA, 165 bp, Homo sapiens
gtagagatagagcgcggctctgagtgctgtctgccgtgatttctgttgtccccagagctttgctgcgtgtgaggagacccagcccaggcgcactactcctcgcagtcctgcagccctctgaaaccccctccctgtgccctgcccctcctggtcgctaaaccctcg

SEQ ID NO: 561268 - DNA, 381 bp, Homo sapiens
gctcttcaacccttagtaaacataagagacttcatactggagagaaaccctacaaatgtgaagaatgtggcaaagcttataaatgctcttcaagccttactagacataagagaattcatactggagagaaaccctacaaatgtgaagaatgtggcaaagctttttactgttcctcacaccttactagacataagagaattcatactggagagaaaccctacaaatttgaagaatgtggcaaagcttataactggtcttcaacctttgctaaacatgagaaatcatgctggaaagaaacccgacaaacatgaagaatgtggcaaagccttcaaccagtacttaactcttactaaataagaattcatttggaaaataaaccct

SEQ ID NO: 561269 - DNA, 219 bp, Homo sapiens
aatcgagccggcccagttcacagctcagatcaaagatacagggattaacttaatcttatcagtcttactatgtagagtccttcaacttcaccaaaagtccagagacattgatttaattatgcatttgatttatactacagttcaatgacaacagcttgcattattattgattactgaaaacgttttatgttttcttgcatttttcagctttgtaactgg

SEQ ID NO: 561270 - DNA, 497 bp, Homo sapiens
  misc_feature (50)..(50): n is a, c, g, or t
  misc_feature (428)..(428): n is a, c, g, or t
  misc_feature (433)..(433): n is a, c, g, or t
  misc_feature (439)..(439): n is a, c, g, or t
  misc_feature (441)..(441): n is a, c, g, or t
  misc_feature (447)..(447): n is a, c, g, or t
atggctcgctgcctgttcggtatgaaacctgtcatgactgggaacccctngtcgccttctctggatttgggggtctcgtggtcacctcaggctgggcacgtgcaggtcctgctcctgggttggaccgggctgtgccactgtggcgagctaggatgttgttgcttttcgcacagaacacgtgcctgtgacctagtcctgtcctctgaggacacagaccaagcctccccttcccaagcacctcccgtcaggccccctgtgagctgggcagggcttgcgccagtgggtgccgggcactgcgctgcgtcagtccactgggcaggagcagcagaggagatctatgttttatctgtaagtcacttagggagcaaacagagagctgagcaaagatggattgctatggaaactcttagaagcatcctgccgagggnatccngaaggntnctggangagtggcactaaaagcggcttggaagtatggagcttcgaggtgagtagct

SEQ ID NO: 561271 - DNA, 548 bp, Homo sapiens
  misc_feature (479)..(479): n is a, c, g, or t
  misc_feature (484)..(484): n is a, c, g, or t
  misc_feature (490)..(490): n is a, c, g, or t
  misc_feature (492)..(492): n is a, c, g, or t
  misc_feature (498)..(498): n is a, c, g, or t
gacagctggccccgccagtggcattggctgctgctaatggccgtgggtcaggagtcacggacattggacttgggaggacctcagaggtcagacgggctgtccctcccttctctggatttgggggtctcgtggtcacctcaggctgggcacgtgcaggtcctgctcctgggttggaccgggctgtgccactgtggcgagctaggatgttgttgcttttcgcacagaacacgtgcctgtgacctagtcctgtcctctgaggacacagaccaagcctccccttcccaagcacctcccgtcaggccccctgtgagctgggcagggcttgcgccagtgggtgccgggcactgcgctgcgtcagtccactgggcaggagcagcagaggagatctatgttttatctgtaagtcacttagggagcaaacagagagctgagcaaagatggattgctatggaaactcttagaagcatcctgccgagggnatccngaaggntnctggangagtggcactaaaagcggcttggaagtatggagcttcgaggtgagtagct

SEQ ID NO: 561272 - DNA, 847 bp, Homo sapiens
ccacgcgtccggataaggggaagagcagctcatcttctggccccctctaaagaggccagaggaggagtatagtaggacagaagatagacaagtatgtcatagaggcaggtcgacacacggagacggcaaaggacgatcgtcggcagactaggactacacaagtccgcagaacgccttaggcaccaggaacagcaggtgtacgaggtaagaactggggcccactgagacgagagcactgcgattcagaagagtgcaggacgtgggcttgcgctacagaaatgcacgagggcatcagcatacaaaatgcagcgagacagcttgggactaacgcacattgaaaggagcacgcttgggacctctactacaatgaggcgaacctccacctcagtgcgcctgcccttcccaagacttaaaacccgcacacaaaagtgagtctcacgacaagcacaagccaggaaacaagagatgcaagcacacacgcagcgccgacgggcacaggcgacaagaacgagctcaagacatggtgctgcacaggaccaagatgcgaacctcaccaaccgcgccgcactacacgaggcaaaaacgacgcatgctggttacaccaagagataagacgaagaaaaacgcacgacataggggacaccataacacaccttgcgcactccaactagccaattacgcccaagatcagacagcatcgatacgccccaccgtaacggcagatgcatccggcccgcccacacacggacacagagacataccacaccaacaaacagagatcaacgcgaaccaaccaaacagaggaaccgcaaccgatacaacactggcacacaacaagacgacagtg

SEQ ID NO: 561273 - DNA, 136 bp, Homo sapiens
aagaaacaacttcttcactcctgcactgtgattgccaccaacattctcttggttgatgagatcatgcgagcttgaatttctctctaaaggttgattaagcgtcctctctatctaatcttgacgacttcaaagtgag

SEQ ID NO: 561274 - DNA, 339 bp, Homo sapiens
agctttaaagttcctggcatcatcaaatgatctctggtcacctgctaagaaaagaatgatcggcttgttagagcctatagccagaactcagaaaatattcaaatgcacttatgctctcatactatggccattgcgttgcctctgatactgtctgaattgaataaaaacatcttgatgtgggctggcctagaaactggcgtctgctatggcgtaatctgaaaaggcgtacttcactgctaaatgatcatgacgcttgcttgtgaaacttgatgatacatcttcatttgtcaaataggaatcctaccttctaattcaataaaattcactgcaggatccacc

SEQ ID NO: 561275 - DNA, 353 bp, Homo sapiens
tttgagacagagtttcgttctattgcccaggctggagtgcagtggcgcggtcctggcttactgcaacctctgcctcctgggttcaagagattctcctgccttagcctcccaagtagctgggattacaggcacatgccaccgcgcccggttaatttttgtatttttagtagagacagggtttcaccatgttggccaggctggtctcgaactcctgacctcaggtgatccgcctgcctcggcctcccaaagtgctgggattacaggcttgagccaccgcgcccagcctgaaattcttataaaaccacaaataccccgagacttctttgtcttccataacgtagcccagtcgacgc

SEQ ID NO: 561276 - DNA, 895 bp, Homo sapiens
gtgaaatatctatacaataagaaccacaaaacactaatgaaagaaattgaaaaggtccacaaaccaatagaaagatattccatgctcatggattagaagaattaatattgttaaaatgaccatcctacccaaagtgatctacaggttcattttaatccctactaaaataccaatgacaatcctcacagaaatagaaaaaggaatgctaaaatttgtatggaaccacaaaagaccctgaataaccaaagcaatcctgagcaaaaagaacataactgaaagcatcacactatctgactttaaattattctacaaagttataataatcaaatcagcatggtattggtataaaaacgaacacagagaccaatggaacagaataaagaacccagaaacaaatccatgtgttaaatatttagagtcaactgatttttggcaaaggtgtcaagcacaaacactggggaaataacaccctgtttgataaatgatgctgggaaaactggacattcatatgacaacggaatgaaattagacccctatctctctccatatacaaaaatcaatccaaatggatttaaagacttaaatgtaagaccctggaattataaaaatactagagaaaaacataggggaaaacactccaggaccattggcctaggcaaaaattttattgccctgcgggctctaaaaattacagacaacaaaagcaaaaaatagaacaaataggaccatactagagttaaaaagcttctaacatgataaaggaaggccaatcaagagagcaaacaagctatgaatgagagaagatatccgccagctaaaccatttgggaggtgtcaatttccagaggcctacaagtaacccaaaaagtcagtggcgaagacttaacatccatcag

SEQ ID NO: 561277 - DNA, 520 bp, Homo sapiens
ttgaggatgtggctgtgtgcttcacccagaatgaatgggccagcctgcaccctacgcagagggccctatacagggaggtgatgctggagaattatgcaaatgtgacttccttgtcagcatttccattccccaaaccttttctgatattccagctggagcatggtgaggcagcatggggcccagatccctggacacttgctgggggagaggccctgagaggcatgtgcacaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagca

SEQ ID NO: 561278 - DNA, 148 bp, Homo sapiens
ctcagctgggcaaggtggggtcagctggacaaggggggagctggacaagggagggctcagtggacaagggtggggcgggggggaatgcgaggaacattttattacacctcctgattttcactccttgagttttattttccccaccttg

SEQ ID NO: 561279 - DNA, 173 bp, Homo sapiens
  misc_feature (1)..(1): n is a, c, g, or t
ntgagggcactagaataccactgaaatagatacaccgcaccctggcatgcggccaggcagggggatagtgtggctgaagccctagtatggctcacatttcctaggctctcagttctgagaagacatacttacctgaaagtccacacagcattacttacccccaggcagctgta

SEQ ID NO: 561280 - DNA, 99 bp, Homo sapiens
catggacacacatgacacattgtgacataaccacactgtcaaatggacatgacacactggagacatcaccacattgacacacctgtctgggtacctgat

SEQ ID NO: 561281 - DNA, 145 bp, Homo sapiens
tggtgaccacacgcttcagcacaagtgatctcacgggcatgcggagcctcccggggaatcacggtgttgccgggatgcagccacccagagcctgtacagcatgacatccccatccttgaggtaagcaaaggccatggccggctaa

SEQ ID NO: 561282 - DNA, 470 bp, Homo sapiens
  misc_feature (67)..(67): n is a, c, g, or t
gatctagaggatctgcctgggtgcatgcatgtgtaggttgttatttaggtagactcatgtcacaggnatttgtgtacagattatttatcacccaggtactaagcctagtactacatgtttatgcttcctgcttctctcccttcttaaaaatttttcgggtaggccccagtgtctgtttttccccccctagagtccatgtgttcttatcatttagttcccacttacaagtgagaatatgcagtatttggttttctgttcctgcattagtttgctaaggataatggcctccaattccatccatggtcctgcaaagaacatggtctcattcttttatatggctacatagtatggcatgatgtatatgtaccaaattttctttattcaatctgccattgatgggcatttagattgattctatgtctttgctatcgtgaatagtgttacgataaacatacacaagcatgtgtctt

SEQ ID NO: 561283 - DNA, 720 bp, Homo sapiens
tccattcaacaagtgttaattgagccatctactacatgccaaacactattctaaaaccctgggaaaggaggggtaagggaacctgtggacctgctcccagctgttactctgtctcccaaaagtgaggctctgcagggaaacagggtctgggggctccctccttgccgtgggacaggaaaggctgagtgttataaaaagggtggaagccctctaaaaatgagaaggctggctgtgtggagactcattgcgtggtgcctctcccagacagaaggagagggcccagaggaggcagctcccgtggagcagagacggcacgcagagaagcgccctgtgcccggctatcactctcccttcttacagcaccgagattatgcagagatctttcttgaagggcgcccgatctggcaatgtggggctgtaccacatctaccccaggaaagaaggcaggcttagagtactgtgggtacaaagagccccgcaaatgtcgactggtaccagggcggctctggaaggggtacaagggggaaaggccggaatgcccaccccggaccggggcccggaaggctattcagccctccgcaaggaggcctcatcttgccgcgctccggtacaggcataacacaggcccaacggccacgtgtcaacgcgtaatacccaaggaaagaccccaaccgtgcgccgaaaacgggtggcgcccaggggaagcctccaagccatgaa

SEQ ID NO: 561284 - DNA, 803 bp, Homo sapiens
cagctgtttcctgtgactttaaccttaccttccccagacaattgagctgaacctgtatctgcgacctctgactatgtgaagatacggtgggaagatgactgaccgcaagacaggaagagagccctcaccgaggaaccaaattggccagtatcttgattttggatttctcaacctcaagaaccatgagaaatgaatgtctgctgttcaagccacccagtcaatgtccatgagagcaagcatctttgtccgtttggctcactgttggattccctgttttaaaaatatcacccggcccagcaaaaagtttggaaaccttcatctagaaagtggtctagcaaagtgtggtccatggatgagtttgatctgcaaactgcttgttattggttcatgacaaggtctaccaattgcattttgagagctcagataagcagagagcaatgcaatttgtcacagaaggatgattatgtatatgcactgtcatgtctatttccatgcctaactcaaaggagacacaaggagaaagtgagctcagcctggataaattggagattgtgatgacttctaggaagcctcaggaacagagaaacaaagacaacactggcctgctgctctctgcaatggtgggacccttgtgggataactgttttaggaatgaaggtgtctaccctctctagaaatgaaaatgcaagttaggctgtggttaagtattggatggaggcaaaaagaaactgacatatttcttctttcaattgtttgattcagcctgaagggcatggctgctttaattatatctccagagcata

SEQ ID NO: 561285 - DNA, 459 bp, Homo sapiens
gacgagtgaggttaatgagatccagctattgtggattactaaaccatctcccacagcttattagctacataaataatagcaagattcttaacttgatagaaccctaatctccttatgcatggagagaggataccacaggcacttctgggagccttgtctcatagattacatagagttggtgaaatttaactgcctagacatcccgtaggaattttatacatgctaggttctttctgctgtctcccaacattattaggaaagtggctatcattaaaaagtaccaataaggctagatagaacaatagacctaatgcaatcatgaactccctctcgtatataagagcactttggatgtgtcataatgtaagattaaacaatgcgtaattttatcctatccagttacctaatgtgaattaaatcattcagatgagtcttcaaatgccgatcaaaaatacttgc

SEQ ID NO: 561286 - DNA, 711 bp, Homo sapiens
ggacacgtgaaggtcggtgcggagtcgtctctgcaagcttggtcgccctgggatgtgattcctcctcctcttcctccgcggcgggtttgggtgcagtggacccgcagttgcagtattttttcgaggtagagactcaaaagcagcgcttccagcagctggtgcaccagatgactgaacttgtgtggggagacagtgcatggacaagcctgggccaaaagtgtggaccagtcgggctgaggcctgtttgtgtgaactgcgttgagcgcttcatgtgatcacaagccagttcatcttgaatcgacttggaacagaccccagaaaatccaagccagtttttctcagaaaggcctttctgactggatctcagcatttacctctttgtggaaaagggacaggtagtctcaagaacatgaacgagctgttgatgggatgatggaagaaaccagttatgagaggatgtggtcccatctttgtgtactcttggggaccatcctgtcactctgagacattgaacaaagaccaatttttgtgtgtgaagcttaagggtcatatgttgtgctggtatttttaatgcaatcttgtgacaaatatttgacagggaaagaaaactctattagatgctattactgtacatggactatgctttttcaaggccattagtgttctatattttgataggtggaccaatagtaaattaaaaaaaatacaacc

SEQ ID NO: 561287 - DNA, 111 bp, Homo sapiens
accttaggcatacctggacctgttccttcggctgggaagtcataggttagggagcacctcacactttcctcagtgagaagacacacgaagcctgaccctcagcctgtggga

SEQ ID NO: 561288 - DNA, 550 bp, Homo sapiens
ttggggctcattcagggtgggtggggtgcttggtaagggcggtcgggctttcacttctgtgttttggagctgatgggccagccagtccaggccttcgtacagcccgtccccgtgggtggcacaggtggcctgaatgtaccagttacggtgacgaagggaatgcaggcccagctggtctgtgatctcagcagggttcatagcattaggcagatccggttggttggcaaagacaaggagtacagcatcccggagctcgtcctccgccagcattctcatcagctcttcccgggcctcatttagtcgctcccgatcatggatgtcgaccacaaatatcaaggcctggggtgtccgggaagtcgtgtctccagaggggtcgaatctggtcctgtggccacccaaatcccacagggtaaagctgatgttcttatactccacggtctccagattgaacccaagtggcagggatgggggggacgatctcccccagtttcagcttgcataggagggtggcctttcctgcgggttccaggcccaccatcaggatgcgcat

SEQ ID NO: 561289 - DNA, 266 bp, Homo sapiens
  misc_feature (78)..(78): n is a, c, g, or t
  misc_feature (266)..(266): n is a, c, g, or t
cagatgcaattgtggcaagtgacctgccaataaagctactgcagctattgaagctggcataggtatatccttagaggngctttctccctgggctagtctttctgttggtattttccccctatattcagagctccttgagaagtgataaacaccttcagctttctaacatccttcccacaccatctcaccatatccatctcccagcatccatctgcattcagctaagggcgggaaactgacctagtgcctgtgttgcagaccatttn

SEQ ID NO: 561290 - DNA, 551 bp, Homo sapiens
cttaccgtttcccccacttttagggaggtgtccacccagcccgttacctaaaaggcgtaaaaagggcgaaacccccaacggcatcctccggggggttgggcgtgtttatttttttttttggcggtcaggtttttcggtttattaagtgggccgtgagtgctcccccaataaagtgagttagatttctcctttgccctccccggggcttgtgtttaactttcggcgtcgcatttttttggaaatggggctgaaccccatttcctccgggaaccgtatttgactattattttccccagctcaacatttatcccccctttaaggaaaagaagcgagaactcccccccggggggggcccctcaagaaaaagtggatccgcgcgggccccaggttaaaggtcctgcatttccctgggtttttgcccttcttttccccttcctcctttttctataaatggggggcagcttcccccctcttttttgtaaaagtccccccccagggggggggatccattttttagccaagccccgacaaaaatcatactttacccaaat

SEQ ID NO: 561291 - DNA, 744 bp, Homo sapiens
cgggaacgcgtgggtcgacccacgcgtctgccagtgcgtcctgggcggccccaaggagggagtggaatggccgcggcggttctgacgcagcagaggcgacgcgagatggtggagcttcagcggcgaggatctacagtgagctggtcgctgtcggataagcacgattggagctactcgtcgtccacctccaagctcgcggtaagggtggctgtgcgacttggggccatttgtgcggattggaaccagctgggagcaaagttgatcccccctgtgttgcggggccatggcacaagctgctctctagagattgctaacttggagggaaccaccaggagaagtctcaaaataccagttttggatgcctatctatggggagaggagtactcagcaggacaattctatgcaagggttcagtgcagcccatccataaaggcactttgcctgtaaagggcacgaattgccagtgttgctatgcctatgggaacccaaatggatgctgggaaaggaccgcaccacaaattgcttgggcatgcccaagagcaacctggggtgatcccccgcgggctctcatggaccctccttgcaagctcacaaggcgagggagggtgcccgagggccgccatgggcccttttctgtcaccatgtcttacctagagatctaccaggagaagggtataagacctcctggagccttgcttccggaagactggtaatccggaaaattgccggggaatatcctgattc

SEQ ID NO: 561292 - DNA, 678 bp, Homo sapiens
  misc_feature (22)..(22): n is a, c, g, or t
  misc_feature (64)..(64): n is a, c, g, or t
  misc_feature (82)..(82): n is a, c, g, or t
  misc_feature (96)..(96): n is a, c, g, or t
  misc_feature (122)..(122): n is a, c, g, or t
  misc_feature (129)..(129): n is a, c, g, or t
  misc_feature (132)..(132): n is a, c, g, or t
  misc_feature (155)..(155): n is a, c, g, or t
  misc_feature (164)..(164): n is a, c, g, or t
  misc_feature (189)..(189): n is a, c, g, or t
  misc_feature (237)..(237): n is a, c, g, or t
  misc_feature (241)..(241): n is a, c, g, or t
  misc_feature (249)..(249): n is a, c, g, or t
  misc_feature (259)..(260): n is a, c, g, or t
  misc_feature (262)..(262): n is a, c, g, or t
  misc_feature (266)..(267): n is a, c, g, or t
  misc_feature (276)..(276): n is a, c, g, or t
  misc_feature (289)..(289): n is a, c, g, or t
  misc_feature (296)..(296): n is a, c, g, or t
  misc_feature (312)..(312): n is a, c, g, or t
  misc_feature (338)..(338): n is a, c, g, or t
  misc_feature (454)..(454): n is a, c, g, or t
  misc_feature (490)..(490): n is a, c, g, or t
  misc_feature (499)..(499): n is a, c, g, or t
  misc_feature (584)..(584): n is a, c, g, or t
  misc_feature (660)..(660): n is a, c, g, or t
tgaagtggggtggcttttaggntggcaagggacttcctgtgacaacgcgtctcatagttgtggnatgactatcaaaaaaacnacaatgtgcaatcnaagtcctcgggcacattgtgaacttnggggggngcncgcgtgccaaccggcgtgctgtnaccttcacngttccagtttttaaatcctgagtcnagccaaaaaaaaaaaaaaaaaccaaaacaaaacaaaaaaaacaaatanggcngggggggngtgcgggcgnngntttnngcgcaagtnaggttttgtcaanaaagggngtaacgcaactaagtnatagtccgcctagaagcatttgcggnggacgatggaggggccggactcgtcatactcctgcttgctgatccacatctgctggaaggtggacagcgaggccaggatggagccgccgatccacacggagtacttgcgctcaggnggagcaatgatcttgatcttcattgtgctgggtgcnagggcagtnatctccttctgcatcctgtcggcaatgccagggtacatggtggtgccgccagaaagcactgtgttggcgtacaggtctttgcggntgtccacgtcacacttcatgatggagttgaaggtagtttcgtggatgccacaggactccatgcccaggaaggaggntggaagagtgcctcaggg

SEQ ID NO: 561293 - DNA, 183 bp, Homo sapiens
gactacaggcatccaccaccataccctgctaattttttttatttttagtagagatggcggttcgccatattggccaggctgttcttgaacgcctaggcctcaggagatctgtgtgccatatgatctatatacattgatttcttcctgacggactctgtcaaggatgaggatttgaagattatg

SEQ ID NO: 561294 - DNA, 315 bp, Homo sapiens
gtacccctgaaactccacttattatatgtgctacggcgggggtgaaatataacatttttaaaatgtattaagctcctactgtgtgctactcttattcactcaggtccgaccccttagtcctttaactacctggggcttccttttcttttctttcttttcttgtagcagtggaggaaaatgaggctggttaagtgaagtgagctctgagaccttgtgtgactttgtttccattgtatccatttgcattaagtgcagtgagctttggcgcaaaccaccctctgccccgtctgttggacccccccattcatcacaata

SEQ ID NO: 561295 - DNA, 154 bp, Homo sapiens
acttacaagtagactttctatttcagacgtttcatgttgtatattgtcggtgtctatacacacacgcctatataccattcctcgtttatggcacactgcgatgtacaaagcagtttcacatgtggagcgttctgggaggtctagagagggctac

SEQ ID NO: 561296 - DNA, 182 bp, Homo sapiens
gtgcacgatccttatccgtctgatagtctgtgagatctagttggtttactggtgttagcactatttccttacttatttatcctgtctgggttgtatctatcgcattatatgacgagggggtactggaagtctaccaggtattactgtatagaaatgtctacttctcccttcagttctgtcag

SEQ ID NO: 561297 - DNA, 89 bp, Homo sapiens
gggtcgacacggccgtgtattactgtactagaggtctccctctgggtggtgggtactggggccagggaaccctggtcaccgtctcctca

SEQ ID NO: 561298 - DNA, 369 bp, Homo sapiens
  misc_feature (369)..(369): n is a, c, g, or t
agctggccctacaggtgcgtgctaccacgcctggccaattttttaaattttagcacagatgaggtctcactatgttgcccggtctggtctcgaactcctgagctcaagggatcctcccgcctcagcctcacaaagtgctggtgtcacaggcataagccaccacgcctggcctgtgttgctattatatgcggcaggaacccagagtccagaacatttcatctatgatggggtagataatgtgtctagacgtatgcatgccaatttcagtagcctcagatattcaacctaggagatttttctacctctctactaccctgctgaagttgctcttcagcagaatatctatgaggtacacattccacactccgn

SEQ ID NO: 561299 - DNA, 825 bp, Homo sapiens
aattgcttaaacctgggaggtggaggctgcagtgagccaagatcgtgccactgcactccagcctgagtgacagagcaagactccgtcaaaaaaaaaaaaaaaaaaaaaaattgatttctggcccccccttaacattggagccccattcccttttcccatccggcccgaaattagggaggatggactgtgtcagggaatggcggggtggccttcttctcgcttgccagggccctttgtcagagcagccaggcttggacagacgggcctcccttccctcctccaatccttgaccgggcaccttgcctgcttcggggctttaggccaccgttcccttgtccccaagaggagatagccccagatggcacttggattgttgtggcttgagagcgcttgtgtgcgatggccccgctgtggtggttccccttcttcttgttcccttccattcgtgtattgttgtttctggtgttccctttgcattgttgttgcgttgttatagagttgagcgcgttattgcattcaactcattggggctctgggcttgcttcacagggcaaatttgtgactttggaaagacttttcattctccttggaaccaagaatttccgtgagttcccccttcacccttgggcccgtgtcccaccagggtatatctgcggctataggggaatggaaaccttggggggaagtgacctttttaacacgacgacacttattaagtttcctactacttgcactactgtccatttgtgcgattgcattaaccctgtgctatttacctggttgaacaacaacaagaaacacaacactttctatcacaacacaaaa

SEQ ID NO: 561300 - DNA, 867 bp, Homo sapiens
taccacaatgcagtgcggctgagcgcctcggagcccgtggggacgctgcggggggacccgtgctgaggcagtgcgtgctggcgacgtggagctgcgtgcgggcccgcggctgtcgggcggtgcggatgtcagggctgggcggacgaccgcggaaggcagagggcgacgcggcgcatctacgtggggaaccttccgaccgacggtgcgcgagcaaggactctggaggacctgttctacaagtacggcctgcatccgacgagatcgagctcaagaaccgggacacggagctcgtgccattccgacattcgtgcgcttacgaggaccccccgagatgccacgagtgatgctaatttatggcaacggacaacattggttatgattattgtgccaagtgtcagagctctcagatgatgagagtttccccaagggaactttagtgagagagtcagagagagtagagagttgagcacccgaggatagagtagagaacggagaaattggaggcactcacatacgaagacacgacatcttgactttcacacgacagtacattgataacacaaggaccttagcatacccggacaaggggccatgattgtggcaggtgacccatgaaaggcgaattcaacattgatcgagaacaggttggagggaatggtcttggtcattggctcgatttgtgtgacgacaaggcataggaaaatagagggaataggtccagaagtatctccaagaaacaaagaaagagccattgggaattattcgaccgctgtgtgtcaaagatgggatgacagacaaaatttcgcggtactcaatgaagaggtgaaaagttacataaaataccagaagttaattcctgaggcagaa

SEQ ID NO: 561301 - DNA, 400 bp, Homo sapiens
atggagtgatccgaggattcggtcgctcggacacagcagtagtgttcatgaatcttatgtgagggcaaagagacccctgcgaaacggggacaatttgacctcctcttttcctaagttgaatacactgtatttctttatcctgcctgatagccctggccagaacttccaaccctatgttgaataggagtgatgagagagggcatccctgtttgtgcccattttcaaagggaatccttccagtttttgcccattcagtatgatattggctgtgcgtttgtaacgaatagctcttattatttttagatatgtcgcatcaatacctaattcattgagagctttttagcgtgaagggctgttgaattttgtcgaaggccttttctgcggtgtattcagataatca

SEQ ID NO: 561302 - DNA, 177 bp, Homo sapiens
ctcttaggtgagctgttgctgtgtcgtgcacagtctccaggtgtcgtctgagaattcgaggacgtggtgctgtgggtgctgcgagtccccggggacgtgcaaggcgctgcaggtaagtggccgcctacaattatgtccagtgacagttgtccacgggacagggattgccttctattc

SEQ ID NO: 561303 - DNA, 439 bp, Homo sapiens
  misc_feature (5)..(5): n is a, c, g, or t
  misc_feature (12)..(12): n is a, c, g, or t
  misc_feature (63)..(63): n is a, c, g, or t
  misc_feature (434)..(435): n is a, c, g, or t
gttgnaacgggnataaacaatttccacaacggggaaaaacagcctatgaacatgaattaccgnaatttaaatacggacctcacctaataggggaaatttgggccctcgaggccccaagaaattcgggcacgaagctgcctcactgcaacctcagcctcctgagtagctaggattacaggcgtgtgcaccatgcctggctaatttttgtatttttagtagagatggggtttcaccatgttggtctggctgctctcgaactcctgaccttgtgatccgcccaccttggcctcccagagtgctgggattacagacatgagccactgcactcagccacttaaggcttttaaaaaatcaattaatttctaaatggttttggacttttgactccttataagtgttaagatattttggtatcacttttttccttccaaaannaaaa

SEQ ID NO: 561304 - DNA, 212 bp, Homo sapiens
aaataaacaggcatgtttatgaaagaaccttttgaaaaatgaagtattaaaacccgttgtaataacaagatatacttttgaaagtggttttggcccccaaatagcaatgatcagtgatacagaataaagaatattaatacagtttggggattgttttgtgtttccagctgcctaattttgaaaaaatataaatatatatcttttccccctta

SEQ ID NO: 561305 - DNA, 470 bp, Homo sapiens
aggcgagtcttgacatccccacgtcgactatacttatttcccacagcctgttctaggcttaacctgcggggggaaaatcagatacagcttggcgaacgatcttcataaatacaattatgatacgttgaattgagtacctgattactagattgtcagagcatccttaaaagggagtcctgaacacaatctttcctcaagagaatacctaaagatcataaatacgtgcctcactgactgaaggaatagactatatcaccctgtgtgccaagacctgttgatgaatgatcgggtcacccctgcggttgttagctgcgaatccaacaattcacaagtgtatttaaagcggactatgaaagttaccgtggatgcatcctataggctattccataacagatgccgaacttaggaccccttttccattgcctttcaatacttaaccatatatagattttatgcatccacccactttc

SEQ ID NO: 561306 - DNA, 394 bp, Homo sapiens
  misc_feature (389)..(390): n is a, c, g, or t
tctctctgtaccccagctggagtacagtggcacagtatcacagctagctgcggcatcaaattccagggctcatgccatccttccaccggacatgtagccgtgcacctcctgagtagctgggactgcagatgagctctgccacaccgggctacttatcgtattgccttagtagagacagggttttgccatgttggacagtctggtctggaacacctgacctccggtgatccgcccaccttggcctcccagagtgctgggattacagacatgagccactgcactcagccacttaaggcttttaaaaaatcaattaatttctaaatggttttggacttttgactccttataagtgttaagatattttggtatcacttttttccttccaaaannaaaa

SEQ ID NO: 561307 - DNA, 201 bp, Homo sapiens
agcaggggtggcgtggtgttcctgttgtggctcagtgtgtaatgaatcagactaggatccatgagggtgcaggttcaatccctggcccctctcattgggttaaggattgggcgttgatgtgagctgtggtgtaggtcacagatatggcttggatctggtgttgttggggctgtgatgtctgctgtgagctgtagctccact

SEQ ID NO: 561308 - DNA, 341 bp, Homo sapiens
cccgactagccgacaggagaagaaaactagagatcaggaaattagatgaatgaaataaggatgccaaaaaagaaagtgataaaattaaaagaaataatgtgtctggcagagagtggctagtgagatcacagctactgctctcacaagagggcgagttcacgtctcctacctgttcactcacctctggcacccatttaactttaagttgtatggtggccgggcgcggtggctcatgccctaactccagcactttgggaggccaaggccggtggatcacccgagtccaggagttccagaccagcctggccattatggtggagccctgtcgggctagtcggggg

SEQ ID NO: 561309 - DNA, 427 bp, Homo sapiens
ggcaaacattgtcttatgaaaacaaaatgaaacaaaattaaagtaacattgaagatcaaaatagtctggaagcacaggatatctgacaagaatcttcaagaaaagcaatgtttgaaaagtgaaagatgatctttggaggacaatagctaaatatccagagtattttatcttcaatctcatttaatttgtcatcatttgtggtgcataagacaatgtttcagatatgtaatggggcaaacactatagataatctgtggatagaaaacgtgacaatgttactaataagtttaaattgacccttcgttgatatcagtactgttgatacatttattagaatgtatgtctcagaagatggttactgtaacaaatttatggtcaagttacaaacaacgtgaattctacatcatggctcaccacaacctccaca

SEQ ID NO: 561310 - DNA, 112 bp, Homo sapiens
cagcaacggccacatcagcacaagacaactctccgcatacatgattcacgtggtggtcccacaagagtcactgtccccacgatctccttctccagtgtcagtctataaggtg

SEQ ID NO: 561311 - DNA, 689 bp, Homo sapiens
  misc_feature (243)..(243): n is a, c, g, or t
cgtggaagccagcaatacgagtttccccaggtcggaaccacccaccgggtgtttgattccaaaacatgagtgcttgcctgtgaccccgcccccggcggatactcaccgtggcgtgctgtcttccgtggtcggatgtccatgaaggagggtccatgacccgatgcttaacgtcagaacaagaacagcagctactttgttggatggatccccaacaatgtccagcaagccgtctgtgtcattccnccctcgtggcctcaagatggcagtcaccttcattggcaatagcacaaccatcccggagcttttccagcgcatcttggagcagttcccttccatgttcccccggaaggccttcctcccctggtacacaggcgagggcatggaccagatggagttcccccaggcttagagccacattaacgaccttgtcttttagtatcaaccgttcccggattccccccccaaaaaggaggaggatttcggttaggaggcccaaaaggaggccttaggcagagcccccctcccctcagggttttcagtttccttaaccgtttttctccactgcccccttcctctccccccgaatttgtgttttccgcccctatcttgttttttgtttttttttttggggggggtttaaaaccgtgcctggcccatagttggcgccccattaattcttgtttgtttta

SEQ ID NO: 561312 - DNA, 1388 bp, Homo sapiens
tcttgctcattctccgcgtatttggtcctcccttctctgcctgtctcttcctctttctggtcggtcgttgttcttgtctcctcctctggcctcttttcttcctctgccccttactccaccccctcctcttctcctccactctctcccctctctcctctttctctctcttgcttctttcttgttccccttctccgtctctttttcacggtcgctcctctctctatttacatattctctcagccacatactcgttctactctctcccttcgtttctctctgttcttctgtcatctctacccgtctctctacgccgtgcccttacatacaggctgctcgttgctgttcctccgctgccttgcttccgtgctgcctcgtcgccccattcgctgttgtccgcctgcctcgctcttctctggctcccgcctacgccctccgtttctcacggctgtctccgcacttttcttttgccaaaccgccactatgggggggccttttgcctcgtgttgcctcgacttggcaagttcccgcccactgcctctctccgttcatgtgccatttccgcctaccacacgggcgtttttgcctgggtccccattcctttgcctccccgttccctccgacggcccaccctgtgggccagcccacctcggtccctcctgccctttcttgctgggccacgagtcgacgcattgctgggattcgtgcgctcttttccgggcaccacgcatccctcgttctcttcctgtgcctcgtccttccctctatggccgcaatccatgccctaggggcttcccgccctgcccatgggacgtagagtcccgagatcctggccactatgccagttctgacttcgcatccccactatccctcgagcccatgcacgtctgggaacatgccgccttctctccagcctctgtgcctgttgttcctacggtggtctctaccactcctgtcctggctgggtctaggtggtcctgtccaggctcgatgcagcgcccccctcactttgacactggactaggatgcagcctcccttgcctgtgtccccttgagggtaccctgggtccgcctcatcaaggggcagaggcatgaaagagtcggggctggatggtccaggggcttctgggccacgacgcatatagtgcagccccatggggtctgtggtttgacatttgtctgcctaggtgcgaaatcaaggaatcattgccgtgttaaggtcgacaggccctccacaggcttccagacattgaaggaaaaggtttaagtaaagataactagaacctaacagttagtggagtcaaagcccagacactgtaaatagaaccccctccaccacccccgccgcccagcatcctactggactgagatgctacgagtgcctgcgggcc

SEQ ID NO: 561313 - DNA, 137 bp, Homo sapiens
tggacaccccaacaagaggcgttgcacaaggtccaccacctactcaggaaagcacaaggacacccaacaggaggcatccccctcctcctcaaggaaggcacaaggagcagcccaaacagggaggcatccccgtcctc

SEQ ID NO: 561314 - DNA, 152 bp, Homo sapiens
tttttttacttgaaaaacttttgttcaagaatttgggtgggggaaaagaaaattggttttcaagggtggtttgaaattttttgccgcctttaagctggcggttttttgggattggtttttattaaggaattttttaccttccctttccggga

SEQ ID NO: 561315 - DNA, 502 bp, Homo sapiens
ggtgatgatgtggtataggtctcctgtattagggcgtggcccacctgcgtgtggccgtgtctgcatgttaggaaaaaggtcttttgattttggctagaagctgatttagatgtagtgaggttatgttttattgaattggagaaagagaaaggtccagtatcatgggcccaccaagaatgtttccagaagccacagagatttgtagctgggatatggggagaagcctctgactcatgggtttgtatcgtctggtcccatactggctgtgtgattccggggtcgagctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacgggttactctttcctcctccggctctaggcattgaagttgatatcgatgtggagcacggagggaaaa

SEQ ID NO: 561316 - DNA, 248 bp, Homo sapiens
  misc_feature (244)..(244): n is a, c, g, or t
tatggtcagatatttcccctgccccaagggctggtaacgtatatcagtgcaggcgaccgacggatgccctctggttgggctctcgtgatagaccaggttcccccgaccctggtcacccgcctggacgggccgccccccctccctcacacgcagccccggcgcgcgcggagaggggcgcgatgcccccgccggcgcagccgggtaccgggtgtccaggtgcggaagtgcccttcgttcctggganaacg

SEQ ID NO: 561317 - DNA, 944 bp, Homo sapiens
taaaaaaaataacctgaaaacacttctgactttctccactgtctcttaatatgttgctgataggcaaagtggtgcattgcacaccaaacactaagcatgtgtttgtggtaagggacaccaggaagtattcttcaaagccctaagaaccagtgtcttatagctttcttgtgactcataaacactttggtgtgggtgttctttccacccatttattccaggccgtgaagaggaggcgcagaggagtggcgtggcgtgactaacacaggtgcagcggcaaaacaaatcgaggcattagagacgttatttcccctttaccactgtgttcattcacagtggaaagtgcttcttacaaggcgccttcttcaagcccccacttacaatcgtggattatagaccaagtttcttcagaccgtgcgggcaaacacaggatacataacttataacctgattgtcgaggcttatacgcaactctataatcggtgcacatgcatctgaatctaccctttatctcctataaatattatttccgctaccacttaaacaaatgtgaacaacaagggtaaccacaagataccacttatcttacagcaatacaacgcgcacacgttagacacccacatgatagaggagctccaatatctcatattatccgtttcacagaattagtgcgcattactcataaatgaaagactcacaaacaacaccccatatggggagaataactggctcataacaagagccgatacataactcacttcaaattaaaatcttacacgtgaaataataacagggcactacaaatcccgtagctcatggacaccattatggacaggccatccccccattatccccataagcccaaacatcagcacgccacaatgagacaaccaaccctaaacatgcccagggatcaacacccattgaaaagcaccccactatttgac

SEQ ID NO: 561318 - DNA, 119 bp, Homo sapiens
cacgaggccggacggccctgaggatcgacagtcggcaaagtttggcacgaccacgaagtgggcacgtgctccggaaggtgtggaccagggcagactacaggagcacgatggctgtcgac

SEQ ID NO: 561319 - DNA, 237 bp, Homo sapiens
tctgtgttacagcagctaacctccctagttctaatcccagccattctttgctgccagatgctgatgggtcaaggcgtgaaacagggggcttgtcctcatccatgtctccagccttcacctccatcaggtcagctcccaagtgtctgagtgccttccaggtggttaagacaccactaggccgggcgcggtggctcatgcctgtaatcccagcactttgggacggcgagacgggcagat

SEQ ID NO: 561320 - DNA, 103 bp, Homo sapiens
atcacttatttccttctgctcgggccctggcgtgctgaccatggtgcgcccattggcaggtgtccaaagtgatcctccatcttaaagaagctcagacagagta

SEQ ID NO: 561321 - DNA, 498 bp, Homo sapiens
aaaagaatgaatcaactttaagcaggcatggagtttacagatacaaaggctacctaggacatgtatgaagatgagacagtcttcataactctgactatgattacagcttcttcaaggaacaggtgaaatcagaggtaggtatcattaaagcacaaagagtgtacagttattggcagaggcatcctatgatgtaacatcaacattacataaaaaagaaggtggattccatgcactaattccatagtgaggtatcaaaggtgcaggttactatataaagacatatactatctaaaacttgaagactcaaagaacatctactaaaaacatacgccactgtaccttgacacagagctgcataacaccataatagacattcagacatctataaatctgtgctctattacactcagacatagttcctctgccaaatgaatgactaaccagaagctaataaagaacaattgccacaactgacgcttatgacgaaagcctacaccg

SEQ ID NO: 561322 - DNA, 274 bp, Homo sapiens
gtgcgcggtcttctagaggtccccattcgacgggtactggtaatgacaggtagggggctcataagcacggctggataagggcaatataatgagatgagtctcccatatgggcctgcttactctcttaaagctgggctgggactcaatccataaggagattttttgaaacttaaaaatctgatgtgatcagcacacagtaactcgtgcagtaaatttcctaatggagaagcatgtatggctcagggcaatctcgaagggtaacagtcatccccgg

SEQ ID NO: 561323 - DNA, 153 bp, Homo sapiens
accattggaagcagcatagaatgggctgtcaactgtgtaaacactggtgaaacagtgtcaaaaaagtaaatgcttttcaaaatgttttgaaaaccctcaaaaaaaaacagcacttccttaaaaagaaaagtctaccaatgttgctgtgtgagt

SEQ ID NO: 561324 - DNA, 248 bp, Homo sapiens
  misc_feature (38)..(38): n is a, c, g, or t
  misc_feature (52)..(52): n is a, c, g, or t
  misc_feature (201)..(201): n is a, c, g, or t
gcagtggccattaaaatatagaaaaccttggaaatggntccctctaaaattnttactttaataaaaaacattttttggccgggcacggtggctcatgcctgtaataccaacactttggcaggccgagactgacagaactcctgaggtcaggagttcgagaccagcctggccaacatgacgaaaccccatctcaactaaaantacaaaatttagtagggcgtgatggtgcgtgcctgcagtcccagcta

SEQ ID NO: 561325 - DNA, 154 bp, Homo sapiens
  misc_feature (61)..(61): n is a, c, g, or t
  misc_feature (66)..(66): n is a, c, g, or t
  misc_feature (99)..(99): n is a, c, g, or t
agggtcttaactgcagttctgtttccggaacgcggtattttctttctagggattataggcntcccnggccgccccctgaggagctccgctagcagctanagagggcagccacgaagagcgcctgagcactctcgcagagactgtggggctcgcc

SEQ ID NO: 561326 - DNA, 816 bp, Homo sapiens
gcatatgatatgaccctggcagagagttatgcccagtatgtgcactaactctgcaactctctctccattaaagtcgaggaaagttgatgctatgccaatcaaaatcatagaagtgttgcagttgcagcgatcaatggaggaacaatgctcctggactcagtgcttaccgacctcattggagcgagtgagtttcaccaatcatgccaggtttgagtgcttatcggtccgctaggaaattctcattgggaagatagagtccaaagcaagtcgttcctgtagaggagatcaggactgtcagatcgagatggagcagcacgtgacacgaaggacttcagaggagacagagtctcaacaagctcgtatcacgaactggcataggaactgttggccaacgcttgaagatagctacctgttacggagccctttcaatgcgcagactaacgttggttcagtacttgaggtgccttagaaggatgagagaggcgtgtacttggggtaggttagacggtttcatcagggagacccaatcgcttaggattttccataaggtatcccaattaccctataggcagtaagtggtcctcgctcctctgtaggcttcggcttgttactttgacccaatttccttacccactttatccttatgaaggttaaatgctagtctaatcttccattctaaataagaacattctgctgcaccaatgttgttatagacccaactgactgaaaccggccagagcccggttctacatattgttcctcgaggggactgaaagttttccggtaaccacgtaattgtgacgaaatggaccccta

SEQ ID NO: 561327 - DNA, 108 bp, Homo sapiens
atatgctgatacctgcttattcagtttcccatctgtcttcttgccagtcatcgtagcctttcttttttaaacacatgatccctagtactcatctttgcatcataggca

SEQ ID NO: 561328 - DNA, 602 bp, Homo sapiens
  misc_feature (118)..(118): n is a, c, g, or t
  misc_feature (139)..(139): n is a, c, g, or t
  misc_feature (254)..(254): n is a, c, g, or t
agacagactcactctgtcacccaggatagagtgcagtggcatgatctcaattcaccgcagcccctgcctcctgggttcaagcaattcccccgcctcagcctcccgagtagctgggatnacagacgtccaccaccatgcncagctaatttttgtatttttagtagagacaggattcactacctgttgaccaggctggtctcgaactcctgacctcaggtgatccacccacctcagcctcccaaactgctgggatnacaggcgtgacccaccgcatccggcctagactgttgttgaagctggttttcttcttctttcctcagttcttttcttttacatcttccccccatcattgctctgcccatccgaaggctgtggctggcacaggacagaacagaacctcctagcctcaagttccaaacccacactctccaatagccaggctctcagatgggaaggtgaggcatgagaactgttttgtcccaggaggtagaggatgcaatgagccaagatcgcaacactgctctccagcctgggagacagagcaagactcttactcgtgggggaaaaaaaattttaaaatttagcctggcaaggcagcgcac

SEQ ID NO: 561329 - DNA, 612 bp, Homo sapiens
  misc_feature (118)..(118): n is a, c, g, or t
  misc_feature (139)..(139): n is a, c, g, or t
  misc_feature (254)..(254): n is a, c, g, or t
agacagactcactctgtcacccaggatagagtgcagtggcatgatctcaattcaccgcagcccctgcctcctgggttcaagcaattcccccgcctcagcctcccgagtagctgggatnacagacgtccaccaccatgcncagctaatttttgtatttttagtagagacaggattcactacctgttgaccaggctggtctcgaactcctgacctcaggtgatccacccacctcagcctcccaaactgctgggatnacaggcgtgacccaccgcatccggcctagactgttgttgaagctggttttcttcttctttcctcagttcttttcttttacatcttccccccatcattgctctgcccatccgaaggctgtggctggcacaggacagaacagaacctcctagcctcaagttccaaacccacactctccaatagccaggctctcagatgggaagcttcaaagccttgtgacagcctggctgaacctctccagcctgggccctccctccatttcctgccccggaaacaggcatctcctctggccacctcccaaagcctgtctggaagcctcaggcacccgctcctggaagcctgtacgattcacaaacagag

SEQ ID NO: 561330 - DNA, 372 bp, Homo sapiens
  misc_feature (299)..(299): n is a, c, g, or t
  misc_feature (343)..(343): n is a, c, g, or t
  misc_feature (353)..(353): n is a, c, g, or t
aaatacatttatgtttcttgaaatgtgttaagtggcctttgtcaaggtgtttataatagaagagtatataaaaatgaatttctctagagatgcagcatactctaaagatccatcattagataattaaaaatatgtaagtcatgctaacatttccatatataaatggagaacattaactctcctactgtttagttataaaataccaaattttgtaattatcctatcttgaattacactatactgcaaaaatgccagttactcacttttaaatttgacaatgtatgtgatgaattataaantttaatagcctacatcttttcctccttgtatccaaatttctccngaccttaatncttaaaccttttggttacc

SEQ ID NO: 561331 - DNA, 185 bp, Homo sapiens
ggggggttttttgggggggggcccccccctttttttggggttctcctggggggggccccggggggggggggggggccccccccccgggggggggggttttttttttggggggggtttttttttgggggggccccccttttttttgggggggtttttcctataatgggggcccttttttcccccca

SEQ ID NO: 561332 - DNA, 856 bp, Homo sapiens
tatgtgtacgtatataggtcacttgggggagaatagacatctttaccatatgagtattccagtccatgaacacagtatgtctatttatgtagctcttgtgatttttgaacaacatttgtaatttccagcatacagatcttttatacatgtttaatgggggtatacctaaagatttggtcttattagaactatggtaaattttttttaacttggatttggaatggcttacagaatctccacccaaatcaaagaatatacattttttccagcaccaaacaacctattccaaaatggaccacatagttggaagtaaagctgtcctcggcaaatgtaaaagaacagaaattataacaaagtgtctctcagaccacagtgcaatcaaatagaatcaggattaagaaatcactcaaaaatgtcacctaatggaaaatgaaaaactgctcctgaatgatactgggtacataagaaatgaaggcagaaataaagatgtcctttgaaaccaaggagaacaagaacaaataacagaatctctgggagcattccaagcagtgtgtagaggggaattatagcactaaatgccacaagagaaaggcaggcaaagatccaaatggcacctaacattcacattacaagactagaaaagcagagcaacacaattcaaagtagcgaggagaatactagtccgagcgcactgagaaattgagacaaaaccttcaaaatatgaccggggcggtttgaagaccaacatggtgacggcgacataaggcaggacacctcggaaaagtgggtccacggcaacaaatgggaaaacctgtaaaataaagttgcacccaagagttcaaggaacacaagcaga

SEQ ID NO: 561333 - DNA, 603 bp, Homo sapiens
  misc_feature (237)..(237): n is a, c, g, or t
gcccccacctctccgcggcctctgctcagcgtccccacctggccaaaattctccccgccctttccgaggactgagccggtgcactcgaggtcccctgagattgctggtcttcccggagaagtaatgctgtgaaaagggaatgtgttattaactaacaacctcttctccgcacgaccagaggttctctatagcgttcactggatacacgaacctatgctgcccttcaccccaagagancccgagaggagccctgtgtgtcctctgagcgcgccactcgtagatgtagaagagaaatcttgtgagcaccccaagcacgctgagatggtcacgctatgagtttctcacgaaattcccttaatctgaattggtggcctaaactatatggcttgccacatgaactccttccttcaggctgtcccctcccacgaaagcggagacctgaggagccccctggccctggccctcacaaacccacccccctttccttccaacctttctgtcatcatttccaccagcccccccctcccctgagcaccctaaccccctcatgccggccccccctgcccatagtaataaagccaagtccccttttttaaaaccaca

SEQ ID NO: 561334 - DNA, 710 bp, Homo sapiens
ggccagcacgccacagatgatcaatgagtgtttgctgacccgcatatgacaacacggattaaggaagacaaatctggtagcagcaggcaagaaagctgaaaagcaagacacaggatgcaggtctggagtgatcagggcctgaaccaggaagggataacattgagagagacatggaaaatgcgcttgaagtatatatatttttattgtaaagaatcatacacagataaggtagtattatatagagaatgattagttgaggatatttccagagtctttaagccagagaaatgtactaatttagacatttctggactcattgctcagtactgatgtcatgtttttaaggacactgacacacttggctaatcccagagacatgaagaggatggtgactagggtggtcacataattaaaggggctggggatatttaacctagaaagagaaacattttttgtgcacataatgactgtacacaaattctaacaaactttcatgtgaaagaggactggattagatgactttcttctgtgtagctttggagggaaaaactcaaacaatggggggaaagaacaggaagctggatttaggtttcctatgttatggaagtcatcacagtgggggatgataattgtaacaggaagatggagggtagtgaaagaaagttcaggatgaagtatgtgtatattggtcattaaaaatatcacattcc

SEQ ID NO: 561335 - DNA, 309 bp, Homo sapiens
gtccccattttttttaaattccctggtttccggttgcccaattccacccttttaaagcggttcttgggaccaaattccatccaaaagggcggttggggcgaagggaaccccccccttcctgggttcttggttttcccgggtggttggttggggaaaaacctggccccggttccccccccggtttggggcttgggacccccgccggctatttttggtttttaaatttgggtttggccggttatttgagcctttaaaggcctttttgaatgggttaattttaggtgggttattccctttttgcccttttga

SEQ ID NO: 561336 - DNA, 220 bp, Homo sapiens
  misc_feature (2)..(2): n is a, c, g, or t
  misc_feature (49)..(49): n is a, c, g, or t
  misc_feature (51)..(51): n is a, c, g, or t
  misc_feature (92)..(92): n is a, c, g, or t
  misc_feature (114)..(115): n is a, c, g, or t
  misc_feature (219)..(219): n is a, c, g, or t
tncaccaccagcatgttcattaccacttaaatatattgctacagcagtngnacaacagagccaaatgagactgtcaaagacaagacaacacntgtgctatttcctagagtctgnnaacagctcagacatacccacacacatggtaacctgtgagaccacaaactgtttccaagccaactcctaatagcctatcagagccttcattaatttatgttttana

SEQ ID NO: 561337 - DNA, 285 bp, Homo sapiens
cactcctatcatactggtacatagaaactccagcagatttagtatagggcatccatcatctaagtcaaacctctcacatgtacttcaaatcaatcagatatggggatactcaacatatttctagtgtcaataaaaggtgtggaattagtagatccgatgaagacctgtttttccatgccacatgggacttccagacgccattgggatggggtaaagaagatggggaaatatagaagacgtatcctgggcctgtgtctcttaagcagtagagatgccgaagagtag

SEQ ID NO: 561338 - DNA, 987 bp, Homo sapiens
  misc_feature (208)..(208): n is a, c, g, or t
  misc_feature (210)..(210): n is a, c, g, or t
agcggctgaggaacagggcggcgacgcgtggtggggactgacgtcggagcccggtgactggatgttggtgttggtattgggagatctgtctcagtcccaggaccggtggcgagaacagtttgccagactgagaaattcaacaaaaacgtcctggtctgcgcagagacaaagtatcagcatcattgtctctgctaccaggaatagcttngncacccaaaggagtagttagtgactactctcaagcatctctgggctggtagatgttcgatagtcgtgaggaggagcacgtgtcgaatgacgtaagtctagacatgtgatccacgatacgaagagagaagtggtgactagtccggacagcttcgaaaagtggggtcctgactccgagtggatcgaatcaggcttagttccagttggggatgataatggctcatgcctctacgcccattgtagcacgtaggctggatttagagttggtggactagttctttttattcttcggggactaccacagcaatcaaaatttgagagcgattctgacgcagtgacaaataagattcgtagcacttaactccacggtccctgccaactgcgcggcactactaatggccgttgggaaaacagcagcgatccacttccactcattgtgtgtacgatggatactccaggcttctaccagtaggtcacctatgatgtatacctggcttaactacggacgatggactgtggacaatgtaagaacgaaatcgaagatacaataaaagactggtaaagccagggcctggtctccgatgatcttcccgggtataacgcgcccactcggtcctggttggaacagtctagagtaagtttaaacattcctaagagcgctcaaaaagtcgtactcagcttttacgtgactcatgtgtgcacgtaacacctagtaataccccatcttcctccggtgtaatacactagtaggctccccagctttcctgttcaaccatagag

SEQ ID NO: 561339 - DNA, 102 bp, Homo sapiens
ccggtaaaaagtttcagattttggagtgtttcaaatttgggattttcagattaaagtcgctcagcctggttgaggcgtctttaatctgaaaatcccaaattt

SEQ ID NO: 561340 - DNA, 321 bp, Homo sapiens
ttataatcagcgagaatggaacaactttttcttgaagtttgaaaactctttgctctaatccttactaatagcagaaatcctaatttcctcatcctgggggcccgggaactggagactcctgggcatatcctcttaaatccttggtgggtttcctacgtcaaccaattaggggcctcttactcagtcaccgatccttgcagcagataaatcaccctcaagaaggctctacaattaatttcaggaatagggagatttaccttaaagttattggcatcaagggcatttcaaggtagtctagttttccaaaacccgaacccgatg

SEQ ID NO: 561341 - DNA, 387 bp, Homo sapiens
ttcacgtgaactttgctctcacggtttccctgtgctcgaaatgggactattgctcaaacttgatcacgactcagctagccgggcgcagtggctcatgcaatcccagcactttgggaggccgaggcgggcagatcacctgaggtcaggagtttgaggcaggcggatcacctgaggtcaggtgtttgagaccagcctgaccagtatgatgaaaccctatctccactaaaaatacaaaaattagctgagaatggtggcatgcgcctgtaatcccagctactcgggaggttgaggcaggagaatcgcttgaacctgggaggcggagattgcggtaagccgagatccggccattgcactccatcctgggcgacaagagtgaaactccatctc

SEQ ID NO: 561342 - DNA, 1254 bp, Homo sapiens
gagcgggacacgcggaggaggtaaggaagtgggtaggccctctccgtggatctctgtcccccagtcaccttcctgcgacccttcctggtgagtgggcgtcctggtgcggtggggtgaatgtgtggtgagtgggctgggctgtgttacctcatctgcctgcctccgtgtgagtgcccctgcatcgctcgctgccggcggcttgggtgctgtgctgactccatgtgctgctggaatgctgagacgaagggatagatggcacagagtgctcctgtggaggcagcgctgcccccccgtgcccctgaccgctgctgggacccgcgccgcgagagcgggcggcacttcggcgcctcgcgcgtccgccggacgcctgggtcggcgcctgcggggctggaaggcgggctgtctgaagcgccgttccgtgctctgcttctctctcggagcttcggcaccctgccccgagcctggtcgcgcgcccgccaccgtgtcttgccccactcgggctgtctggtctgcccatcccggccggcccagctccttgccctcggggccttgcccttctccgggtctcgggtgctccggagcgggcgaccgagaaatgcggcgactgtgagccccggttgggccccaccccggagaccacgggccccaagccaggcgacacgcaacgtgcaatagaggcgtccgccaacgggaaggcgcacagccacagaccaccacttgaaggggccttaacacaatacagctacggtgaaagtcgtaagcccactcgggccgaagcccaatggcagcggcggtaaaccctcgccgcaattttcagcccagtaacccaaaggacaccccacgacaaccattagcgaccacacaacctctcacaaatcaaatcccatcccaagcctcccctactaccacacgaactaactccccttgatttcgacctatctatgccccaactcacaccacacacacctccccctaaataacccaaacctcgtaatatagtattctctagacccatgatcacctatatacgcactttcaccaacttccagccaaccacaacaccaaccaacacacgcacctccgacatcaacccccagatatcaacccgccattagtattaccaaatctcaaacaccaccctacccatccaaaccacacccactccatccacaacccacccctatcatcctatttgtctctctagtatccatcatcacctactcttcatcccactcctcccatcaccccttcgtt

SEQ ID NO: 561343 - DNA, 398 bp, Homo sapiens
gaaatatgattaaggatagagtttattccagcgtaaggcttgagggtagcctctcaggagacaccagctccaaatggggttagcattccaaagtgaagaagttagggtttcgcctaggtggccagagacaaattttaacaggatttcatttcccctaagagaccagtgcatacttacagctatttggtaggttacagattactacattccaagaaaaagtactttgttactccatgagggggggtagtgatctcagggggttgtatctctggtatggtttggtcctcctattttaattatttatagaaacaaaaggcagacgttgcagatgcctgctgcttgactcaggctgtagccacattcctcccaaggctcggaataaagttccaacagcttta

SEQ ID NO: 561344 - DNA, 716 bp, Homo sapiens
ttctctcgagatagacatcacacatctaacagttacgtctcttgtgaagcaccgccagagcaccctctcttctccaactcaccacctgtccccactcttgttgatgtttacgccgacaacaaatatttagttttcccccctcggccaaaaattcacttcccatcctaccttcctcccccgccgtccttcctcgttggtggtccacccccatcttcctgctgtatctagaaaaatcatctgccgtgtataatataccaaaagaagactagagaggtctctcttcaataacaccccctctaatgttatttgaaagaacatattgattttacacagccccccacgcccggggagtggtctccaatatacacgctctctctcgtctcgtgagaagcctggtctgttgtctgcccgcgcgaggagacatgatgagacgcaccacgcgcacgcgagagattgtccctccttcttctcttcgtatagtggatagccccctcagtgattgccaccacttcctctcctctctcgcgatagagattatgtccgaagaaacaataattcctcccgccctgttcttcatgtttttggtgcgagagataataaactacattgtcttccgcggcaagatacatatatacatttggatacagtgacccacttcgacgtctgtgcccttgtgtaaaacagcgggtcacccccgacccacaattgtacaaaaa

SEQ ID NO: 561345 - DNA, 246 bp, Homo sapiens
aacggcccccagcgcggcggaacgcctgggccctccgattagggccccggttttaccgccacagtaaacagggcggcaatgaacagtcacatgcaggattctgcagaacgcccgatatgcctaagggtatatactcagtaaaaggaacgctgagccaaaaggcagaactggctacagttccctgaggagacaccataccacgtaccacaagggatgaaccaaactacactcccaccaacagtggat

SEQ ID NO: 561346 - DNA, 131 bp, Homo sapiens
gcggcccctactactactactactgctcgaattcaagcttctaacgatgtacggggacatggtcactgcctcagcccagccaggctgtgcctttgactttaaaataaaagtccacccagtgctgtgtgtgg

SEQ ID NO: 561347 - DNA, 396 bp, Homo sapiens
gcagtctacagagatatcgctggaagtacttgcatcctgcttggtcagaacctcagagagagtccccaaagaacgatgagtgagctgacttgtatttacgaacgactaatcatctatcctctgattcaatccactcttcacaggttccaagtgtttcttcctcacagggttgctttctgtattataactcctatttcacttgcctataattctttgttcatttctttacttagggttcctttactagaacattcagaaacagagtcccctgaactataatcccctaactgacagctctcaagaaacatcacaacctctgatgtggaaagtctatccagctcagaaaaagtacttatgtaaaaatcttgcagagctgacgtcaaataacctacctct

SEQ ID NO: 561348 - DNA, 116 bp, Homo sapiens
catggatttgctggtgcagtacaactaggcttaatagggacatgtcaagaaacattagtcttaggaattcttcaaaaaatggcatcccaatgaaaataaatttgatgactacaaaa

SEQ ID NO: 561349 - DNA, 455 bp, Homo sapiens
tccagagtatagatggactggactgaatgctggtttccccctcaaatcataggctgaaatcctaaccctaaatgtgatggtttcaggcagcaggaccttagggaggtgattaggtcatgagggtggagcctgcatgagtgggattagtgcccttataagagggaccccggagagctgcctgccccttctgccatgtgagcacacagggagaaaacagagctctatgaatccgaaagttagccctcaccagacaccaagttagctgactccttgaccttggacttcgcagcctccagactacgcgataaattcctattgtttataagccactcagtcaatggcatcttgtctatcaacctgcagggactaagataactatgatccatttctgatacttattttaatgcaaaattggttttcctaaacatgtgggagggaacaagaagtcagatctt

SEQ ID NO: 561350 - DNA, 355 bp, Homo sapiens
tgttatcctcgatgtgctgcttcctgacagtgttccttgccatcagaggccttcgaattgtaaatggacaaggccaggcgcagtggctcacacctgtaatcctggcacttggggaggccgaggtggggcagatcacctgaggtcaggagtttgagaccagcctcgccaacatggtgaaaccccgtctctactaaaaaatacaaaaattagccaggtgtggtagtgggcgccgggaattccagctacttgggaggccaaggcaggagaatcacttgaacctgggaggcacaggttgcagtgagccgagatcgtgccattgcactccagcctagacaacagagcgagactccgtctc

SEQ ID NO: 561351 - DNA, 337 bp, Homo sapiens
ccaaaagaaaaattaatagaaatcagaacactagtgtgtattaaaattttaaacacatatagaggcaatgaaattaggaaaattcaaccgttttcgtggtaagggttagtttatgtgtcaagatgtcaaaacaaagacttaccgacaaatttctgttaggatttaatattgaatcaaactgaatctaacatttcttaagttctcacttcaaatgaacgatgataaaattttcgtacactggaatatctagacattctacactctccacaacttattagaaattataatgtgtatttggtgtgattttacggaaaggtattcaatttctttggtaaaa

SEQ ID NO: 561352 - DNA, 261 bp, Homo sapiens
taaatctatgtgaggaatgagctacagttcaaggaggagaagcttgcagagcagctgaagcaagctgaggagctcaggtgaggggaccccatgggggcaggcaggggggcaggtgtgtaaatctttgaagtataacagctcggtggggagacttaagagctaagctgggccaggggaagggcaggaattgccatggcaggctcgctacacacaaatatttatcaaacagagaagaaggataataaaaatttatgggttgca

SEQ ID NO: 561353 - DNA, 757 bp, Homo sapiens
taagatgcctcgctgggtcgcccgccgctaggtcgctccccggcatgcgggcgctgcgggccggctgaccctgctgttgggcgcggggctgggtgcggtcgtcgagggctaggcgtgcggcgtgctgggagtgaccgcgctgggctggcgctgtggacttgcatgtggcctggctgcccggttgcttgccctgttggcgagcagtcagccgaatttagcccctcttgttgcccgcggggggaccccgtgtggccgcggggtgaatcttggccgaacggataacgggtggttagcccgggtggggctttgggctggcagggcttccaagtggacgcccgggagaaatgctcggtaagtggttgcttagttggctacgtaacccgctggtggccaatccccgaggggcgcgcgcgcgctactgtggggttacggttgccagcgaagttatgagaaccccgggaagcgtgttcttcacggggggggcaagagctgggggagacaccccgggagaggccgagatgtttacgagaactttatcccgaggggaaggaggaacggaaccttatcgagattgcagaacgggcggttaccccaccctctgtgtcgcaaggcacaaaaacggcgcgagaaaaaaccgcggagggggcacatgcggcattacacgaagacgcggggggagacaaccactggtaggacggagaccgggcacgggacaaaaacccgcaatcgatgttttgaaaccgaccaaaaaaattgg

SEQ ID NO: 561354 - DNA, 128 bp, Homo sapiens
ggctgatgccaccgttctattgtgcagaactcaagcaaaacgtcattttagtgttgattttgatgtaccagaacctaaattgcttagaaattaaaaacttgtttcagcagccaggtgtgtcagcacat

SEQ ID NO: 561355 - DNA, 160 bp, Homo sapiens
cctacggcatacaaatctgtttctgaatggcaggaagggggagatggggacacataccacgatgtctccttcatgaccctaacacattccctcccccatcactaccaggccatgcagagagcagcgtgctcttcgccgcaggtcacacggcgctctgggg

SEQ ID NO: 561356 - DNA, 185 bp, Homo sapiens
gcttcccaacaatattgcccgggccgtgccccaccccagcacgccccgatgttcccctctctttgcgaggcgccctagaccgctgccgtagagacactcccgctcccccctggtagaatttatttttttgatgggtaaaaaaccgcccgaagctggaaaaaaaaaggggtttggcccccaaaaaa

SEQ ID NO: 561357 - DNA, 141 bp, Homo sapiens
  misc_feature (34)..(34): n is a, c, g, or t
  misc_feature (123)..(124): n is a, c, g, or t
ttcaggagagagaactgattgtgcagcgtttagncctgtgcctgcccacagcctgtgtgggcatttggtgcccaagtgatgatctgcatccaagtggactctgcaaccacatgccatggtacnnttgatatttcctaatcc

SEQ ID NO: 561358 - DNA, 144 bp, Homo sapiens
ggtaccgcgtataattatgatgttgacatctactcatgtgctgtaggctattgcatggcgtgtttggagaaacgtctgttcaagggcttgcctttttttttggagacagagtcttactccgtggcccaggcgggagtgcggggg

SEQ ID NO: 561359 - DNA, 1065 bp, Homo sapiens
ggaagattttcctggcggtctaccggggaagatcgctgaagacagagcgactggtagttctggaggcctcgctccggggccgacccgaggccacagtgccgtccgcggtagatcggacgttgggtgacgggctccgggcatcccgagggatggaagggtctaagacgtccaacaatcagcacacatgcaggtgagcttcgttgtgccagcgctgtagcagacccttgaaactgggacacgaagtttcaagatccggggaacccgggatgcaccaatacagcgagaatctacagaggtccactaaacaatatacacacgccggacaccgaggcgggaaaagcacgggcgaaagcagaccacggtggcgtgagcgagaccaacgctacagggaagcaggcagcccagttgtactgggaaaacttccattacgacccacggggaatgggttgtccttctcgcaagacatttcaatccgaccccaagccagggcatggaatgttccacaagaaaaagttgcgcagaatcaaggcttaacatcatgactgggggcgcaggcattctgatgggcgggaacccaatgagaagaaaacgcatcatggcgcggacacgacgttgacaggggttcaacttgtgggcgacccctctgtcgttggaccacgtacagtggtacgggagcccaggacccatgcactggtggggattcacaccccaaattccttgtgcagggacatgggcaatgaatacctactatgtttagaacccaaggtatgtgacaaattcatcggctccaaaccgtttccgcgttggcacaacattgacagtatggtccaggaaaaactaacacacaaaccggccgggatgtatggggagcaactccttttaggacggcgaaccattggcaactggaacgggcttggcccaggcgggacagcaagcgtcacacggcaattggaggccttacagggcacgcttgggcacactacaacgggacggacgacgagtctgaatcccagggagcagagggacaccaccggtggcacacgaaaccgggcacacatacagtgg

SEQ ID NO: 561360 - DNA, 362 bp, Homo sapiens
  misc_feature (195)..(195): n is a, c, g, or t
  misc_feature (229)..(229): n is a, c, g, or t
  misc_feature (283)..(283): n is a, c, g, or t
cagtgcacctgcttcttgcaggtgactctgaggttccctattttcccatggggtgcgagtcagggaggcctttctccctcttgacagggttggagttggctctatcaccaccatggatttgtgggacatgtgatgtgttccctggtgacagaaccccattgaagcagagctgcaggatatgatcaatgaggtggntgcagatgggaacgggaccattgacttcccgganttcctgaccatgatggccagaaagatgaaggacacagacagtgaggaggagatncgagaggcgttccgtgtctttgacaaggatgggaatggctacatcagcgcccagagctgcgtcacgtaatgacgacctg

SEQ ID NO: 561361 - DNA, 207 bp, Homo sapiens
cctggtgtcgcatgggcgccgcccgcccgttgttaccggtattgtaagaacaagccgtacccaagtctcgcttctgccgaggtgtgcctgatgccacgattcgcatttttgacctgggcggaaaaaggcaaagtggatgagtttccgctttgtgcacatggtgtcagatgatatggcagtgtgctctgaagtttgagctgccgattg

SEQ ID NO: 561362 - DNA, 954 bp, Homo sapiens
gacgtgttgcgccagttattactagttgatgcgtgtgtacgattgtactgcgccctcgctgtccttttccaggagtgtatatcttgtggggtctacatttttgccaccacccacttttgatgggtctaccttgtgaaggggtctgttcccacaccggatgcttgacgggaaaaactttgcgagaccctttcggcgggtcgttgccccccggatggtctaagggtagataccaaaactgtgccgcctttcccgcatttcccccctccgggactgccatacacgcccttctgtgcgagccacttccttacccccctttagggctccccctcccttcagtctcctcccccctgggtcagaattttaaagagccccccccaatgtttctcacaccccccgtccacaacgcattcagacacaaacatgtcactgtatgaatatatattcgctaaccccttgtatccaccacctctctgaaagcatacacttattcataaaaaagggcgtattgtggtctctcccctcaaaaaatctatatcaagaatatgaggaccattacacctcaagtttcgtagataaacctctagcattctttagtacggttcactgaaaacaattgtattccccccctctatcggcacaatcccgaggggcttcgcaccacggttgtttgcggcccgcatttaatctactgcttccacgagttaaccaccggcgcataccctctccatgaggggggattctttctcccacctaagggttactctgccaatataaaagtagcctcaatatctgtttttgggatacattaagaggaacattctcacgacagatggaaagactcgaacggttcgaacaattgttcacccgccacaggtgaggcttttttaaaagaagctgtttctcccccttgttttactctgccccctccaccaaaaaggcccaacaaacaaaaca

SEQ ID NO: 561363 - DNA, 398 bp, Homo sapiens
  misc_feature (116)..(116): n is a, c, g, or t
  misc_feature (119)..(119): n is a, c, g, or t
  misc_feature (122)..(122): n is a, c, g, or t
  misc_feature (233)..(233): n is a, c, g, or t
  misc_feature (295)..(295): n is a, c, g, or t
  misc_feature (303)..(303): n is a, c, g, or t
  misc_feature (347)..(347): n is a, c, g, or t
  misc_feature (368)..(368): n is a, c, g, or t
  misc_feature (376)..(376): n is a, c, g, or t
  misc_feature (396)..(396): n is a, c, g, or t
ctgccgttctgcccttaggtcctggtagattgcaaacgacctgctttctttctgatcccgggctgcgttcggacccctgtcgtatagaaaatcccaagtaaggtacctgccgtcgnaantgntgagctttcttcttggacacctaatacccacagtcctccagacccctgtcggatagtaaatcccaagtaaggtaccttctgctggaagatctgagctttcttcttggacanctaaaacccacagtcctccagacccctgtcggatagtaaatcccaagtaaggcacctgcgtncggaaatncttgagctttcttcttgggacaccttaaaacccacagtcctccnagcagtgaaggatcccagttnagattttnccagggtttaacgggtcatnac

SEQ ID NO: 561364 - DNA, 406 bp, Homo sapiens
gcagacctgagcccaagggatactccacaaggagaagacatgctgaacgccatccgaaggggcgtgaaactgaagaagaccacgacaaaccatcggttagccccttgcttttcttaaggtcacaagaaatgcgcccgtggggaaagaactggttcattaatcctaaattggcttgatccattccactctattattaaaccaaagaatttggaggcgactcggaatatagctcttttgaaaggacttgacacctttagattagaatttaaacccacccatggtaccggccttaacctggacctttaaattggtaaatatggccaatttcctttcggcacatttaaatctatagttcccctttggatttttctgaaggtgccttccatttaacttttttcgtctttgt

SEQ ID NO: 561365 - DNA, 530 bp, Homo sapiens
  misc_feature (503)..(503): n is a, c, g, or t
  misc_feature (530)..(530): n is a, c, g, or t
tttaggattatgttcttgtattgtggttctccgtctgtgcccacggcctctgtctccccatggattttcttctggctggcgttcggtccgtttctgctccgccttgtggcatcccctctgttgtacggcatctggtctaggtgatgcggcaggcctccttcctgcccctcgacgacacctcttgggacgatgcattttccgtctggtctcacagggggtaggagtgaggctttgcaccccagccctctagccctaggccactgtgagggatgggtgctggctgagcccccgggggcagccaggagccaggcaggtgatgtctttgttctcggctccacatcagcaagagccaggtgagggggcgcatcgccagggccagacccagcgtggggcagcctgaaccgtgcttccccctgtggccggcatgcgccgatctgtcatacactggtgagcactgagagaggagggaggagggaacctggcgggggtgtctgaggccgcantaccgccgaggcgtcaaagctcacgan

SEQ ID NO: 561366 - DNA, 157 bp, Homo sapiens
  misc_feature (132)..(132): n is a, c, g, or t
tgatatgctgttcagctgaggtcatgtctgtgtgaagtggctcattctcccatctttatgggtcttctccaagtactccagtttcctcccatatcccaaagatgcacatgaatgcgatgtgtactacgcggnccacgtctgtagcagcgtggcgtgt

SEQ ID NO: 561367 - DNA, 338 bp, Homo sapiens
ccctagcacttcctgtacatgtgtacagcaatatgtcggcgctcaagagttaagtcaatcctacttgtgttgtgtgtcaggtcacttaggcagatgtaataacccctccttacccatttgcacacgtcacagtcgattcacacacaggactgggctggacagctggccacagagcccagcaagtccttcctgggagagaagagttagggctgatactgaaggtctctttcacatctgggcacacgtctgccttcaggctgtaagaatttcatttgtcgattgttaaataaaaccaggagaaagcaatgcaggtctctgggaatctcatcccttccgta

SEQ ID NO: 561368 - DNA, 129 bp, Homo sapiens
gcagaagagcatgcagctcctgcaggaaggagctctgcactggcagtggcactgacggttcaaggagctgcgagacacaaactacagaaagaatagaatcaattcttcctccttttaccttcaatcagg

SEQ ID NO: 561369 - DNA, 628 bp, Homo sapiens
  misc_feature (28)..(28): n is a, c, g, or t
  misc_feature (30)..(30): n is a, c, g, or t
  misc_feature (251)..(251): n is a, c, g, or t
  misc_feature (307)..(307): n is a, c, g, or t
  misc_feature (413)..(413): n is a, c, g, or t
  misc_feature (422)..(422): n is a, c, g, or t
  misc_feature (426)..(426): n is a, c, g, or t
  misc_feature (430)..(430): n is a, c, g, or t
  misc_feature (437)..(437): n is a, c, g, or t
  misc_feature (442)..(442): n is a, c, g, or t
  misc_feature (447)..(447): n is a, c, g, or t
  misc_feature (452)..(452): n is a, c, g, or t
ggtggtgttcaagtggcctaaaattcantnatgatattttctttcactcaattacgtagcaaagaatgaggtttgaaacagggtgccataattagtttgaatgagggtactatgctgaaaaaatatatgtctatatacacacacgtatctacatgcgtgggtgtgtatataaaatcttaccgaattgtacatgaggagccttctcagtttcagttatttgtaacattatctattatcattaaatattattnacttgacaaatacttatttaaggactagtggaaagactgtaggcaggggtgtcttncagaagaaattggtatttaaactgatacctagagggtaagaaaagttattagagcaaccaaaaggggaaagggtagttcaagcaagaaaaaaaaaaaaaatgttangttgctgancatngtancacatgnctgtngccanaaatncatgtgatcttagggttacgtactaagaaccccagatgcctaggaggggaggcttatgtaacccaattccttgcgcctaaatgtagactgttaaatctctttataccatttttctaaaactgaaatgggtatacaaataaggtcgttattgaataattatttcagggggacactcc

SEQ ID NO: 561370 - DNA, 627 bp, Homo sapiens
  misc_feature (28)..(28): n is a, c, g, or t
  misc_feature (30)..(30): n is a, c, g, or t
  misc_feature (251)..(251): n is a, c, g, or t
  misc_feature (307)..(307): n is a, c, g, or t
  misc_feature (413)..(413): n is a, c, g, or t
  misc_feature (422)..(422): n is a, c, g, or t
  misc_feature (426)..(426): n is a, c, g, or t
  misc_feature (430)..(430): n is a, c, g, or t
  misc_feature (437)..(437): n is a, c, g, or t
  misc_feature (442)..(442): n is a, c, g, or t
  misc_feature (447)..(447): n is a, c, g, or t
  misc_feature (452)..(452): n is a, c, g, or t
ggtggtgttcaagtggcctaaaattcantnatgatattttctttcactcaattacgtagcaaagaatgaggtttgaaacagggtgccataattagtttgaatgagggtactatgctgaaaaaatatatgtctatatacacacacgtatctacatgcgtgggtgtgtatataaaatcttaccgaattgtacatgaggagccttctcagtttcagttatttgtaacattatctattatcattaaatattattnacttgacaaatacttatttaaggactagtggaaagactgtaggcaggggtgtcttncagaagaaattggtatttaaactgatacctagagggtaagaaaagttattagagcaaccaaaaggggaaagggtagttcaagcaagaaaaaaaaaaaaaatgttangttgctgancatngtancacatgnctgtngccanaaatncatttttttataggctctagttcgatgatcccttgatcccatgaaggggaagcttatctacccatatttatgttccttgaattgtgactttgcaaactattgttataccttttttataatctattatggggtacatataatgtttcctagttcaaaatttttatgtggtcagccc

SEQ ID NO: 561371 - DNA, 687 bp, Homo sapiens
tcaacgcttatattcctagttctagtcttcatatttagaccacctcatttgcggtaactaggaaaatttgatgctaaaatccagagtctcgggctcaaataattccatatactgggaaatcagagtcccatcttggatatattttcgctgtgacatttcccaaagtgggttccatggaatgctagtcacatgagatatattgacaaaaagagtgctgtggttagtaaggttgggaaacactgcctgctgccatatccttctggagctgcataatgaatacaagcatatttacagactctgataagtcacacagtaaagaaattgatacttggtagagatgtattttggctcagtttcccaaacttagttggcgatagcacactcttattcaccaatacctctgaacacttttcgggaaatgctattctagggagataactgatcttggttaggaccgtcttaaaaatgaaaggaagaggctgggtgcagtggctcatgcctgtaatcccagcactttgggagggcgaggtgggtggatcacttgaggtcaggagttcgagaccagcctggctaacatggagaaaccctgtctctactaaaaatacaaaaattagcctggtgtggtggcgggtgctataatcccacactgggagctgacacagggaatcattgaaccaggaggcgagt

SEQ ID NO: 561372 - DNA, 178 bp, Homo sapiens
gtaccttccagcaagctaacactcctgcagtgagagcccaagtgtcgtacacactcctgcaggagagccctagcactgtacacactcctgcaggaagagcctcccagtcaccacgccacactcctgcatggatgagccccccagtcgactgtacactctcctgcacgggaggaggggg

SEQ ID NO: 561373 - DNA, 1078 bp, Homo sapiens
tacaaaaaaaaaaaaaaaaaacccctaaggccaaaacttggaaataggttctggacttgcaatttgggaactgaaattaaaacacgggggtgtttttccccctgttctgaaaattacacagtttcccagaaatttcaaagaagtgggccaagattaccttccaaataggggattgggcttatttctccagtaaacacaaacttccctttgcagtcatttttctaggggagaatgagggctcactctgttataaggccaatagtcattagactttccaaagcaattcccagattaaggatccgtgttggtagcaaccaattcttagctaaaccttaggcattaaagaatttctttcgagggaattttaagaatccaaagggaacgcttaaaagaaacccaaacctcgggaaatagaaacacttaaagcctccccgaagaaaatttttttagacggcagaaattggctcaataaacttcttggcttaataatcccctcagtggcttttaaattataaccactccgggctgtgcttttaaagatgtgccccatttcaagaattttaatgtgccgtggcaccggttgagtttgttgccaaccccttagggttccagaaaatattaccccccgtggccgagtctctttgagaagcccttttggagaaaggatcatctcttaacgaggaacattacactttttcgggtctttaacactgaaattttgagagggcacaagaaccagctggggctgataaccaggatttcccccttcaaggagaccttaaccgttgttgacaaggggacgaggggctacgttacctccaacgggggagaacaacacacgcagactagagaagctgcacaagaaccatggttgttgggccccgctctgcgcgaccaagaagaaaagttttttaaaacaacaattagtagtggggcgcgccgcgcccccagtagttatagagcacaacagtgccaacagtcttgttgccaacaggaacagtcctggcgacagaccatggtgtggcgatcacacaaaataaaaacacgcgggggaaccccagggggttgtaaccactcg

SEQ ID NO: 561374 - DNA, 292 bp, Homo sapiens
  misc_feature (34)..(34): n is a, c, g, or t
  misc_feature (77)..(77): n is a, c, g, or t
  misc_feature (80)..(80): n is a, c, g, or t
  misc_feature (85)..(85): n is a, c, g, or t
  misc_feature (281)..(281): n is a, c, g, or t
ggtggtggagaggccttagctgtcctgactggtnccctcccaggctccttttcaccctgccccctggctagagcccntgntgtcnaagcctccccctggctcttcagttctctagcccttggtttgctgggtttcctgactgtagccacatctctcccgctccctaagggtaacctagccaatggaagctgccctttgggtaggtgctgggctcctgggagggcccagatgatggggtgaggcatgtctttccagaactttccctgggcagggaggggatngcagaaactta

SEQ ID NO: 561375 - DNA, 280 bp, Homo sapiens
  misc_feature (276)..(276): n is a, c, g, or t
tacactgagctcaactcctgggccaagtatcctctcacctcagctcccaaggaggtgggactacaggtgtatgccaccacactcagctatttttttattcatttttgtagagactgagtctcatcatcttgcccaggctggtctcaaactcctgaactctagtgatcctcctgccttggcctcccaaagtgctggaattacagatctgagccaccgtgcccagccttgcctgatgttgaatgtcatatctacatgtggtttgtaagcttgtaactnaacg

SEQ ID NO: 561376 - DNA, 1016 bp, Homo sapiens
aaaaacaaaaacagcagctatttgttgagtggatccccaacaatgtgaaaacgggctagtcatgtgactatcccaccatcgtggggcttaatacaatgtccagtcaccttcatgggcaacagcacggccatccatggagctgtacaagcgcatctcctgagcagttcaatggcctatgttccggctgcaaggccttcctgcactggtacacgggcgagggcatggacgagatggagttcaccgaggccgagagcaacatgaatgacctgtgtgtccgagtaccagtagtaccaggatgccacagtccgagtgacggagggctgagttcgaccgagcgaggctgatggagtgacggtcggctatgaagctcttcagtcactggggtaaatgcagggaagcagtgtgaactcttatatttcactcccaagccttgtacctgttggtctgttccactgtgtgcatcttgcatgtattccctgtcgcatcattcatgactgtacagacacgcaaccaatataaaaggcaacttcgccaatagccaaaaacaagaaacagctaccaggggagtacacataaagagcatccaaaagtcggggggagcctgcgcccaccccggagaaagcacgccgtggacgcagcagactagtgcagagcgcgacgaagggtgcaccgccgaggggagatgacagacaacagcggctacacaagggcggaccaccaaagacagaacaaccactcggcaaccaaagagaaaaacaaggacacgcggcgaccattcaacacaacacaaaaaagacgaccgacggtgaggagaccaatacggcactattgcggaagaaaacacgacgagagagatagcgacaggaggacaaaaaagggagaatgaaaaacacaggaaggtcagagcgcagaagcgaaaacacaagatgaggcgccgccgcaggggaaacgaacgcgaagaagagaaagaaggaaagagacaggcggaacaaagcgacaccaaccacgagaaacaa

SEQ ID NO: 561377 - DNA, 137 bp, Homo sapiens
ggcgacgcagagtaaatctggtggaggtccgtagcggccctcgccagcagccacatcaccacccccgttccagcatccgttatgcagcctttcagcaaccccagtgctgtgtatcttcctccaggctcctttcacgg

SEQ ID NO: 561378 - DNA, 606 bp, Homo sapiens
ctcccgctccacctcgcttcttctctcccggccgaggcccgggggaccagagcgagaagcgggaccatgtccgacgcaagtgtgacggctctcgagtaccacaaccccgccggtttcaactgcaaaggatgaaacagaatttagaaagcttcatcgtgtggcttgaagaccagaaaatcaggcacctacaagattgacagaccagaggggcacctttaaagaaacaatccacatgcagccgacttgggcccccaaaaggtttccttttgggaaacaaggctattctccagagaatgttaaacctgtcctttcaagattcaagatcgacaagaagctattgactggcttctgtggttaagctgttagacttgaatatggagataatggctgaaaaataccaggatttagtaccctgatatttcaaaaactggctgacaatgcaactaaaaatgcagaaccattgatcaattgtggattgtaaataatccctgatttttaaggctgggttgtgaatgggcttgtggcttaaccttgtttcaagaattcagccgtcattgatgattacctgggtaaatgcttaaggcaaattcggatttgcggttcaag

SEQ ID NO: 561379 - DNA, 734 bp, Homo sapiens
ggaacagtgagcactccctgtacggtcagtccaggatgaagtgtttcgggtggaattcctcattcttccatcgagcaaccgcctactattgatccattatcacctctgacttagtggcagaggatcccagtgagaagccggagagttgggtttcaaaacaacttcgcgtgtaagtcacggaccatcagaagctacagcaactttgagcaacattgagtgcgctatgctagtggcgcctcactcacctgagacctcgaattactgctttcagtggttggaaaccgcattctctctctgcgcttagtaggtcagtgcctgattcttaatagtagcttagtgcttgtgtagtgggcttaatataacatggatatggacagaatctttctagaatttaggcgttcctctggagaacatagatccatacttgacagaggaaggagccagatttatgctatttccaaggtttcttacttatgggactgcaaataggtctggttaggaagccctcaacattgctgagcattgtacttgtgatctccagttaaataacaaagtgctgttgaaatggcttattttctatataggtttcgttcagaagaacagaggcagaaagcttgggagaatagaacgatttcatgtacaagctatgaatggcagctcagcatcggcaattcaaaagtatcacgtctatatgaatcaggggtcatgatatctgggagaaacgttcctgagta

SEQ ID NO: 561380 - DNA, 291 bp, Homo sapiens
cccccggggccccccccgggggggggccctttgtcaggcccccccaaaccccctccccaaacaaatttttcctggggcccctttttgggtccccccccccctggggggggggggcccccttttaagcccttccctttcaaaagggggtttggggaaaaaccccttttcaaatgcccccccccccccctttttggggggccctggggccgggggtttttcccctccccccggggggttttttgggggggggggggggttttcctaaaagttgggcccctttttttcccggga

SEQ ID NO: 561381 - DNA, 350 bp, Homo sapiens
  misc_feature (19)..(19): n is a, c, g, or t
  misc_feature (39)..(39): n is a, c, g, or t
  misc_feature (101)..(101): n is a, c, g, or t
  misc_feature (174)..(174): n is a, c, g, or t
  misc_feature (211)..(211): n is a, c, g, or t
  misc_feature (223)..(223): n is a, c, g, or t
  misc_feature (280)..(280): n is a, c, g, or t
  misc_feature (292)..(292): n is a, c, g, or t
aggcgggacttgaaacagnaacacattcagccgaagccnaaagggaagcttgagaatagtttgtttggaaaacagagctttaacttgaaagctgattgccnagaaagggattcaagagaagccccaggaactccttgagcattaaattgcaggccccgggaggccctggtgagnccaggcttagccccttcttccacagcaaatctggggnagttgcagcttnttcaagcccaaggagcttgaggagagctgccagagttcccaggcaggtggggagccntgcacccaaggntttgcccatggtgatagcccacttccagttccagaagaagcagcctctagaagcaccc

SEQ ID NO: 561382 - DNA, 705 bp, Homo sapiens
tcggcgagtgtatgtactagcaccgttttcggcagcgccagccctacactcgcacgcgcaatgacctctgaaacagagctgacatgaattaatcggccctcattatgatcgacgatgaggtgacagtaacggaagaaaagattaaaaatgtaattaaagcagtagaagaaaatgttgtaataatttagcaagctttgaatgcaaaagccatgaaaaacgtattcaatagcagacttaaatgaactaaagggacagattgaacttgaatcaataatttatgcttataatgcaaggagtttataatttaattaaaattaaaaaattctgaatttaacaaaaaatgattaatttcaatagtagatttctatttaaatcttataaagatatatatatcgaacattaaataacttaaatttctctaaactgatttaattggactttacctaaaaacttaaaaacacaaatcttaataaatatttatatctctaaatactaaaacttatatacaatcttaaaaaattaataaacataaaaaaattttaaaattttattctaatatttacacttattataacaataatatcacaattatttctgtatcttattaaaaaatactctcaataatattaataatataaaacctatttaataattatttaaataataaataaattttcacaaaattatattctttatctactactc

SEQ ID NO: 561383 - DNA, 181 bp, Homo sapiens
accggctctactaatgatatacacgcacttcgcgcagtgcgtggtggtgcgcacctatatccctgcacctcgggccgctgacgccaggagaatcgcttgaacccgggaggcggaggttgccgtgagccgagatcacaccactgcactccagcctgggcaacagagcaagactctctctctc

SEQ ID NO: 561384 - DNA, 183 bp, Homo sapiens
ggaagactgcccgggggtctgggaatagcgccgtcgaatcgctgagacgtgtatcgtttatggtcggaactacgagggtatcgtgctcgtcttctgaaagctccgagttccgttcttgattaatgagaacattcttggtaaatgctttcgttctggtccgtcttgcgccggtccaagaattca

SEQ ID NO: 561385 - DNA, 1754 bp, Homo sapiens
  misc_feature (173)..(173): n is a, c, g, or t
  misc_feature (349)..(349): n is a, c, g, or t
  misc_feature (495)..(495): n is a, c, g, or t
gcattagggtactcgcagcacggagtaaggtacaagaattcaagttaggaaacgagttgatcccagcgctagtattttgtacagcgcgcaatgatgtcggattactcttcccaagtgatgagacgcggtgtgaatgcaatcgattggaagatgtgtaagtgatgtggtctgancctgaagcgtctatggtcgactcaggccatcgcattgttcatgagtccgagagaattccactagcggaggtgacttggtatgtacatacagcgccatggcgctggcgtccatcgcgagcgcttgctgcgtactgttcgtgccttatgttatgctccgtgcgtcttattattctcgncatgcatctcccgtgcgcctatgtcgcgtgtggacgcctcacatttagcataggcgtgctatgatacggacttctcgaagaagagaagttaatccgacgaactggcgcaaggtgagaaaaagacgaatatacgcccattctggggngcaaagctatagacctagaccggtcgacacatctgcttgacagagcggcttgtatacagagagccttcaccgcgtttacaccgtacagaacctaggataacgggcttggcaaaggggtcgcgtgtctgtgcttggagttggcgctgtgtcccggtaccgtgtgagaactgacacgcagggcatgttcccctgagaagtggaaaggtgagtggttttcctgggaaaaatatgttggtcttaataggagaggccccttttgttgcgagctcttacaaggtccctcggacgtgggcttgcgcggatggatttcccttgtgggaaccccccacgggctgatttaattcacccgggcaagttaagtaaagaaacaatcactacgggggcgttgcttttcaaagcaattcttccaccggcaattgggttcccccacgcggaaagggggtaaaatttttccgtgcgaaggccggttatatggccctttggaacaggtgtatttgactcagcttacaggaacaaagcaacattcgtttgtgggcgcatgcacaaacttttcctaggtcaaacttttcaagcgcggttacactcgccggttagaacacaagggtgaaacgaatgcactttcccaccgtccgagaggggcgggccatgttataaagttcggaacaggtccacgccgaaggggtaaaccttcacccaaggggcagctaacataaggggcgaggaagttggtagtaccccctattgagttggctagggtgcgggagatcaagcctctcagcgtgcagccgcgaagaacccccccagggaaaaaggctgagcacaactcatcccccaggggatagaaacgcccgccataattatctaggcgggcgctgtgggcggcacccacacatctatggggggcggacagatagaccaagacgtttgacgggagggggggtacttagttaacacccagcacccacccgtgtgattggggggttggctacgtactccaccgggggtaagcgacccccagtacacaagagcgttgttgttattggcgaaaacaagtggtgttctagttatgagaaacgtcagcgtgctgtgcgtgtctttccaccccgaagaaggtgaacattgagtgagtatagacatgtgctcgtcgcagagctgacatgagagctcttactttacatagatcgcatgtagtgtgtgccttatcatcgagcgagcatcggatcgacagcggtgaggtattatggtaacaggaggcagct

SEQ ID NO: 561386 - DNA, 129 bp, Homo sapiens
ctgtgagctggttttctctggaagccaggcccatgacagctttgtactctgaagaccacaggcattcctggtacagccctagaccctgtcccttaaactagccagcagtaggcaagaaggctgacagta

SEQ ID NO: 561387 - DNA, 422 bp, Homo sapiens
tctagccgatccctgattgcctttgtctccagaaaacctcctgagtacgaaggcttatcacggcctcaaagccacccagtcaaagtaggcactttaggcacaggaggagcagagggaaggagaagagctcaggtttacgcgactggaatcattcctacatgattcctggcggcagaaacatgacaaggtgtgtctcagacgactagaagtaaaacctcacaccttggaatcgccagataaacattccttggactttgttgtacgcgtcgaaaggattgatggtgtgagtttacgggtgcggagagccattgcaagacttaaacctaaaaatgcagcgtatagtatgtaaccttatgtgacctggggatttccaaatctgaagtctgtccagacactcatttcgaaacgtagacgacgggaca

SEQ ID NO: 561388 - DNA, 239 bp, Homo sapiens
aagaaaggaatgcgcaaaaattaatatgacatcagctggtgcctaccgtgaagaaaaagaagctgattttaaaaatgaaaggctagatagatatttctccaaagaggacataccaatggccaacacgtatgtatgtgaaaaaaggatgtaaaaaattttcaacatcactaatcatcagggaaatgcaaatcataactacaatgagatagcacttcatacctgttaggatagctattagc

SEQ ID NO: 561389 - DNA, 955 bp, Homo sapiens
cagcgcgctgctttgccgcctggtgccgcctccgtggtccccgtctatctccccgtagtctctctgcgttccccctgcttttttcccccgggcttgtctgtagtgttgtggtaaggcaccggggataacacgggcgctgtgtgtttaaaccccttgggaacttccagattctcggtgttcccctctggaagccgctgtttctcccccaaagacgggggggattttccccgatgggcctgggcagtgggaccactaaggttgcccaccggttttcgttgtcaagaggggcaaccgtctttccccatcaggtggattggccacctctgaaaatgctcccagccctgaggcccctcaaaattcttgcgacaaaagccaacccaccttttttttccccgcgtcactctcattagatgttctccaaaagccgcccccctggctaagaaggataaaacattccgggtaatatggggccacccttcattaatactacgtggcctcctcccaacttctgaggttttcaaaagagattctatgcccactcttctctgaaattgcaacgcaatattagtaacattgagcgtcctttttcaagaccgcgttctttatataccccccttaccttatattctcttgtcttctccccgatgttggaccttccttagaacacaatggtaacaacagtctttgttgcgtgtagaaaacacctatttctattctcttaatcttctacaacaatgtgctgtgtataagagatatcaaacctcccagactagactagtcctttttagtaacaactagttaaaattttttttctgtctttcagaagcccttcttgagctgtttcataaatcacaaaagggtctgttctcgtctttaaaacccatttaaaaaatgttttgaattaaaaaaaaccttgaattcccacccacaaaacaaaaaaaacagaaaataaaaa

SEQ ID NO: 561390 - DNA, 859 bp, Homo sapiens
  misc_feature (358)..(358): n is a, c, g, or t
agcgggcctgtgacatcaggggcaggacagagtggagcgaaacctcaactatagccaggcgtcgacccagtaaaaaggcaggtaacacagaaaactgcaccctcgacaacaacaacaaactaagtctggtaatcaggatctagaaaacacaaagacggatagatcagaaaataaaagaacagacaataaacagtaacctaccaggaaagcattatcaagaccaaaaaccccgaacaacacaaaacaatgaaaaaatcgaaaaaaaaaaacaccgccaaatcaaacgaaatccataattgatcaacgaaaagaggatgaataaacaagacattaagcagaggctcaaacctctaaggangcgggtaagtagaaatagaaagatacaaataaaacaaaaaaagcaaccgaaaaaatagcccaaagaccgaacgtagataatagccgataatataaagcacaaaccgcgagaaggacttaatctcaaacagctcataagtatcattaatactttaatcctatcttatctatttacaaactaaaatacatccaactattaattcaaaacaaccaagtaataatcagatcaacagatgactcgatacaaccaagggaatacctaccaatggcctaaccaactcataattatgaacaaacttctatgcgaccaactatgcaactaataaacctgaaatacgttacttaaaaatcccctaggcttatggtatatcacataagccgaaccgaccctattaatgaagaaactaagaaatataagaataaaaattaattattaaaaattttaatttaattactcttacgactgctaccaaacctgggtcactcactataaagaaaataa

SEQ ID NO: 561391 - DNA, 461 bp, Homo sapiens
  misc_feature (113)..(113): n is a, c, g, or t
  misc_feature (204)..(204): n is a, c, g, or t
aaacacttgtttttattcacagaggtaaagtgtcttttcaatattaacccagcaatttaggtggccatcttataaaaataaaaaatttcttactgtggacatccccttttccnaacttttctacataatggcttagttctgactactaagaaatgttaagaaataggccaaagtgcggggtgtcacgcctataatcctatcacntttgggaggcctaggcaggcagatcacctgaggtcaggagttcaagaccagcctggccaacatgaggaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacg

SEQ ID NO: 561392 - DNA, 264 bp, Homo sapiens
agccgaaactcacttccataaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaa

SEQ ID NO: 561393 - DNA, 175 bp, Homo sapiens
tgtctctgtgtccttaccccaatcatctcaaactgtaatccccacatgtcgagggaggggccgggctggagatgatgcatcatgggggcggtttcccccatgcgcttctggtgtaagtgagtgagttctcacaagatctggtgggttaaaagtgtttggcagccgggtgtggcgg

SEQ ID NO: 561394 - DNA, 349 bp, Homo sapiens
cgcggtgtggcggccgatgccgctataaaggcttgttttgctgcagggctcatgctcgggagcgtggttgagcggctggcgcggttgtcctgaagcaggggcgcagaaattttgaggggaaacaaacagctgggaagcctggaaccctccattaaaagaaaagaaaggatttcgccttaggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgc

SEQ ID NO: 561395 - DNA, 174 bp, Homo sapiens
ggggatatctggccccctccgcgagtggatgcgtcggcgtgcagggtgacgtcgtgacttgaacgcagagcccgcatgttctcctcgacacagtgcgccctccttgtggcccactggaagccggccaccacactgtccttaatctcgttgaggtactgcacacccttagtgctg

SEQ ID NO: 561396 - DNA, 1284 bp, Homo sapiens
  misc_feature (325)..(325): n is a, c, g, or t
gcgaagaaggaagctcctgccccattcgctagaagctgaagccaaagcgaaggctattaagaggccaagaaggcagtgttgaaaggtgtccacgagccacgaaaagaagaagatccgcacgttcacccacctttccgagtcgtgcgcgaagacacatgcagacgtcgcgtgagacatgtcccatccatatcctcggaagagcgctcaacaggagaaacaaggcgttgacacacatatgctagtcatctaatgtttccgcgtgaccactgagtctgcctatgaagaagatagtatagacgaatcaaacctatcacttgtgattcanttggtgtgcatggttatcaatgcactaaacaagacactcatgagttaaaactagggctgtgaagaaagctgtatgacattgagtgtgggcgctaaggtctaaggtattcctgattctggccgtgatggaggagaagaaggcatatgttcgactggacgtcctgattagcgatgcgtgttggatgttgcgcaacaaaattgggatcatctaaagatgagtccagctgcctaattctgaatatatatatatatatatcttttgaccataaaaaagacacaggatacataaatgctcgcaggccactcgttttcgcgggttgctgcgaccaaacgaacttgactcaccagtggtcctcgggtgccatgacacggtgttcactctggacccaaatttctgtgtgtccacaaagtgaggaaaaccattggcaggacacacgcttattatagcagaaaaccgagtttgagaatgcacgaaatagaagcccagttttggcccgccggcattctattcaacggtgtcgacaaaacacggaacagcgaatggacttaattggtggcgtcggatcaactcaaaaacaacaacgagacaaaacagagagggcactcaacaaacactatgctcaagcgctacatgaaacatagaaacatagggaaaaaggaaaaagtagacaacaaagcgtcgaaagaaacgaaacgagaacaagtgacagtacacacgagatgacagacgtgaaaaacaagaacaacggacacagagaactacatacgacggatgaatccaccgaccatacgaaggagaggacacgaaaccaaagaagaccgagaataaaaacaacgagtagatgaccgacaccgacacaactaaaatagaaaaacacgagcacagaggcgccaacacagcaagacagcccccagacacacaacagcaaaggaaaacaaacgaagagaaagaccagggac

SEQ ID NO: 561397 - DNA, 340 bp, Homo sapiens
  misc_feature (321)..(321): n is a, c, g, or t
gacgtaggactgattgaactcaggaggttgaggttgcagtgagctgagatatgccactatactccagcctgggcaaaaagggtgaaactccgtctcaaaaaaaaaaagaaaactcagtttacccaaacggcccccactcttcatattattaacaacagtcattattatcaattatggcactctggcttcagaagccaggggcttaactcatgggtttctaactctttacaacaggccccaacaggggcaagtatatagtttacctaacttttcaagaggcttagacagggttaacgctaacttccccacgggtcctaggtnctggataggacactcttgg

SEQ ID NO: 561398 - DNA, 93 bp, Homo sapiens
agaggtctacatgtgggtggggacccagactagccaggtggagatcaagctgagcctgaaggcctgccaggtatatatccagcacatgcggtc

SEQ ID NO: 561399 - DNA, 588 bp, Homo sapiens
  misc_feature (549)..(549): n is a, c, g, or t
ctgttgggttccatctttatacttgacatggaaggaaaccaggacccagagctgctgaacaatttgcccagtcgttcagcagctcagtagcaaaccaggattcctctgctgctcagggatagtgggaggtggaggctcagcgtggaagatccacagccccgcacgccctctttgtgcctcctcctgctgtctccatgttgggtgttagcaagatgaaacatgttgggtgtcttcttcccccgcaagccccagccccagatccactctccacccctctcctttcttctctgggcctccagaggctaaccttgatgggtttcatcagcaaggacttttctttgctttggccaagtagaggaactggtaggagataggaaggtgggaagagatgagatgaggtttccatgggttggctgtgtctgtacccctagcaaggccacagctgctgtggggctgcctctcccgtggctgcagctactgtctccgtggtccaggaacaacactccctccccttcaggccccaggtggtgacagtcctggctgtggcanccctggtgcatagactcccttgttagtttcctataaaga

SEQ ID NO: 561400 - DNA, 347 bp, Homo sapiens
cacatgtgaaatacagcatgagcgagaccacactcaggttctgccctctctgacccagtttacctatggcctttgtcacattgctgcagggtctgccatcattcactcacctgttcaatgtccccacctcatcctagcacagcagatataatccatcgactctactcccgaaacatgcccttctcataaccacataatcgccacagccctggtccaagccaccgagaggctctgacctggaacctggtgacagatgcctggcttggtcttgctgacccaaagtcaccccctacagactgtacttttgcttatgatttcctggcctcttcgaatctgggaggaagata

SEQ ID NO: 561401 - DNA, 353 bp, Homo sapiens
ccccatggaatcccattcagcactgtaaagaaatacgctatcaagtcataaaaagacagggaggaaacttaaatgcatattactaagcaaaagaagctagtctgaaaaggctacatactttatggttccaactatatgacatgtcaaaaaaaaaaagcaaaactatggggacaataaaatgatcaagggttgcctgagaattacggggaaggaggggatgaataggtggggcatagatttttaagggtagtgaaactactctgtatgatattataatggtagatcattgtaaattggcctaaactcacagaatatacaacattctatgatttacccctaatgtaagctatgaa

SEQ ID NO: 561402 - DNA, 1031 bp, Homo sapiens
  misc_feature (72)..(73): n is a, c, g, or t
  misc_feature (79)..(79): n is a, c, g, or t
  misc_feature (225)..(225): n is a, c, g, or t
  misc_feature (238)..(238): n is a, c, g, or t
  misc_feature (285)..(285): n is a, c, g, or t
  misc_feature (334)..(334): n is a, c, g, or t
  misc_feature (382)..(382): n is a, c, g, or t
  misc_feature (384)..(384): n is a, c, g, or t
  misc_feature (390)..(390): n is a, c, g, or t
  misc_feature (401)..(401): n is a, c, g, or t
  misc_feature (407)..(407): n is a, c, g, or t
  misc_feature (416)..(416): n is a, c, g, or t
  misc_feature (436)..(436): n is a, c, g, or t
  misc_feature (457)..(457): n is a, c, g, or t
  misc_feature (464)..(464): n is a, c, g, or t
  misc_feature (468)..(468): n is a, c, g, or t
  misc_feature (472)..(472): n is a, c, g, or t
  misc_feature (490)..(490): n is a, c, g, or t
  misc_feature (523)..(523): n is a, c, g, or t
  misc_feature (531)..(531): n is a, c, g, or t
  misc_feature (534)..(534): n is a, c, g, or t
gcatgctgagctggttactgccatggaggggagctgagatgtgtgtggctgctctctgtgagaggcccaggnntgccancagtaccgcaaggaccccaaagagtgctgcaagttcatgtgtctggacccagacgatgatgcttttgagcctgtggaggtcagctgccagcccctggggatggtgggagtgaaggtgcattactccggcgcctggagcagctctgnccactgcgggggnctctctggcagacctggaagactctgccgacagcagcagcgccctgntcgtgcccctgaccctgccagagcgggagcaccccagctgcagaggcanttgcagggggtggcgcacagcgagtccctcaatactgtggtgtagacngnctggcntgtaccccaancggtcntgggagcanctgtctgttgtagaaaacancggtccctggggagacttganaggcccntgtnccangctggacgccagcactgncgcacgtcactggcgggctcgcgtgtgtacatngagaccanagnccgccttctgccagaagaagtgatggcctgcaccgagcttccttgagggcttcagaaacatgcatagcttggatcactgtcttctaccttataaaatggcgcaagagtgacaaattcattcagaccgccaatgttagacgcagggaatgacgaaggtactgtgggccatggcaacctgatgcgtatggtgggtaacttggtgagatgttctgtcagagagaacgttgtgaccaagttgggaacgtgacctgtgggagtgcacggtgcctttgagggcgctatgaggtgctttgaacggaggtttggtagagtggattgtacggagggcctctcattgtgaacggctgagttgatgtccgagggtgtgatataggtgacgtgcgtgggatccgtgtttactacttaagagtagagggtagaagagtgataggaggaaggaggtacggggcaatgagaataatggggcataaggaactaagacgtaggggtgtttttct

SEQ ID NO: 561403 - DNA, 328 bp, Homo sapiens
ctggtgctctagacggatctttgtacgaatactccatgagatccctttttagatgccacgtgcatgaatgtaggatgcccagctttttactgagtgcttcttcggtacggaggtctgagctgatagtggggacggggattgcgaggaagaatgaggtatgttcctcaagggaactgactgtctccctgggaggtgaagacatctgtccacggaaccacagaactattcgaagctgtaaccaagtgtagggggctgatgccgacagagcccctgaggggacacttttagagtgagcccttcatgggcagcatctgcaggccgcgaaggc

SEQ ID NO: 561404 - DNA, 150 bp, Homo sapiens
gggccccccaggtcagcttaatttttttgttttgtttcttaagacagagttttgcttttttgcccaggttggagggccgggtcgcaatttcagctcactgcaatttttccctccgggattcaagcatttttccttgcctcagcccctcca

SEQ ID NO: 561405 - DNA, 398 bp, Homo sapiens
  misc_feature (28)..(28): n is a, c, g, or t
  misc_feature (64)..(64): n is a, c, g, or t
  misc_feature (253)..(253): n is a, c, g, or t
  misc_feature (280)..(280): n is a, c, g, or t
  misc_feature (286)..(286): n is a, c, g, or t
  misc_feature (299)..(299): n is a, c, g, or t
  misc_feature (305)..(305): n is a, c, g, or t
  misc_feature (375)..(375): n is a, c, g, or t
  misc_feature (385)..(385): n is a, c, g, or t
cccacaataagttaataaatttaaattnaaggcccattaatataatatgagtgatgttttgttnccgtttttgctgaaactaaattggctgtcaaaaaatggacatgtcccagagaggcaaatccacagacagagagagaatagatccgtggcttcccaggggctggggaaggaaagaggcatgacgggctaatgggtatcaggtttctttttggggcgatgaaaatgttctggaattagacagtggcaatgngtgaatctacttaaaaatcaagggcanggtgcnaagcgtcacgccntgtaancccaacactttgggaggccaaggtgggtggaatgcttgagctcagaagtttgagatcagcctggggaacnatggtgaaancccaacccttaca

SEQ ID NO: 561406 - DNA, 601 bp, Homo sapiens
ctgtgtgggcccgtgggttcggtgttgggctgcgggtgctcgtctttcgtgtgggttttgcgccctcggttgtgggcccgattgcttgcgtttggttgctccgcgtggcgttgcaaggatgtctttgttgtgtgttctctggtgaatatgcctctcctttgggagttggttacaagttggtaacatttatgggagatttttttcccccctcgcttccaaccccttttgaacagagttatataaacggtgtacagatcacccgttgtttaaaattatgtgcgctcgagctgtgatatctgccctctctcgatggtttttctcgtagcacgattttagcctgccagattcatacgtttattttattcttgggcgagtgtccgttctgtaaccgccccccttcttaatcactcctccactgcgctagaagaatgtcggtgcgatattctctttttgtgcgagaactagggagcgcctattatcccacactgtctaaagagagtattacaatggcgcgagagagaacacccccacgttttagaagttataggacggtggcaccacacacagtgcatacaacaaacataatcattatacaaaacat

SEQ ID NO: 561407 - DNA, 154 bp, Homo sapiens
caatgtgtgttaagtcccttgtttttttttccaaatgtgccccctcaagttttaagctggccgggcccactcttggctccttggtttgtcccggcccttttttggcttgggtttcagcccccctcttagttggtgccccccccccccgagatta

SEQ ID NO: 561408 - DNA, 1353 bp, Homo sapiens
ggcgcgtggacagcgcccgcccgagcctgccccggtgtgctgccccgctggcttgtgccccgctcggacccagtgtctgtgccgttccactccccgtgctggagtgccccgtgctggactgcctagatgctggtgtctgcaacttgaggcgttatcctgctgggcctggccgtggggaaggtggcggggaggaagaagaggctggtcgggactgctgtgacatgtgagcattctgggaatgattcttactggtgccctttcactgctggtgcctatgtgacggagaaatgccgcgcgaaaataaaaaccatcccccagaagtaagtttgtggccggaactaagtcttaaactagtggcgtgtacggacttgagggacaagctctgaatactgtttcgctagtcctgtaagggccgacaagtgccactgacagacagacaccttggactgaaggaaggatcccgaagatacatgatgacatggggcttacatcttgtgaactgagtcgactttccaaatggctacaggcagaagaaccaggaaagtggtcaaacgacctgttatgcaacgcacaacctagaaccttagacaaaaagcacgatgcaaacgaaagattgcagcacaagagggtagaaagcacggtccataactggcccattgtcctcacccggtcctgtacgctgcaccgacgccgtcggccttcctcgcactgttcgcacccacgcgccactctgccccggtactaaccacgatggcacgcgctcccgcgtgtgcattgcgccgccgcgcgtgcgcgcctcccgcggccagcggcgcccctgcacccacccccaaacgcgtgtccacccgccacacggaactcggtacgccgccctgcccgtcgccccccaaggcccaccgccaacacaccgcgcgagtccacggagcccgaccaaatacaccctcccccacacacccgagagcacccctgagacccaccgcgcagagcacacagaccggcgacatgcccacacgactacgcccgggccggatcaacaggcgccggagcccgccaggcacggccaacaccaggcggcgcaccgcccccggcgccgaggagcgggaccccccacgacgcaccgaggaagaggtccacccgcacgcgcacagacgagacaggcgggaagggggcagtaggatgagtaggagagcgatattactcaggagatacacagaggggtactcaagtgtgagcaaggcacagggtgcaggagccgcggacaggtaagataagaggagtgtgcacaggcagtacatagtgacagagtagtagtcgaggtaatatagcaaattctgtcagggtatgatctttggg

SEQ ID NO: 561409 - DNA, 203 bp, Homo sapiens
tgaaacagaagagaagagatgtatactattatgacacaaacacgaggtaaagagggcaaactagacatgtaatgcataagatgcaggaaaaagtgcagagcataaactataacccttttgaccagaaactttatgtctataaccgatggttaccttctgaacttatgactctttctggtctcgcaggaagccccaggtaagct

SEQ ID NO: 561410 - DNA, 843 bp, Homo sapiens
ctgttttcagaacttccccagctggataggttattaccagccctcttttctgaactcgatgttaattgtcccaatgatctattttgtgaccacatattcttaacacccgttacacttcccgccctggccccctttatagggatggaattttgattggaccaggggcccacgataaggtgtagcaggaagagccacttcttcaaagttcaggcttcttggtcccgacatttccaaagttgtctatgagggacattttaaaagtgaaattttatttttagaccattgccttaaatgtttatttatattgactatggggacttttggggcccccctaaattttgcacttgaaatgggatccccacctgtgtcaccccatagtcccgcctggttttaggatgcgggattgaggccaaggcatcaggccagtatatgaagccaaggtttattttttggtgtcccgattatccatagctccgtcatgaaatctatgtctttctatttttctcccttctgccatagtccctgcctcggctcatcagcccatttagctcctagaaagctggggtcatctcgtattccccagcaagtaccccagcaccagtgccggttcagagcaggtgctccacacacattcctgggatgagaccagcaccagaaatggctctcgggagcctcggatgctgctgggagtaagtgatcccggaccttaccgctaagaggagaaactttttttcaaagcatttattaatactccctccacccctcactccaccaatggggtgatcaacacttactgcttgctcttgttctgctaatgattaaaaccactttattttaatttga

SEQ ID NO: 561411 - DNA, 824 bp, Homo sapiens
  misc_feature (32)..(33): n is a, c, g, or t
  misc_feature (303)..(303): n is a, c, g, or t
  misc_feature (425)..(425): n is a, c, g, or t
atataaaaggcgccccctcaaaaaaagagaanntttttttttttaaaaaaaaggggggggggggggggggggggttaaaaattaactccccacccaaaaccttctttaacccagcaaaacttttttttttttttggggcggaaaaaaaaaaaaaaattttttttttttttctaaaaaaaccccccgccaaagaaaaaagaaagcgcccttttcttattgaaggaaagaaaaagcccccctctcccggcgaggagggggtgtttcccctccccccgccggctgaaaaaaaaaaaaaggcatttnggttttttttggtgcctccccccccccctttttataaaaaaaattttttaagggggcccccccccctttttttttttaagggggcgccaaaaaaatatatctcaaaaaaaaaaaaaaaaagngggggtttgtttctttataaaaaaacacaatattatgggtgggagagagaaagagggggggggaaacacaaacaccccacccccccgccaaaaaaaaaaagggggggttttctcccccccccccaaaaaaaaggggggggggaatattttttttggggaaaaattttttcaaaaaaaaaagggcgccccaaaagcggttttttgtgggaaattttcccccccccaaaaagaaataaaatcttatatggtggggggcaaaaaaaagtttttttttttcttaaaaaattccccccccaaaaaactttttttcccaattcggaagggatatgggaaaacaatttcaagcccattccatcagtggattggccacgtggaactcttatttttttctggggccga

SEQ ID NO: 561412 - DNA, 110 bp, Homo sapiens
tatgtactgtcacgtgggacgttgacggacctggactaccggcttacccaccactcctatccactttctaacgactttttctaccacgtactgacgttactcttactgtt

SEQ ID NO: 561413 - DNA, 179 bp, Homo sapiens
tcttaacaaccagctctttgcacctggatggcgactgagctggggcaagggcagcagcggagtgctcatgagccaagccctcagacgcagcatcagaagctgctcacccagcaaccagaactttgaatcgcttctcagcccttcaacaagcagtacccacagaaagcacagataataga

SEQ ID NO: 561414 - DNA, 854 bp, Homo sapiens
cccccctgtgggtgcccttctgccacccgcgggtcgagttctccagttttccgcggctggggggcggcgttaccccgggccaattgtagccgcgggctctctaaaaccaactctttttggtctttctattttcgtccccggttatattggctttggaaaggcgctgacgccccttttcccccggaatggcccgagggagtaaggcgcgcgaggtgtcatcacgcgtttttcctcggagagtgccgcaaccacggcgcttggcggccgccgcttcttttcccgggagacatccaagagaaccgccccgcgctggagtaatggaagttgggggttagaaccccctcccgaccgcgcccgggttacagacgtgccccatgggccccctggaagagaaaaaacgctgtgacaccacggcgcccctttggaattcttctactgcccctggggtcgtgccccgcgcccggacgagccccccatcttctctggtgacagcttctcctggagacaccctacactttctcctatgagtgaaggagaatgtaaacgctttattccagaaaaatgggagaaaccacccccgagcccaccctcataaccacagtggtgggtggccccgagggctgtggctgggcgagataatctcttcgagaaagcgtcacactctcaggccccgagcttagaggccctctgagaggcccacagccgagactttttggaaagggccccctgccaaatatataagggcttctgcctaaagcctctccctccacaccccacatatggcacgcttttttaaactatcccaacacaaccctgggcccaaagggaaaaaaactttttgaaaccaaaaaaaa

SEQ ID NO: 561415 - DNA, 129 bp, Homo sapiens
cgcttggagttctagcactccattgtacaagctctagacagctatgatgcagtcccacaacgcgccagcatccccagcgtctgggattccttgtttctgctcctgtggcctccacgagcccgcgaagag

SEQ ID NO: 561416 - DNA, 312 bp, Homo sapiens
  misc_feature (3)..(3): n is a, c, g, or t
  misc_feature (10)..(10): n is a, c, g, or t
  misc_feature (19)..(19): n is a, c, g, or t
  misc_feature (36)..(36): n is a, c, g, or t
  misc_feature (63)..(63): n is a, c, g, or t
  misc_feature (65)..(65): n is a, c, g, or t
  misc_feature (80)..(80): n is a, c, g, or t
  misc_feature (159)..(159): n is a, c, g, or t
  misc_feature (163)..(163): n is a, c, g, or t
  misc_feature (166)..(166): n is a, c, g, or t
  misc_feature (173)..(173): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (212)..(212): n is a, c, g, or t
  misc_feature (216)..(216): n is a, c, g, or t
  misc_feature (264)..(264): n is a, c, g, or t
  misc_feature (267)..(267): n is a, c, g, or t
  misc_feature (285)..(285): n is a, c, g, or t
ggnagaggcncttaatctntaaccccccaagggggnaataactaagagattcttcctaggggnanctggtggttgtgccntttgtaggctggtccctttgccttaaacctgaagatgtccccccaagcctgtgggcagcatgcccagattcccagaccntaanacnctgtganagttgtccctgttggnccnctntgtttagttgcaaggantttnccatgtgtggtggtgttttttgttactgttttaaagggtgcccatttntgntcagcattgtgacttggngataataaaatttagactataaacttg

SEQ ID NO: 561417 - DNA, 244 bp, Homo sapiens
  misc_feature (13)..(13): n is a, c, g, or t
  misc_feature (35)..(35): n is a, c, g, or t
  misc_feature (87)..(87): n is a, c, g, or t
  misc_feature (207)..(207): n is a, c, g, or t
tcccctttctcgngaggctccccaagaccctggcnatgggatggggctgggattcttctcttgtgaatccatcccctggctaccccncaaccctgggctaccccaaacggcatccccaaggcccaggtgggggccctcaagctgaggggaaggtacgaaagctccctgctgggaggcctgggacccaatggcacaaaggccaggcanggcccggaggctgtgggtggggccctcaaagtggggg

SEQ ID NO: 561418 - DNA, 158 bp, Homo sapiens
tcaattgttggataatatttaatagccaatgcaactaatccagatagaagaccttactctctggattagttgcattggctattaaatatttatccaacaattccagcaccgtgatgcaggatggatctcagctcggactccactttctcccgatagtc

SEQ ID NO: 561419 - DNA, 352 bp, Homo sapiens
tgaccacctgtgttagttgtgctgataccacatacggaccaattctaggatacttagtacgagactgttacactactacttatggtcttaccttgggattgattctttaccttgatgtatatttaatgggatggagtctcgctatgttgcccaggctggccttgaactcctgggctcgtggcaatccttctgcctcagccttcccagtagctgggtcactgtgatgcatttgacattgacattctgtgcatgtgtcacagcacgcagccagcctgcacgagccaagcaccagcatggggcagcttttgttctgcagacacattcgtgcccttcactgaacttgggtctggct

SEQ ID NO: 561420 - DNA, 112 bp, Homo sapiens
gcgaagaggagatggcggagtcgttgaggtctccgcgccgctctctgtacaaactagtgggctcgcgccttgaaagaggctttccgcagagatgtctgagagattgagaaca

SEQ ID NO: 561421 - DNA, 514 bp, Homo sapiens
  misc_feature (1)..(2): n is a, c, g, or t
nncatgagaaaaattgattcttccaagaaaactggacaccaagggaggggtggtttggaaacagaataggtgcccctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaatttaaaaaagaacaacaggatagagctgttgggtggcacagtggcccaaaagcagcttagagaaaattccttggtctatgacccctgttaaactcaaaatacagtcggacttgatacatcatttgtaacaattgagaaaagaaaaaagtttggttgggaaaacgatttggatttgggtaaaaaaaaggaccaagctttttgtctgtaaacatgggtgaaccgggggttgtggaaaaggggacactggagagca

SEQ ID NO: 561422 - DNA, 263 bp, Homo sapiens
gttctgtctgacggcatagaatagaatagctagagtagaatagaacacagtagaatattttagaacagattagaatatattagaatagaacagaacagaacagaatataacagaatagactgaacagaatagaacagaatatcctagaatagaatagaatagaacagacgagaacacaagacaacacaacacaatactccagactatatagaatagatcagaagcgaatagaacagaatcagaacgtaagacattaccgcggg

SEQ ID NO: 561423 - DNA, 329 bp, Homo sapiens
tcggccctctctgactcccagattcccgagtggatgggactgcaggcgccgccaccacgcccggctaattttttgtatttttttagtggagatcgggtttcaccgtgttggccaggatggtctcgatctcctgacctcgtgatccacctgcctcggcctcccggagtggtgggattacaggcgtgagccaccacacccggccaaaacttggcatgtttaattgctggcaggggggagacaggagaaagaggctgaagactgagtaggtatggcaggggatgtgcagcggcttgggggagagctgaacataggtcgaggggtctcagata

SEQ ID NO: 561424 - DNA, 141 bp, Homo sapiens
tgcagtccaaagcataacatcatgagccactggttttcccgataagcacacagaaatatcctaacaagtaccaccattcaacacagaacacggaggttacctcacggtacagagagcaggcacagtctgagccctgtaggt

SEQ ID NO: 561425 - DNA, 411 bp, Homo sapiens
  misc_feature (16)..(16): n is a, c, g, or t
  misc_feature (39)..(39): n is a, c, g, or t
  misc_feature (118)..(118): n is a, c, g, or t
  misc_feature (333)..(333): n is a, c, g, or t
  misc_feature (389)..(389): n is a, c, g, or t
ccgaccacccacctcntcctggctcagctcggtgatgantaagtgctgatggtcttggtcccagccagggtcgtgggggcggccactctctccaaagcatagtcataggtgtcatganaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctnaggcaggagaatcacttgaacccaggaggtgttgcagtgaaccaagatcacaccantgcactccagcctaggcaacag

SEQ ID NO: 561426 - DNA, 245 bp, Homo sapiens
ggtatgatctgggggccacaccctgtgccggtggcctctgggctgcctccgtggtgtgaggcgggcttgtgctcatggcacttcctccttgctccaaccctgcagcaggaaggctttcctgaaacaccagtttatgtaaatattcttgcaagttgttacttaggagcctgggaggcaggggtcccaatgctccagacttgttgtccgagtgtatataaatcgtggggaatgccgcctcggatgct

SEQ ID NO: 561427 - DNA, 131 bp, Homo sapiens
acaggctgacgggtccccaggtgttcctggtgattctcagggtcgaaggtcgacggctgaccagctctgacagatttctaccactccaaacgccggctgatcttctcgcaagaggaagctctaatccgccc

SEQ ID NO: 561428 - DNA, 125 bp, Homo sapiens
ggactcctcaagcagtagtagtgagtcttattacaattcactgtaagacaatatacagaattgaatactgtagaattctgtttctttaacagtagcagggaaatgtaaactacaggtgacaaaaa

SEQ ID NO: 561429 - DNA, 164 bp, Homo sapiens
gccatgcaacaagatggaactatgagcatctccccattatcatgcaggcaatcaccacatttgttggcatcccaacgatgccaaatggatagacctcacctttcatatcgccctcctccacaatcttcctaggaacaacatatgacgcactctcccctgaactc

SEQ ID NO: 561430 - DNA, 702 bp, Homo sapiens
  misc_feature (640)..(640): n is a, c, g, or t
tttggctcgatttattgatacttaagggccggggaacacgggttcagtaaaagggaagccctattctccctaatctgtatttgtgggcgcttgcggttgggcaggctagtctaaggaggacgataagtataaagatccatcttgtcatggtggtggtataaagagaaaaggataaatttatccttcaaaaatcatatgtcaatctatagggggagggggacttggcgggggcggggcggaggggaagatagaaatgagcaaccttattcttctcccctcaccgctcgggcgcgcgcgggggggcgcgcggggcgggtcgctatcattggggcgctggcggttttcagcataaatataaggtcacccagcggtttcgcgttcctcggcgaatttttttctacctcaaaaacccaaatccactccttcaatgtccgctatgtcagttgcgcggtttgtgagcgtatgagagaatagatggcatcgcgttcaagagcctggaccgtctgtttcctcactccttacctctcggtaatcagggccgggatggggatgtattagagtcagaggaaggagttaaggagatcaataaggtgtactaggagcctaagagagtgttgtgcatcagcggtgaagggaggcnagggagatacgtatattgaggcttatgtatgctcgaagcaaggagacgagccgagggagcag

SEQ ID NO: 561431 - DNA, 1340 bp, Homo sapiens
ggggcggggcgagaaaaacaaagcatagtagctcattcctgtaatcccagcactttggaaggccgaggcaggaggatcactggagtccaggagttcaaggctagcctgggcaagcactaagacactgccctttacaaaccaaaaacaccaacacaaattttctcccaggcctctgcgcgggctccagtgccgcgcgggcccctaagctacctctgcggcagactgtggggccccggcccttctctggcccttgcagcccccctcgcacgcgttccaccccccttgcccgtcgagccctttgcaccgtggtgcccactggcctgctctcccgcccgtggcgcccttcccccgccctcgccccccttgcccctcgcttccccacaccccgctgagcttccccccacccgctgcccacttgacttccccattagcgcccccccaccccccccaccccccgtcagcgccgccccccctcccgccccaccccccccgcgccctccactcgcccccactcccgcggccaccaccaatgcccacctcttctcaacattctcactacctccccccggtctcacccccccttcactatggcactcctctccacgtcacccgctctcccgcactcccctctataacgggggcgcatgcccccccccgtccgcggcgccaccgcggcccccttccgcgccccccggggctgctttgcctaccggccttccccgttcgcgcgcgggtttctcttctccccccccgcctccctcttctgtgccgtccctctccgcgcgcccccgtcttcctgtgccgccctcccctcgggcgcccccgcccgtccccgcccgaatcttccacggcttctcttttctcccctcccgcacccccccccccccccccaccagtggcgtccctccctctcgtccccccaccctttcccccaccggcccctctctctcccaccaacccctatcacctcaccagaactccacctccactacctccacccctcccccaaccccctctttccccctccactatcatacctcatcccttccacataaaccacaacgaaactaaaccactcccccatactaaccatccacaccgcacctttcccccccccccacaacccaccatacaccaacatcaccatacaacactcactactcatccttccctcccccacccccccacccaccatgcctccaccccccactccccctctctcccctcccaacactatataactccacactacctctccaccacaccacctcaatcggactccaaaccatcatcgaacccaccccactacacacacacaaccatcctccccctaccgtcaa

SEQ ID NO: 561432 - DNA, 2081 bp, Homo sapiens
  misc_feature (2081)..(2081): n is a, c, g, or t
gtgtgaagcttgaaacctgtgagcctggtcctgctgtgtgctgtgctgtgtgactgccgtgtggtgcctgtgatgtgtgtgctgctgctgctgtgctgtgctgtgcactcccaatgactagtttaagtgctgctgtgatgtgcatgctcatgtgctgtgtgcacactatctgatctctgtgagtgatgctgtgatgtacagcttggtacttggtgtgagctgtgtttgaagtctgtgcatgtgatgtgctgtgattgtgctgcatagacacttgtcaatgtgtgcctattgccatgtgcacaaccttgtgatggagatttgattactcattgagattggctgtgaagaccatcatgatatgacacacagagaacaccctggatgaggtgaaccgttacattggttgacataccctgacaggttacatcaaaagaccggaaagacttctagcctggcttgatcattcctcagcctaccaacttccaacatacgaaagactactagacaactggcttgtagccacactttgagatgacactcataggacatgtggtttggcaccatacgcatggttactatgcaccatcatggtaccacggaaatgtactttcccaatggcccccttgatgctgtggttttgaataggcccacgccgttttcagcacgatagaagacatttccactatgaagaacataagagtaggagagaattcacaaaacggacgaagaggttattataatgaagtatcctacccgaaattgtgtggcgaccatatatggcaatttataataagcctgtttgtggactagttattcattaacacaaacaaaaatttagcagagacaataaaatctatgttggggaagcaagaactagttacaacaaaagacagcatatatggaacatatacaggaaaaacagccaaatgggtatatgaaccgccaaagagagataccgcgacaatggagatcaaactggtgtagcattagcagagattgagggcaaacggattaggacattttccctttaccaaatggatggcccccaggtcgcaatggtgaccatgtgagccatgtgatggaaaagcgtttcaattttggtataagacagagaaacggccaccaccgattaccatgttattgggacagccgttatgcgtcaaacacatctatggcggtccgacatcagtttcgacttatgaactcagcgacaaatcgagcacgcagtttcacccccccgagacaagaggaaacagagatcagtggaccgcaccactctacatgtgttgagacatgaacgcacgattccaccgtgggcgaacaacaaagaggcacccgatttggataagagagcagggcccagcggatatggccggatcatcgggcacactgtaggcagcacagaatgaggcgagagcaacaggcctggacacacagagcgacaactgacacaggacagcgtgagcattaaggagcacgaccgaagagagtacgaacaagtagtagaaagggttaccaggaagaaaacggtaacgtacgcaacgcgtatggccaacttcctcagcgatgctacaggactacgctgaagagtactccaatcacaaaattctactacaataacgataaacacacacaaaatggagtattgacatatcccacacaccagatcaacactaactccaacaactactagagtatctattaaaacataataaccaactaattctgcgacacgcaacaagatctcagcccaaaactaccacacttaataatcattaataactagacttcacccgaatcacatcataaaacatatcacactaacaaatagtactaccaacatatatatatcaaatagacataactccaagcaatcaacaaaaacaacactatatacagatcatccacaagattacacatacccactcatcaatactcaacaattaagacaatatacatagtaaaatacaaacataattacatcaaatcaatccatagaacaatgttacaactaatacaatacgaaacaacacaacataccacacgacatctctatcatcaacatatccccaaaaatcatn

SEQ ID NO: 561433 - DNA, 252 bp, Homo sapiens
gctgctacagagcgaaactacgaacgcatgctgccatgggtattccctcgccgagcgattggcgtaatccaaagaaaaagccagccacaaccgctgatgctgaccgtctataccacgtcaacccctccttcgtagacctactgccgtgggtagattacctgcctgcagaaaaagccatgctgttggaagacggcgtgtctcgtgctgccttttttgagctgacaccgatgggtactggcgattagggttagt

SEQ ID NO: 561434 - DNA, 1447 bp, Homo sapiens
  misc_feature (1447)..(1447): n is a, c, g, or t
ggttcgtgcgggctggttggcattgagcgggaccgtgagctgaggcaggaagagcctggcgccatggtggagaagtgaggaggctggcggcggcattagcgaggagtgaggcggcacagtatgaccgtgcagatccgcctgtggggacttggaggcccagaaacggctgcgggcctctacgaggtgcttctatgtctgttgcttagaacaggacttgtgggctgaaattgccaagaatctacatactatggcaggagtgaaaggactgaccatgctggatcacgaacaggtaactccagaagatcccggagctcagtatctagcttacgtactgcgtctgttggccgacatagggctgaagcctcttatggagcgagctcagaatctcaaccccatggtggactgtgacggtggacactgcaggatatacgagaagacaccagagctcatctcatcactacaatacacagcatgacatgtcgatgctcatgacctcatgctcgcatccaaggggaatagtcactacaactcacacgatagaccaggactcgtggaccaccgaagtacctccggaatacacggatctcaacacagcacgaacactgactaatggatagccactgcactaccaacaactaatgaccacaaaccataacgacaagccagttccatactctagcatccatgaacacaccaacctaaaaaacatagccacacagtcacaccaccaacgaacaatactaaaacaaactgaccgacaccaccacacaaataactcaccaaacatgtaaaacatacataaagaaaacacaaaatacacccaccaattaaagccgactgcctccaacaaataccacctcgataatacatagaacacaccccatactcaaacctatgacacttagtacatcaacagcacacacacaaccacaacacgcaaccacacgcaacaccagcaactccgacatcacaacacactcagcatacaccacacaacagacagtactcatcatgagtcaccccgaactaacaacaactaaaaacacataaatcataatcatgcataccgactacaaggcagaccaacagatcaggaaaacaatacgacacatttcggcaatgacatatcgaaacagtagcacacacgaaggatgactcagactcgatcaccgaccgcacccagcaccgctagacacgtatccaccgagaccgcgaaaacgccgcataaatacgagatgagaagactactaacagatgaaagtaacaaacacagtcaacaaacgacagtaaaacagaaccacatagactcacatatccagaagaaacgcgaaagctcacagccgcctcacaacccgacacgcgccaactcaagcaacgactgaaaaacaacagcacacagaaacgctcacaagacgaagcatactgtcactactatccaacaacccgn

SEQ ID NO: 561435 - DNA, 682 bp, Homo sapiens
aagacgtcacagccatcatggtggcaggccctaaattaatcacgaaacatctgaagattgaaagttgtaaaaaaaaaaaggggcaaagaaataaatatcaccaaagaaaaaagataaattgtagcttaaatataaaactaaatcaccagtaaataaaactatacagatctaatacaaaccaaaaccagcctgaaagacccaaccttaaaaaatggctaaaaaataaggcataaatctgcataatattgagttttatttccattctctcctttcccctctactatgtatgctttacctgatctgcctctaggggcttacaagaaaacggtttccggtatccgtcttcaatttgacctcaaatgtcctgagcaaagtttttgttattctgctgagggttcttatgttggtaagctttagaacatcattatttctactaattcagtagttttgatcgtagcgccaaatttaaattcttccactggttcttctggaaggaattaaaacttttacagtgccttgcctgcacagtattctgtttttaaaagagaaaacccaagcaaaatctattgcttaaagaggttcttattttttaaacaaacagaataaccttgacaatttaaaacctgggagaaccgtcattagaactcatttcttaccggaagaataatactaaactgtctga

SEQ ID NO: 561436 - DNA, 591 bp, Homo sapiens
  misc_feature (564)..(564): n is a, c, g, or t
  misc_feature (575)..(575): n is a, c, g, or t
aattcgcggccgcgtcgacgtcgacgcgaaccacgcataccaaccgtaaatattcgcggcaaagaaaaacacctgtaatagcaggctggcatacagctgaatctgaaagaaaataatgccaaacaaggtgacgttgatcaggccaaagaagtagttgctgatcttctccagactggcaaggccaatacacagcaacccggcgatcgtgcctaccgcttcgatccatgagagatcataaccgcctgcccctattggtatatgtaccaggatattctgcacactaaatccatctttcccccaaagcgtaacgttacgccttattatcgttatccacgtatgtagccgcaaatccagcatacgattgagcggcaccagcgccctcttctcgcagcctttcatcaacatgaacctcgtgattgcttccttcctgttctaatgcctctgcgatggcctgaaggcattcatggccatccaggacaatgcgcgcagtgcggcaggttgcaacctcaactgcggttggtgctccagtaactcttatctggcaacgctggctgcatttgtagntaacccgattngttgccacatgctctg

SEQ ID NO: 561437 - DNA, 1810 bp, Homo sapiens
ctgtgtgtgtggtctggccgtatgtctatctggcggtcgtgttgtgttgtcctccgtcgtcgcccgcccggttgttagctacgcggcgcggttgtgtctttgttgtgggggcggaattatagtggtgtgatagtgtcttcggtgttgctgtttgttgataagagagctgtgtggtgcgcccccgccgcgttgttgggtagaggtctcgctggtgttaagtaagataggttggtttgtttgtcactctagggtgtgctcgtgcgccactgcctcgtgtggtaattgaatagggggggtcacgcccatcttctctctcccgtggggtgtatatagatagtaagtaaatagcggggtggttgttcatcacccgcggggagataaaaataggagttgatgtccgcactcgatgatgtatccgcccccctccagtaggtgtcttgggtgattaatcccgtgaaaatatagtgatgatgggacgaggagtaagaaaaatgggccgagggggtcgatgtgtcccgccaccccgcgtgggtttgctgcctcgcgtatgagtgaagagaggagagagaatatggtggaaagatcgtataatcattatgttggtatgtctccatcagatgcagcactctgtttgtggtcgttgtttctctttgtagaggtccgccccccaaaagtgggctgccaccacagggggaggcggccccccgtgttgttgtggtggtgttcaagacctcctggtggtggcgctcccctacgtggtagttgtacgcccccctgcgtgtgggttgtggtggtgttttgtgctggagagtttgggtagtatttgtttgttgtttatgcgcgtcgcgcacatctaggttggtggtcggcgtcccccacacgtttgggtagtgggaggatgtctcacgcctactccgtgcgtgctggttctgctggttgttggtggccgcatgcgtcgtgggcgccccagtaagagtaggtgtgttgttgttgtgagggtgtagtagcgcaccaaccttcttgtggtggaagtagttataatagtgggagcatcccgcggcgctgtctggtggttgtcgccccccactgcactggttgtggtggttgaaatcttgcctgccaccagcaagtagttagtagttgttgctgctgctggttgtggcccaccctgcggaagtagtaatagaaactacctgctccacactgtgtccacggtagactcttctgctgcaatagtgagagcctgtcgccacagtagtgttctcacttgtcactccttcgggtgagtatattgttgtgtcgcctccggccgagatctctgtggacacacacaggctcggaagagagaagatagatatatggcctctctgtgctggcccctagtgtgtgtcgactactcctctgtgttgtggaagacccctacgcacactgttagcacagctgccgcacactgtgtctgtgtgagattctcgggggtgtctttccgcagaggccacacagagagcttgggcctcttgtcccctggaagtgtccacacatatgggggcacggtgtggaactatcgcaggttcacaagacacacactcggcgcgagaaactggaatcctcggcacgccgatggaaacccacgaacgcctggtttcgaagaagtaactttttcctggtgaagggggcctttcccgcacatttgggccaaaccttccaattccgggcaagaatttttcaatgttacattttttgccctcccctaactgcctgcccctgcccttcagggaaatgggggtcctttaaggaaactgaaacccagtgg

SEQ ID NO: 561438 - DNA, 156 bp, Homo sapiens
tggcatctagcaccaagtaacatcctttccataaaagttttccaataatcattattgccccagacatcccatccagcaggacatcactcatctaatgagccagtttgtaggccattcatacaacatgtcatccttttcaaatcacactccaacaca

SEQ ID NO: 561439 - DNA, 156 bp, Homo sapiens
ttaccaaaatggttggtgtggtcgctttaaagtttgttttcattttttttctatttttaattcttacgggtatatagaaggtgtatatatttatggggtacatgagatgtgttgaaacaggcatgcaatgtgaaataaataagcccatcatggaga

SEQ ID NO: 561440 - DNA, 517 bp, Homo sapiens
  misc_feature (36)..(36): n is a, c, g, or t
  misc_feature (89)..(89): n is a, c, g, or t
  misc_feature (114)..(115): n is a, c, g, or t
  misc_feature (165)..(165): n is a, c, g, or t
  misc_feature (209)..(209): n is a, c, g, or t
  misc_feature (220)..(220): n is a, c, g, or t
  misc_feature (248)..(248): n is a, c, g, or t
  misc_feature (272)..(272): n is a, c, g, or t
  misc_feature (281)..(281): n is a, c, g, or t
  misc_feature (301)..(302): n is a, c, g, or t
  misc_feature (358)..(358): n is a, c, g, or t
  misc_feature (499)..(499): n is a, c, g, or t
actccttcctttcagacccagtgtccactgggctangagggggtggagccgggaccagccccctaggaaaaggtgtaggaatagaaggnaatggcattggcgctatagtccaannagaggaggtgcccgaagtgcctggaccctaggatggccccacccagagangaggagtgcctcaacttcatcagggtgaagctggagaagaagtnctgggcctggntctctctgccctgggtcagcgccaaaanaaaaccttccttcagccgctcccngctcttccncccagcgcccacgcccaggnnggggagtcccatcttgccctggcacccgcccgggtcactctcgggcaaccctgctncgctgtgtctgcccagcctctccccagccttcctgggggtctggggggggggggggtctccctgctgggccccttctgcctttttccggcccgcccccgccgccctgcctttttccccgtccctatacaggtgagtcagtntccctagccgatctggca

SEQ ID NO: 561441 - DNA, 306 bp, Homo sapiens
cagtgtgagaacattgtacacacatcctggaataccttcagtgactgaacaggcacatcttatgtgcaggtcagagttacatggtcaaatcacacaccagtcacccagttgtctcagccagcccacagtatccaaaagagtctctagtactgaattcagcatgtcatagcttgatgcatcgttcagcaagcaattctgacaagcggatttagatgaactgaggacaaaatcttgactagtttcagatggcatcactaagtgaaagtaaagttattgccacgattccgtcctcagttcatctagggt

SEQ ID NO: 561442 - DNA, 186 bp, Homo sapiens
ggtcgttactagaggatcccgacgctctctctggtggtgggacgcttcttccagagtgcagtgactgccaccctggccagtccgaccctcacagctcagtctgcaccttgctcggctctgcagcctccagccctcccttgctcctctccggggccattttcttcacttgccccacagagagagcgt

SEQ ID NO: 561443 - DNA, 187 bp, Homo sapiens
tacttttccatcaggcacacacatgagggctcgccttcctcccaccagagctgcgacgttctgatccacattgcctggaggctctggagcacaggctttagccgttggtctatttttatttagagatgggggtctcactatgttgtccaggctggtctcgaactcctgtgcccaagtgatcctctcg

SEQ ID NO: 561444 - DNA, 938 bp, Homo sapiens
  misc_feature (8)..(8): n is a, c, g, or t
  misc_feature (18)..(19): n is a, c, g, or t
  misc_feature (23)..(23): n is a, c, g, or t
  misc_feature (46)..(46): n is a, c, g, or t
  misc_feature (58)..(58): n is a, c, g, or t
  misc_feature (73)..(73): n is a, c, g, or t
  misc_feature (95)..(95): n is a, c, g, or t
  misc_feature (128)..(128): n is a, c, g, or t
  misc_feature (133)..(133): n is a, c, g, or t
  misc_feature (137)..(137): n is a, c, g, or t
  misc_feature (206)..(206): n is a, c, g, or t
  misc_feature (285)..(285): n is a, c, g, or t
  misc_feature (308)..(309): n is a, c, g, or t
  misc_feature (339)..(339): n is a, c, g, or t
  misc_feature (348)..(348): n is a, c, g, or t
  misc_feature (364)..(364): n is a, c, g, or t
  misc_feature (382)..(382): n is a, c, g, or t
  misc_feature (390)..(390): n is a, c, g, or t
  misc_feature (396)..(396): n is a, c, g, or t
  misc_feature (419)..(419): n is a, c, g, or t
  misc_feature (453)..(453): n is a, c, g, or t
  misc_feature (472)..(472): n is a, c, g, or t
  misc_feature (497)..(497): n is a, c, g, or t
  misc_feature (546)..(546): n is a, c, g, or t
  misc_feature (555)..(555): n is a, c, g, or t
  misc_feature (563)..(563): n is a, c, g, or t
  misc_feature (624)..(624): n is a, c, g, or t
  misc_feature (636)..(636): n is a, c, g, or t
  misc_feature (641)..(641): n is a, c, g, or t
  misc_feature (749)..(749): n is a, c, g, or t
  misc_feature (759)..(759): n is a, c, g, or t
  misc_feature (786)..(786): n is a, c, g, or t
  misc_feature (802)..(802): n is a, c, g, or t
  misc_feature (831)..(831): n is a, c, g, or t
  misc_feature (863)..(863): n is a, c, g, or t
  misc_feature (889)..(889): n is a, c, g, or t
tggaaaanaacgtaaatnnattnaaactggttttggggcaggggangggtggacagcngggggttttccaaanaaaactgagggaggagccagcncccggccaggtgggagcgggtgcctggccacanacccnatcncaggcccagcttcttcttttccttctgcttcttgcggaccacgtccaaattccggtccttccacatgcncttgcgaacttgaaggggcgcgaccaacaaacttcccattcatctcacgcatggcgcgcacgtagtcgctggggtcctngaagctgacgaagccgtagcccnnagtcttgcctgtacgcttgtaacggatcancttggcctnaaggaaggatgggaancggctaaaggcgcgtccnaaaaagtnaacgtncacctcaatgcccaaaaccccanaaaaaaaccggaagtaatctgcatcccactccancaggctggggtcctcccancagcaccctgccgctgtgcaattcncgtttcaatttctctggcttccccttcttcttgtcttcacccaggggcnctgggaccncaaaaacnaagaggcctgggggtggctctggccgagggggccggggccgaggacgcagggacaggagtncaggaatgcgcnggggnggcaggaggccgcggacgacctccaacgggaggggcaggggctcaggctcgggcaatggcatggccagggccagcggcaggctgggcccaatgactgcggggccagcnggggcacctnctgcccccacggccacagcgcgctacnttcctccagcccagcngccgccgccacccctgcctcttccttctntttcaggcccaaccccaggcctaggcccagcnctcgggggtgctgctggctcttccanagggggcctcagttcagccatggagcccagcgggggccctggagcccga

SEQ ID NO: 561445 - DNA, 346 bp, Homo sapiens
cctcaataatggcatcacggacccagtcatcacaagcagtatgtggcatagtgtgagctcagcgattcatatgggtgtgaactccatcagactctgtggatttctgcaagctatttgagcgtgcatcactcgtgacttcgtctgtaggttactagacctctaccttcgttgcaccttcatgacatcatactagagtggtacgcattgtccgtcacctcacattagaaccttatagtagcatagacccgtacctgtagaatggtgaaataaatgtggagtcagcactatagccgaggtctgtacggcctataagcacacctctcataatcgcggcatccaacctcac

SEQ ID NO: 561446 - DNA, 265 bp, Homo sapiens
cctgggaggacagagtgaatcagagaggcagcagtgtcattcatgcaaagcaaggtcttgagcttcacgaggatgtgcaggaaatgaatgccgtgaggaaagaggttgctgaaacctcagcaggccccagatgtgcttagtgtgaaaaccgatggaggggataccaggagaactgctgaagaacttccaggacattatgcaaaagcaaagaccagaaagattgtctcatcttcttcaaggatacaccttgccaaacatctgtacc

SEQ ID NO: 561447 - DNA, 270 bp, Homo sapiens
tcattcttatagctatacaactatacctcagctaagaaaaacatctctggtgaacactcaacctgggctactaaaaataaaacggaatatttaatgtcgtaaacaagtatagtaaacaccatgtggatttactgtagttaatgaagacatgatacattcaaacaagtatgtatttattaaaaagaacacaaccaaaaaattttctagaaagagacttcacaagaaaaaaatgagcccaaggttcatccctcaatcagaaatcggtcttag

SEQ ID NO: 561448 - DNA, 167 bp, Homo sapiens
atgcgaacctggtgctggttttctgcctcccgccggggctggttcatgaggtagcggcacaactcaccaatgttctgctcaatcgtgcagctgtacttgatacaacagtcccacaaccgggggggtgagaacatctttctaataaccaccgccatgccatgcagcag

SEQ ID NO: 561449 - DNA, 214 bp, Homo sapiens
ggggaacagtcactttgttgagttctcgctgagctcactcaagatgtggttgtttaaaagagtgtggcacgtcctcccccaactctccctctcactcccgctctcaccatgtgacacacctgctcccccttcaccttccaccatgattggaagcttcctgaagcccttaccagaagcagatgccagccccacacttcctgtaccacctgcagaa

SEQ ID NO: 561450 - DNA, 395 bp, Homo sapiens
atctggatagagatacggtgcgttctcagagaatcacacatggtagaagggacagaagtgctccctcaagcctgttttataaggtgctaagcccattcatgatctccaccctcatgacctaaccagctcccacaggccccacatctttattattttctggagatggagtctcgcgtctgtcagccaggctggagtgcagtggcacgatctcggctcactgaaatctccacctactgtgttcaagctattctcctgtctcaggctcccgagtagctgggactacaggcgcgtaccagcatggccagctaatttgtttgtatttttagtagagacggggtttccccatgttgggcaggatggtgtcgatctcctgacataatccagctgccccgccc

SEQ ID NO: 561451 - DNA, 170 bp, Homo sapiens
caaggttttttgttgttgtagttgttttaagtattcttgtaagctctgcttaccacagttatgggaacaaagcactaaagactgatggcaaagtagcaaaagcagtcagccttatgtaaaatcatgtcaacgtctagtttttaaactttttttttttttttttttttttt

SEQ ID NO: 561452 - DNA, 913 bp, Homo sapiens
  misc_feature (913)..(913): n is a, c, g, or t
tacatatagggctaaattcgatcctcattactcaacccttggatgatgatacagagaatgccatgagtagattgataaccactgaaggttgaagtgccttgtgtcatgtaagaacatctatgtgaacacgaagtaggtgcaaatatgacatctgtcacgtgccattcactgccttgcgttgcatcgtgctgtaataatctatggatgaagatataagggctgggaaatagagatgggttccccacaagatgagggacagaacaatttgactattctaaggtgtaaagagtcaagatataagttgacctatcaagaaatgctctgtaaaagagcatatgtatgattatttttactctttgtatgcgcccttaagcatttaaaagtagaatcctaagagtaggaggcataggacgcaaatctggacatcaatacttgaataatttagttttatcataccttggagagctacgcgtcttcatcattgaacagctcgctactagatagaaacttgtccaaacggtatgtagcttgacatgggacttccgtggcaagatggagaacataactgaatcgtgggttcgggtgacgttgccctccagctgggcgtggggaacactaagtcagccagctttatatcccacagaaggccagtggccagtgactgcttgaaacaagaaattcaggccacaggggtgagaatgagcctttcaaacgtaactattttaacacttggaaacatagtgcccaaatttaagtcgggaagagcgaatttcatttgccacgcctttttataaaataaccacattctttacccaaaatttgccctttgttttgtgcccccacgggacattaccggaggggttcgccctccccattttgctcccacattgggtcgccattcctatttgacagn

SEQ ID NO: 561453 - DNA, 169 bp, Homo sapiens
gcgcgaattccaggctgatcaagatgacggcggagaagggacgagatattccagttcgctctccatcgatgtggcgggcaacttggactacaaggagcacagttacgtgatcagctcacggggaggagaaggaggagtgatgacccagcctgggtcaataaacctgtga

SEQ ID NO: 561454 - DNA, 273 bp, Homo sapiens
  misc_feature (25)..(25): n is a, c, g, or t
  misc_feature (230)..(230): n is a, c, g, or t
  misc_feature (232)..(232): n is a, c, g, or t
  misc_feature (241)..(241): n is a, c, g, or t
  misc_feature (248)..(248): n is a, c, g, or t
agagctgcatgtttccttgatttgnagcttgaagttcagagctgtttacccaaaaagggagccaatagagatcttcccaatgaacctcaatacacgatcgtaatactcgcacaatgaaatgttaagtatgattctagacttcactgactatcacaatgatattttctcgatcgcactagtgcacaacaaaatacgatgagtgcaatgtgaaacatctcaaagtaaatcananactgttttnttaaatncatagaaatttgatttgtaataaaa

SEQ ID NO: 561455 - DNA, 682 bp, Homo sapiens
  misc_feature (432)..(432): n is a, c, g, or t
gtctttaaaccctgcgtggtaatgcctgacgcaccgcctagatgcccagcgaagacagggcgacctgctaagtacaactacttgcttaagatcatccaactattggatgatcatccgaaatgtttcattgcgggagcagacaatgtggtcttgaagcagatgcaccagatgcgcatgtcccttcacaggatggctgtggtgctgatgagcattaacaccatgatgcgcagggtcatacgagggcacctggaaaacaccccagctctggagaaactgctgcctcatatccgggggaatgtgggctctgcgttcaccaaggaggacctcactgagatcagggacatgttactggccaataaggtgccatctgctgcccttgctggtgccatagccccatgtgaagtcactgtgccaggccataacactggtctnggtcccgagaagacctcctttttacaagctttaggtatcaccactactatctccagaggcaccattgaaatcctgagtgatgtgcagctgatcaagactggagacgcgggagcctgcgaatccacgctgatgatcatgctcaacatctcccgcttttacttagggctggtctccagcatgtgtacgacaatggcagcgtgtacaaccctgtaatgcttgatatcacgtgggaatcgcctacgccctgttg

SEQ ID NO: 561456 - DNA, 341 bp, Homo sapiens
  misc_feature (132)..(132): n is a, c, g, or t
gcacacacctgtaatcccagctacttgaggctgaggcaggagaattgcctaaaccagggaggcagaggttgctgtgagccaagatggcgccactgcactccagcctgggcgacagagtgagactccgtactncatctcaaaaagtaactttatctttgaaaggtacaacattctgagagtgaggcagatctaagagatcctaatttaagccagataggccaggaaattattaagaaggattcaacctaaggtgtaaggtgttaagcatgtgcctgtcatgtagcaaaggcatgagtgatggttgttgggttttggggcttttttaaggttttattacttct

SEQ ID NO: 561457 - DNA, 227 bp, Homo sapiens
acatacatcttctacctactcattagtttgaaaaccttggatgatttgatgaggagtgatgaaaatcctggctggctgagcaagactggcacttgttccagccattagtgagttgaagccaaagccctataggtgactcactgagtaccatggttcatgtactcctctggagatcttgcacgtatctgttttcctcccccagtgaactagaaaaccacttattccca

SEQ ID NO: 561458 - DNA, 841 bp, Homo sapiens
  misc_feature (72)..(72): n is a, c, g, or t
  misc_feature (120)..(120): n is a, c, g, or t
  misc_feature (123)..(123): n is a, c, g, or t
  misc_feature (129)..(129): n is a, c, g, or t
  misc_feature (160)..(160): n is a, c, g, or t
  misc_feature (179)..(180): n is a, c, g, or t
  misc_feature (208)..(208): n is a, c, g, or t
  misc_feature (238)..(238): n is a, c, g, or t
  misc_feature (250)..(250): n is a, c, g, or t
  misc_feature (261)..(261): n is a, c, g, or t
  misc_feature (264)..(264): n is a, c, g, or t
  misc_feature (294)..(294): n is a, c, g, or t
  misc_feature (303)..(303): n is a, c, g, or t
  misc_feature (352)..(352): n is a, c, g, or t
  misc_feature (358)..(358): n is a, c, g, or t
  misc_feature (383)..(383): n is a, c, g, or t
  misc_feature (386)..(386): n is a, c, g, or t
  misc_feature (398)..(398): n is a, c, g, or t
  misc_feature (401)..(401): n is a, c, g, or t
  misc_feature (419)..(419): n is a, c, g, or t
agcaggcccttgtgtcccgcacgagccttgcgtactaagtgacctgaaccttgctccgagagggagtcctcncggacgtcagccaagattccagaatgactatcttgacttacccctttnaanatcttnccactgcatcaaaatgggccctcagattttncataagacctctgagctgnncctcccagctacgagctgccccagctgnccagaccaaaacgaagaagacgttagccanacccaatataangaatgttgtgntgntggatggtgttcgcactccatttttgctgnctggcactncatataaagacctgatgccacatgatttggctagagcagcgcttacggntttgtngcatcggaccagtgtccctaaggangtngttgattatatnatntttggtacagttattcangaagtgcaaaacaagcaatgtggctagagagggttgccttggaaccgggcttctcgtgacaagactcctgctcacactgtcaccatggctgagtatctctgccaaccaagccatgaccacaggtgtcggcttgattgcttctggccagtgtgatgtgatcgtggcaggtggtgtggagtcgatgtccgatgtccctattcgtcactcaaggagagaatgagacacactgatgcgttgatctcacataaagcgcaaatctatgggccagcgactgtccttcaatctctaaattcccgattcaatttcctaagcacctggagctccctgcggtttctgaagttctccagcagtgagaccatggcccactctgcagaccgaactggccgtgccttagcctgttctcgggtggcacccggatgcat

SEQ ID NO: 561459 - DNA, 146 bp, Homo sapiens
atttccctgctgcgcttgcccggagaccaagacggcgcgcgatgcagtgtcatcatcgcagaacaggcagaagaacaacttgtgtgacctcttaattgcaggcccacaagtgaatgcactgcagagcccttaggcatttcaacaat

SEQ ID NO: 561460 - DNA, 127 bp, Homo sapiens
tatgactttgtctcggggctgtatgacgagactggcggtccactcatgaggtattctacacctccgtgtccggccggcgcgggagccccgttcatctcagtgggctacgtggacgacacccagttcg

SEQ ID NO: 561461 - DNA, 137 bp, Homo sapiens
ccagctgccactcttcctgaggctgtggcagcctacttgggactctggagcagggagcttggtgattcattttattatgggggagggcgggactaataaataaattactaacaataataaaacaatcactaacattt

SEQ ID NO: 561462 - DNA, 295 bp, Homo sapiens
  misc_feature (26)..(26): n is a, c, g, or t
  misc_feature (35)..(35): n is a, c, g, or t
tgaggttctgccggggggggcgcgangaaacaaanacggccgcatcgggttttatttggggagcaagaatttcagtttggggcatacacacagactgggtggtcttcattatgtccaaagagcaaagagaaggttgtaggtttcataaaaatgagaaatgttatggattgttaggaaagcaagttcattaacactagcaacgttttggggatccggcaagctctgattggtgagtgggtgaaactagtcttagatttccgcaagttgtttctgtagctatgagatcaaaccgtgt

SEQ ID NO: 561463 - DNA, 154 bp, Homo sapiens
tgtgtcgaggtcctggcgcagcagcgtcatctggctcgcgcgactcgcggagcagctccacgagcttctcgttgccgccgcgcccaacgtgcggtttcttctgctgcagcatcacggatggtgtcggccggggtggtggctcgggcggccccgt

SEQ ID NO: 561464 - DNA, 165 bp, Homo sapiens
aaacccggtttttgggggaacttttttgttttccccaaagggggtaaaatttcaaatttttgaaaacccccttttttttttttgggggggaaggggaaacaacccccccccccttttttttttggttaaagggaaaaccccttcaaaaaagttttttaattttca

SEQ ID NO: 561465 - DNA, 129 bp, Homo sapiens
acggatcgtccagaggacacgaggtcacatctctgatagatgcgatccagaggagactgggaggaggagagggtggcgtcctcgccctccagcaggcggcggtaggtggcgaatattcctggtcccagc

SEQ ID NO: 561466 - DNA, 174 bp, Homo sapiens
cccgtcaaacgcaaagaagacaagcgcaacaagtagggttaggagaggaggagtcggcggcggcggcggaaagcgagagcgggtcgtcggaaggaaccgccctcgtcgtcggagatgacgggcaaggcgaagccgaagaagcacacggccaaggagatcgcggcgaagatcgac

SEQ ID NO: 561467 - DNA, 401 bp, Homo sapiens
tgcatagctgttagtggccacgaaatcaaaattgtgtgtgctccatggaatactatgcagccacaaaaacgaacagaaccctgtcttttgcgggaatgtggatggagctggaggctattatcctcagcaaactaacaggaacagaaaaccaaatactgcatgttctcacttgtaagtgggagctaaatgatgagaacttatggacacaaagaagggaacaagagacactgaggtctacttgagggtggaggtaggaggagggagacgagcagaaaagatcactattgggtactggacttaattcctgggtgatgaaataatctgtacaacaaacccctgtgaatatgagtttacctatgtaacaagtttacctatgtcacctgcacatgtcccccagacct

SEQ ID NO: 561468 - DNA, 154 bp, Homo sapiens
  misc_feature (4)..(4): n is a, c, g, or t
  misc_feature (129)..(129): n is a, c, g, or t
ctanggtcctggtcactgctcacctgtcactgctccacctcatgctgtgaggagctgcgttcaaccatggaaaagggacaggcagatcgaattctgtcttctaccaagccagctggagctcctgagggnctcctgagtagctgggattacaggt

SEQ ID NO: 561469 - DNA, 151 bp, Homo sapiens
ccggggtgatctagcaggatccctttggtcgatttcattagtggcagtttagggctaagcataggggggtatctaatcccagttggggtcttagctatggggggtgcagatatgttaaagccactttcgtagtctatttggggtcaatggg

SEQ ID NO: 561470 - DNA, 270 bp, Homo sapiens
caaagcagcaccgccggtacccgagtggatcggggacggagagagcacgagcccatcagacaatagtggtgaagaaagggaagatggacaatgaagatcaccaaaacgttcttatgaagatgctggcatgtagaatataaacatggctggtggaagaaagagaaatgtgctcaagtgagaattgagcagacagcatgcagacgacagtaaacagcttaacctataaccgtgggatcctactaagagtacgacctagcagtgcatagccat

SEQ ID NO: 561471 - DNA, 303 bp, Homo sapiens
  misc_feature (17)..(17): n is a, c, g, or t
atttctaataacacagngttttgctctgaagcgtgataagactgctagtggattccatgaagcgtggccctatggtacccgattgaatgcactggttgcaatgaagcatgattgaatgcagtggattccatgcagcatggagaaattgaaccctattaaatgcaggggattttatgcagcatgattgaatgcagtggattccatgcagcatgattgaatgcagtagattccatgcagtgaggcccaatgcatcccgattaaatgaggtggattttatgcagcgacgcccaaagtatcccgatt

SEQ ID NO: 561472 - DNA, 542 bp, Homo sapiens
  misc_feature (239)..(239): n is a, c, g, or t
agaggatcgtttctgctcctcttcacacgactcctggtagagtcatggacaggtcagtgtcacatcacgtcgtctggcctgagtgtcttggcgtccttggtgaactgtctttcagttggctacagtgaactcagctctcgaattctttgctccctagctttgatatctctttctgctgctggagagcagtctgacctgtgccagtcctcggttcttccagacaaactctccctccaggnccgagacctgctgtatcaggctggagatgctgcctggatccaccctggcaaggcccaggctttcctcagttaccctgatgccaatgcttctcatgtccacctctacaggtggcgggggtggaatctcgctgatattgagctcgatttcttccaggaggagctcattctcagggatgggtgatggcagaggtggcgggcttggcgtaggggagccaggggtgaacgacacctctgcttctctggcattgtgttcatcttccttgtcctctagaactacaagcacattctggcatgagacaggag

SEQ ID NO: 561473 - DNA, 419 bp, Homo sapiens
  misc_feature (1)..(1): n is a, c, g, or t
  misc_feature (157)..(157): n is a, c, g, or t
  misc_feature (165)..(166): n is a, c, g, or t
  misc_feature (172)..(172): n is a, c, g, or t
  misc_feature (213)..(213): n is a, c, g, or t
  misc_feature (228)..(228): n is a, c, g, or t
  misc_feature (249)..(249): n is a, c, g, or t
  misc_feature (251)..(254): n is a, c, g, or t
  misc_feature (363)..(364): n is a, c, g, or t
  misc_feature (366)..(366): n is a, c, g, or t
  misc_feature (378)..(378): n is a, c, g, or t
  misc_feature (382)..(382): n is a, c, g, or t
  misc_feature (391)..(391): n is a, c, g, or t
  misc_feature (396)..(396): n is a, c, g, or t
  misc_feature (408)..(408): n is a, c, g, or t
natgacagtgggggggcacagtttgccaaactttgccttggaggacatgcagaggcaccctcagaattcagtgaaaacctgctcccatattgctaagactcatgaagtataatctctcatcttctttctctttcccctgcccaagccctaagttaanaaaaaaanncatatnaacaaagacttctggtccggtggcctttgctctctctgcgnttccctgcccatgcncgaaaaaaaaaaaaaataatnannnnaaaaaaaaaaaaaaaaaaaataaaaaaaaaaaaaaaaaataaaaaaaaaaaaaaatagaaaaaaaaaaaaaaaaaaaaaaaaaaaaaaataaaaaaaaaaaataaaaannantaataaaaaaanaaanaaatagaantaaanaaaatagaaagnaaaaataacta

SEQ ID NO: 561474 - DNA, 456 bp, Homo sapiens
gctgtgagcatgactgcgaggcctcaagaaacttacagacatggcagaagggcgaagggaaagcaagcaccttcttcagatggcagagggagagagcaagcaaaaggggaagtgctacacacttaaccagatctcatgagaactcactgtcatgagaacagcaagggggaaatctgcccccatgatccaatcacctcccaccaggctctacctccaagactcaggatcacaattcaacatgagatttgggtggggggacacagccaaaccatatcattccaccctggcccctcccaaatctcatgtcctcgcatttcaaaacacaatcatgccttcccaatagccccctaaagtcttaactcattccagcattaactcatatgtccaagtcaagtctcatctgagaccagccaagtcccttcctcctgtgagcctgtaaaatcaaaaacaagtcag

SEQ ID NO: 561475 - DNA, 226 bp, Homo sapiens
tcagctcggacccactttccgagtagaacttgtattgatcattgggacccactttgttccagggctctgggttatttctgtcccaacaaacatctggatgaacaatgccccacgcacgagatacagtgttgctccactagctccacttccaataaatacaaaaagggggatcaagctccgatgcttcttggcctgaccgatgatctggcggagcatgttttcggca

SEQ ID NO: 561476 - DNA, 1925 bp, Homo sapiens
atgcctgctgtcatcttgtctctccggtgttgttgcttgtgccatttaagttcgcggggtggtgggtggtgtggacacacaacccgttgggtgcccgtgcgtgatgtgtctccgtgataggtggcactcaccatatatggcgtctggtttttgtgtggttcatattgatctaacgcgtagtggtggtctgtgtggaattgtgtggggccaccgtttcttctgtgttgtttcacaacaacagcgggtttggatcggttgggctgttttgttgctatgtgtgtgtgctgtgtgagttcactaagcaatattctgttggggagggagtgtgtattttagttttgtttggggcggcacaagcacacatgtaatttatttgtttggttgattgctttgtagtccaagcagcgtggtattgttatcgttttttggcgtgcttcgttttggctcggcggctggtcttatatgggtgagtgttggttttgtggttgggtgtgtgggtgttgtgtgtggccgccgccgccctcgggggtggtgtggttgctgccctccatacttcttcttgttttgtggttgtgttgttgtgctcttgctttctcttccctctcgctcagtggtctgtgttgtgtatgttgtagtggtcagtgggccttttctgtagtactgttccgggtgggtgttgtttgatcaaagtaagaggggtggggtgtgtgtgtgctctcttcttggttgctgtggggtgtggttggtaagactggttgtttgttttgtctctgtttcagccctcctccctgctcttgtgttgttttggtgggtgtcggttcgcccacctcctgttgttgtgttgagtaggttatgtagggctttgttgtggtagtaggcactccgttctgttcggatcacatctgctgtgttggtgtgtggggtggttctggttggctggctgggctcctcctcttcccctccgggggcttgggtttatgtgtgtctctggttgcccgtcgtgctgcgcctcagcaggtgggggggggtgcgcacagaccttttgtgtggctcgcgcgcggtgtcttattctctcttcgcggggtgggtctttgtgtgtgtcgctcctgcttttttgtgtgttttctctctctcacactctgcgttctgtgtgtttttgtgtgtgtgggagtgtgtgtgtgtgtggtggagatgataaatagaaatatagatagagtagaggctcacacagcgatgtgtgttttggtgtgtgtgtctctctcatcccaaagagatgtgggagaagggaaatgagcatagagagaggtgaggtgagagtagagagagcagactgtgttgtgttgtgtctctctcctcgtctctctgctcttctgtgagtgtgtgtgtgtgctccctctgatggtcccacacacacagcgcgcggtgttgatgtgtgtgttgagatagctctctcactacgctagagagtgtgttttctctctctctataattgtctgctgctctgacatcacacacacacacacaccacacgcgcgaatgtcactccgcgacttgttcgtgtgtgtatatatatatagatagatagtgtgggggaaacaacaccgcgcgggagggagactgccaatccactctgtggtggtggtatgttgtttgttgttgtgatgacacgcggtttgtattatataatatcccctaacaagcgaacttgttgataaatagattgatgcccgacgcgctggaggaggatgagttgtgtgaatgtgcgcgcgcgaataaaataagtcgtggtgggatttttgttgtttgtataatataaaaagatatatgagtgacggccaggtgtgtggtgtgtgtggaaaacacaccaccaccttctgtttatgaatataatataaaaaaataataaataaaataaaataataaat

SEQ ID NO: 561477 - DNA, 602 bp, Homo sapiens
  misc_feature (376)..(376): n is a, c, g, or t
ccctaacctgggcgtatgtgacttctctggtcgtgacgcccatggagatactctgtaagcagagctggtaatccacaatggaatactacccgtgggaaagacaactgactgtgtctcgagtcgggtgacagcgaggtgacagcatgccgatgctgactcagtcttcattcctggcttgaaaggctccaagccaaggtttgagaggtacagtaacgtgtcccgggccccgtacgaggtgacgtgtgaccccaaagcccaggctttccgagctaagccacagcgtgcccctgccaggtgacctcacgatgtcacatgcgggcagtagggcctgctgtctagagggcttaagggagcagaatgctcatcaaccccccgnttcactgtgaaaattcacccttgaccagggactcatcactgaaaaccaaaactgacaaatccctcgtcaccgtagaagtggctcaaaacaaggaacactgtgtttatttcgggggagatccatttttgctggttaatcactgggcaaatatttatttatttatcgagacagagttctctcatcgccaggctggagcgcagtgggcgactcggtcacaaaaactcga

SEQ ID NO: 561478 - DNA, 260 bp, Homo sapiens
aatactcagagaaaaagtgttgcaccttattatatctcaagcaaaccaaaatatgatgctcttctgctttgttttattctaaattgttgtatcatatctttctgaaaccattctgaatttagttgaaattatcaatatttatcgctttataacccttaatttctgcgattcaatgcctgatatatgacatcttattgataaaataaattgtcctattccctttctctgcgtatgctcggaagtatgaagattgcagtctc

SEQ ID NO: 561479 - DNA, 236 bp, Homo sapiens
cgaaataaagagaaagaaggaaggaagaaacgggaggaaggaaggaacgggatgatttaaaaagaggaggaaagcctattatattttcacatatttttgcttactgtgttattctcttccttcccacattgttccaattcttctctcagctttctcactttctcttgtctgttcctcgtaaattccgtttaggctatttcttgttaggaatcggttctagctcagtgacaatatta

SEQ ID NO: 561480 - DNA, 435 bp, Homo sapiens
  misc_feature (12)..(12): n is a, c, g, or t
  misc_feature (19)..(19): n is a, c, g, or t
  misc_feature (21)..(21): n is a, c, g, or t
  misc_feature (46)..(46): n is a, c, g, or t
  misc_feature (48)..(48): n is a, c, g, or t
  misc_feature (216)..(216): n is a, c, g, or t
  misc_feature (409)..(409): n is a, c, g, or t
  misc_feature (412)..(412): n is a, c, g, or t
  misc_feature (417)..(417): n is a, c, g, or t
ggaggcgttctngaggatntnccacggcaggtgtactgtaatggcngnccaaagggagtagcgcccatcacctagggagtaagagcaatggttttctgggagcttaagcttcatagtatgacttttataagacttcaaggggcttggagacagcaacaatgcatactattcctaattttctatgatggaaatgcccatgcgactggtataagagtngtttctcttcctaaatccttgggctctcaactgtgtctcacagataaatgggactactaggtcccatcatccttgaagaaaggctctatccactgtagacaacagtcctatgaaaatgaccagggaagaaacttacagacccttatgaatgtcttttatctctctttttttttttttttgggaaacagagttncantggcnaccaagagtacacccggc

SEQ ID NO: 561481 - DNA, 1655 bp, Homo sapiens
  misc_feature (201)..(201): n is a, c, g, or t
  misc_feature (1577)..(1577): n is a, c, g, or t
cgcaaatatgggggcctcagatcatctgtcctagctgtgccagaaagagcactcctgtgaagttggagaggatgatgtggaggacgtcgagtcacacatcgcggcgcaagcgatgctctcgcatgtttttcctacggcatccggcaaaccctaccggggtacgccatgcatgtctactgaggcactgttccgtaggctatntttggggaatccctagaccatgccataacgtgtctcagtaggtgcccgatacacatattcctatgcaaaagtcacaaatcctattgtcagaacttaactctaggagtacagccacgggcagtctctgattcagggccagaacagtctggcagtgtctcagttccgaagtagtgcgagtattgacatctgaacgtgccgtcaccccaatgtgcagtggccttgccatcaacagcctcatcttgggtctttcgctgtggtgactaatccttagtgagtcggagacccgtccggcattgagactagtgtgcggcgccccaacagaaggcaccattggccggagttgaagtcctagcagctgatgatctactcagaggagttggaaagcctgggtccaccgcgcagagaagagtcacgacgcaagcggggagagcgacaattcactggcggaggcaagctcaactccacatgtgtcacctgtaccttgactattgcaatcggagcacagatgcttaagggtcactttgtcagaggcacggcaatggcataacgcgttccccccctagggggggagaacagtcgacgcgttgaaaacattgttccaagctgggcttttgccaatcgggtacaatcgatacactatgggggggcgcacactataaatacggcgcggacaaagaaacgtggggccccaataagcaaagcccggtggcccttgttcacctttcttggggacacaccgccttgtccgaacgttcaccccaactataactttcgccagtatatagacgtccaaggtccccccattatgtgcgagcaacctaggtaaaaattagcccacacgtggttcacataacacttggttggacaggtggacagagagggacaacgcggccacctgaggattcaaccataaagagaaaagatgggattgacgagtgagggacagaacaactcaatttgcggtggagccgattgaactacacctgagaagagtgaacaatgccatgtcaattaccaatttttaatgtcccagagacattgcgaaaaatgggagattgaaaaaaaacaacacgtaatgcaagacgcaataaagcgcacatatcttctcacacagcgccgatttagtgagtatcacataggtaccacctctgtcggccaccacgcttgtatgcaagtacgtcgtgggggacgcgacaagctactattcgatcgcgccattacaggcgacgggaatcgggctctatccccactatactgaacatctggcgaccgttgtcgcgatcagcacaaaatgggaggcaccgcttgggtcctagacgcagcggcgacacaaagttctagccactgcgaccactgttcagtacatggagagagcntacgcccacgtgtcgctactaaagcactggttgagggggagcagacttcggattggcacattcactacagcacaacta

SEQ ID NO: 561482 - DNA, 269 bp, Homo sapiens
  misc_feature (131)..(131): n is a, c, g, or t
  misc_feature (135)..(135): n is a, c, g, or t
tatttcccaggtcctagctgctggcatcactatactactaacagacgaactcaacacacttcttcgacccgccggaggggggaggagaccccattctataccacacctatctgatttttcgggtccaaccncccntgaagttatatcttatcctaccaggcttcggaataatctcccatatgtaacttactactccggaaaaaaagaaccatttggatacataggtatggtctgagctatgatatcaattggcttcctagggtttatcg

SEQ ID NO: 561483 - DNA, 748 bp, Homo sapiens
ttcacctgtgttcactatattccttcggtgatcactatgctgatggaatgcgtggctaaaaacatgaccagatgaaactcttctactcgtgcagcttcctcaaacttttttgagtttctcaaacttttattttgagaaacattaatgaaatctttttattgtttgtaacctgagccattatatacaatacatatttaacttaaatgtgaaacatatctgtgaaatgtgtacttccccttactgtgtgtgatactgctgttagtactcttctgtatttaactcctcactcctccccctcctcttcctattactccttttactatccttacctcttttattataattaatattacaacgtgccaaaaattgctctaaggccacctgaaaagatgaattataaagtgccaaaaagagcccagaaggcttagaaaccacttctccaaactttcccaatccccgaatggctcctcaacaatttgctccgtggcagttccccctacgggtgatggcaatcttacggaagactctacttttagtcttcctcgtgtgccccttctcccaacattaatcccatcccattttagtcttaacggaaaacaacctatagagttcttcagccacggtcgttgtgttgtgaatcgcgcccaagttgaccccctaacaactttcggaaagtgcccatggccccacaaaactcaccgaggcccgagtagatcacgacaagtgcctgtgcgtcaccagtgtagac

SEQ ID NO: 561484 - DNA, 213 bp, Homo sapiens
taacatttaactgtcatctctttacctgctttaagctggaatgtactctcagtctctgtctttcctgagcatgacatttttgaagagaagctaccagttagtttacaaaatacccatcaatttgggtttcgtctgatgtttcccaaggattaaattcaggtttcataggctcctgtagtattcaggctccagagaagcctgaatcaccaaaga

SEQ ID NO: 561485 - DNA, 418 bp, Homo sapiens
gtgtggcagagtctggggattggatgaggattctttgcagccgggaaagaagggtgttacgggagctctggggagaggttcctaacccatggggaagagagggtcagggacatcttaccgtggctgtagtgatgcacttgtgggagtcagcctccactgtgtcctcacagtcactccttcgtcagagctcttctctgtgccaggcctccgtggagagttggagttgaggatttatttcactgtgcattcttcagctgtcggcccgatagttcactttcaacccagggacactaatttctcacccagcctcttgaaaaaaattaaatttaccaacccatgcaaaccctctaccagctccccgcctcgtaccccaagtcctctcccaggaagggatgggcagggtgtgagctgggtcctc

SEQ ID NO: 561486 - DNA, 707 bp, Homo sapiens
atcccagccactggggaggttgaggcgcaagaatcgcttgaacccggaaggcagaggttgcagtgagccaagatgccccactgcactccagcctgggcgactgagcgagactcttatatctcaaaaaaaaaaaaaaaaaaaaggtcaaaaaagggaattccccatttaagttctcaaatcaggtgactctgttgctccaaaataggcccgtgggtaacttgaaaataaccttacaaagcagtttctaacttaatgtgcaagggtgtttttcaaacaattttgaaaagtgaaccttttacattgggtgaacatacgtggcaccagtggttttaaggacaaacgagtattaaagtcgctttgaaagaccgtgtctggtagtgtctcctcaaattgggctgaagaatttttaattaatgggtgtcacgattattgtgaaaagtaagcagggttttttccaagggtacattggggatatctttgtggtttagacagacttttataacagatgagggtttggaaaaagcccctacagaggtttggggtaaacagactatcttggcttaaactaaaatgacaagttgggtgacggatttcaacttttacaaagtaggacgcgtattcacaggagattggttgtgtgatgtgctacacactcagtcagcaaaggaaatcatgtgggtggtgaacttcgagttaccccgaaggca

SEQ ID NO: 561487 - DNA, 435 bp, Homo sapiens
  misc_feature (41)..(42): n is a, c, g, or t
  misc_feature (65)..(65): n is a, c, g, or t
  misc_feature (81)..(81): n is a, c, g, or t
  misc_feature (93)..(93): n is a, c, g, or t
  misc_feature (140)..(140): n is a, c, g, or t
  misc_feature (170)..(170): n is a, c, g, or t
  misc_feature (214)..(214): n is a, c, g, or t
cagcgctcatttccgtaagtaagtttagtttcatcctgagnntgaggaaagatctgtactgaaantaaacgatagggttcngaatctggactnagactacggctcctttaatagtaacgaaaactaaatggataagttangctctacattattttcttttaaagcttgcngatcctaactaaatgtcttgagaaggattatcacactgtagcanttccagttttagtgattctccttttttcccttgtctgtaaagatttatggaatgatcactttgtgtacatacaggttactgcttttttatttaaattcttttagtgttttgctccgtgagacacttcagtttaaattgatggaataaatgttatatgacacatttacgttttccttatcaaggtgtcaaatatgtggactttaaacaatgaaactttttcc

SEQ ID NO: 561488 - DNA, 307 bp, Homo sapiens
  misc_feature (40)..(40): n is a, c, g, or t
aggaggaatgtgctttgtatcatgcctatggtgtgtgatnactgcttgatacattacgtttcactttaatttattgtgctaaggctttaataaattgggggttccttataagagcagctcgtactgacgaaggtgcatgcgctgaatgatgtcacggcagtcgttgaacacacggcggatgttctcaagtgtccacagcgcaggtgaaatgagggtagcagtagtgacgcccatctccactggcagtgctgatcctcagaaactcatctcgaatgaagtacttggcccgggtcacgcgtgggtcctc

SEQ ID NO: 561489 - DNA, 438 bp, Homo sapiens
ctaggacgccaagagtagagactagcctgggcacataggagacccccacctcaacaacaacaaaaaatttttaattaaaaaaaattagtcaggcatggtggtacatgccgtagtcctagctacttgggagcgtgaggtgaaaggattgcttgagcccaggagtttgaggctgcagtgagccatgatcacgtcactgcactctagccagggcaacagaacaagatcctgtctcaaaaaaaaaatagtaaatttagtaaattgggggacaatcagcggggctggctcagttctgctcctccccttctcctctttcttttccatatgttttttatgcctttggttcctctaaggctgcctttttatgtattcagttgattttttatagaattataatcctgtttggatttagagtgtgtgtgttactttcttagtggatgc

SEQ ID NO: 561490 - DNA, 264 bp, Homo sapiens
aggtagtggcattgtcggtgggcaggcccatggtccagttgagggatcactcggggatggcagcagctcggcagtgcccggtgcgcaccacagagccggtggagggacttctctgagtaggtgtctcggtcgcagcctttccctatgtggctggtttctagctccactgtggcctgtactgaggcgactggctcgtcacgtgtctccaggtggatatttggaaagacggccaacgcgccggtgcccggctcatactcaatcctg

SEQ ID NO: 561491 - DNA, 704 bp, Homo sapiens
  misc_feature (315)..(315): n is a, c, g, or t
aaggcgagggggtttccactgtgtcaattattttagaaccttaaggaaggggtgccttacaaattgtaaaaagttttccctattccgggtttttccccaccccagtggttacccctctccagagggccttcacgggggcttcttcaaccaggggcccgttatggggggatggataacacagacatgcagtttgtattcaacagcgttagataatatttcgaaaaacttcccaagctaactgtaggggccctaaactgcatgtattcctcttagcagtgcaagcttgcagcattgcgtcagccaagtagtcaatcnccaatgtggtgaccactgcaagcgtgccgtctctttaaaactatctaccttctataagacttggatatacacgtgaaatgtcttcacagacagacacatgtattaacggcgagtttatgggattgtcgcaatcacctgtatcattgatgtattcaatagaagcggtgtcagcccaccatgttcaccactagaatatcatcgtttggtcgggtgggtctttctttcttttttaattgcgcactgtgcggtaacgtcacccatgtgcaggctccacaggggcgcttacaaatgaaatagatcttgtgataatctggatgcatttgcccttttcatacataaacctgtagaactgtccctgctgggtaattaaattgcttcattcgaaaaaa

SEQ ID NO: 561492 - DNA, 592 bp, Homo sapiens
gctcctcacagcggaggccaatggcaggcgcaggagtggcggctgcaggacggctgcccggggactcaccaggctgtggtcctgctctaaccccccacgccccattccctcctcacagcggaaacatcacttgttaacagctgacatgcactcacaagctgtgtttccgctgtgaggaggccaagtggcgaggcgcaggagttggctggctgcaagggacggctgcccggggacctcaccaggtctgatggtcctgcgtctagaccccccacgccccattccctcccaaccgcaggtctcattcttgaccccttttgaacgacttcctctctaggcctggctagccccgaagatagcatgagttgcgcgattggctacttgattgacggtgcgcgtcgccgactgttcgaggtttaccgctggacgtcgtggtctctgtgctctttcctcttctgtgggttctctgaaatccatgttggatccacggaggggagggccatctctgaagcggctgcccatgggggggcctgttcgccggtcgcctggtgcgactacctcccctgacccctaagaagtcatccctgaagcctct

SEQ ID NO: 561493 - DNA, 1605 bp, Homo sapiens
aataggtgaaaattccttataaatccaggatgggctctgagagaacgggataagaattaggaagaaacacaaaaagattcagaaatccgtacgaagggtttgggaggcacgaattagggccaaaattttataggaggcagcgtggtagggagtgcaggcagaagaattaagaggtggtttgcgttaagtagtcagaaggaggaaactagtcaacagggtcagtgagaaggtgctggagggtacagggaaaactatatcagcactggtgccattggcgatgggctggtggcgagtggagaatggcgccttaagcctggggtacagcctatcctgggggcccataaaatctggggctatccgaggagcatagctacagggtaactggtggggaaacaaaaaatggcacgagcttacagcagcaagcctatggggatagatagtagagggcgggtacacaaacaactctaacaagggcgttcgggggagtccgcatggcataggtgtccaggaacccatgtgaacatctattaccgtggaatggagagagggatctggagtatcaccaggcagccaaggggagaaaagcaagaagagatatattgcacacacgattatagtgccagaaacatattcgcgcgcagtcgcatattaaccaatcatatatacatcatataccacccagtgtgagctatacacgccaaacatgggatctccatctccacgtgcacagtgcacaaaccagggggacccgttggaaaagtttcccctggagtggccgtgggtgacaggacacgtggttacgacaacgagatagccacgcgggatatatacaccaacacacggatgggtgagaacgagggcacatggcaccacacggaaaccaggggtacgcacgcacagagggacactatatcccccaccaacacttttggggacgaccaccattcatggaggctcagggcaccccccgtagttcgaagattcacatggggcaccgagggggggagacaagcgcgagggaaagaggaaaacaccacaatggcaaagagtgcataacacagagagcgacccctacacaaacgggaacagcagaagcattgagttccccacccaaccaacatcgggggggtgttgaagcacccacccacagagagagacgaacgaaccaaaggggcgacgagaacaccaagtgagatcgagtaaaacacacgagacacaggcaggggggtcccacacacaggaaaaaacaaggagggagaagaaaacgaatacgcaaagagagcccgcttgggtgaacaccccggggggaagagaccccgggcggtagagagcaccaaaacagaagaaagaagcacggggataaaacaacccggcacacagaaccaccacacacggagaacaaccaccaaccaaaaagaaacgagaaagagaaagctaacaacaaggagggggacaagaacatacgaaaaccacaccaacaatacagagcgacaacaaaaaacaaagagagcagtcgcacaaagacagcaagagccctcccagcaacaacacaaaaaacaactagagagtagacacagcaccacacgcacaaatagcaaatagtaa

SEQ ID NO: 561494 - DNA, 144 bp, Homo sapiens
ggtaggcactgaagctcgatatccaggctcaagcgattctcctacttcagcctcccgagtagctgggactacaggagcgcccaggatgccatctttccgggagaccctagagctgaagccgtggctattaagacagccatgcca

SEQ ID NO: 561495 - DNA, 167 bp, Homo sapiens
cctagtattagaagtttcaatagcactgcactaaggaacctaagttttccattatggttcctactctcaaaaagcttgaatttcagtaagcaaataggatagtaaataaaagattacctttgggtatcagtacgaccactattgctattgaaacttctaaaactagg

SEQ ID NO: 561496 - DNA, 308 bp, Homo sapiens
aaaaaaaaaaaaaaaaaagcatttcagggccaggctcagaggtttactcttgtaatcccagcacttttggaggcataggtgggaggatcacttgaggccagaagttcaaaaccagcctgagcaacatagcaagaccttgtctccatgaaaaataaaaaattagccagaaatggtgatgtgtgcatagagttccaactacttggaaagctgaggcaagaggatcgcttaagcataggagttcaaggttgcagtgatctataatcaccactgcactccagcatgggtgacagaacaagaccctgtctgga

SEQ ID NO: 561497 - DNA, 302 bp, Homo sapiens
agcagccatgtttggccttgtttaacattgtagctgtcggtagcatcggtggttttttgttctcccaagcttgccccagaactgtgtcaagtttccgaactcccaccggcttaatggatctggctgttgcattttcttttaaaaccatcagggcagtgtccaatgttctctgcagttatgtgtccatttgcttcaggtacagtaataatgtagatggcacaaatggaagctcaaccttccacatcctcggtcttatagtagcagagtggtctcagcaatattagtcatataatgattcttgt

SEQ ID NO: 561498 - DNA, 415 bp, Homo sapiens
tagaggccacggatcactatatctttgttgagcgcagcttcactgctgagtgtcggtactggtctccttaggggaaccttccgcaacaggtcttctagcttgctgggattcctcaaagtgaaccctgaggtcctcatcctctgctatgctggtgatatctctgtagaacacggatatgtcaaagcccccaggtttcttcaggtgcatcaagtcaaggaagatgcctgtatctcggagatcaccggctttggtcctggcccggctgactaaggcactgtcattgccatgggggttgtcttcataggtgaacagcatgatcctcttatgactcatcttgaattggacatcaataaagaggttggcacagaaccacagaacttcactgagtgagtagtcagatccgtggcctctataa

SEQ ID NO: 561499 - DNA, 237 bp, Homo sapiens
  misc_feature (23)..(23): n is a, c, g, or t
  misc_feature (51)..(51): n is a, c, g, or t
  misc_feature (57)..(57): n is a, c, g, or t
  misc_feature (125)..(125): n is a, c, g, or t
  misc_feature (157)..(157): n is a, c, g, or t
  misc_feature (199)..(199): n is a, c, g, or t
  misc_feature (209)..(209): n is a, c, g, or t
tctgccctgagccctcccacgtnagtgccatcggtctagaaccactaaccncgcatngctgttgatcgtcacgctcgcatctatagataacggctctccagacctgagctttccgcgtcagcaantaggaatcgtttttgctgcagagaataaaagnaccacgtgcaatacttaatgtccgcatgatactgctatcccncttacccaanaggggactggtctcttttgaacaccttg

SEQ ID NO: 561500 - DNA, 334 bp, Homo sapiens
gacagtgcggaaatctgagtcactgctgtgcccagatatctcgcagactaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttg

SEQ ID NO: 561501 - DNA, 588 bp, Homo sapiens
  misc_feature (34)..(34): n is a, c, g, or t
  misc_feature (58)..(59): n is a, c, g, or t
  misc_feature (106)..(106): n is a, c, g, or t
  misc_feature (130)..(130): n is a, c, g, or t
tggttttaccacccggggcgttaaatcccaaaangtagagcccggcaaacaaaggggnncccttcccccccggccccgctttgggttccatcgggcccattgtggnttgccccccggtttggtacccacnaaggtgcgcgccggccccggcttcaacctggaggaactcagggtggccggcattccaaaaaaggtggcccggaccctcggcatttttgtggatcccagaagggggaacaagtccccggagtcccttcaggccaacgttcaacgggtgaaggaggcccgctcccaacttttccttttcccccggaagcccccggcccccaaaaagggagacagttttttttaaaaatttaaactggccccccccctggccgggccggttttgcccgtccggaacgtttttaaaaaggaaaaagcccgggttctcccttagggaaaagaaaaattttaaagcctttctttgtttccgtttgggccgggcccacccccggctttttggcattcgggcaaaaaaaacccaggaaccccccaacccgggtttttaaaaaaaaaaataaagcccccctgggggcttgggttcca

SEQ ID NO: 561502 - DNA, 137 bp, Homo sapiens
gctgagacaactctgtatatgcggctcggggatgtcggaggtgctgctgctccgaaggatctgctgcatgctgtcccactgtgagatggccagactcggctgcaggtgcattttctgactgttaacactcctccact

SEQ ID NO: 561503 - DNA, 944 bp, Homo sapiens
  misc_feature (133)..(133): n is a, c, g, or t
  misc_feature (149)..(149): n is a, c, g, or t
  misc_feature (192)..(192): n is a, c, g, or t
  misc_feature (240)..(240): n is a, c, g, or t
  misc_feature (300)..(300): n is a, c, g, or t
  misc_feature (311)..(311): n is a, c, g, or t
  misc_feature (317)..(317): n is a, c, g, or t
  misc_feature (377)..(377): n is a, c, g, or t
  misc_feature (525)..(525): n is a, c, g, or t
  misc_feature (566)..(566): n is a, c, g, or t
  misc_feature (615)..(615): n is a, c, g, or t
  misc_feature (634)..(634): n is a, c, g, or t
  misc_feature (640)..(641): n is a, c, g, or t
  misc_feature (662)..(662): n is a, c, g, or t
  misc_feature (672)..(672): n is a, c, g, or t
  misc_feature (692)..(692): n is a, c, g, or t
  misc_feature (740)..(740): n is a, c, g, or t
  misc_feature (749)..(750): n is a, c, g, or t
  misc_feature (763)..(763): n is a, c, g, or t
  misc_feature (769)..(769): n is a, c, g, or t
  misc_feature (783)..(783): n is a, c, g, or t
  misc_feature (789)..(789): n is a, c, g, or t
  misc_feature (797)..(798): n is a, c, g, or t
  misc_feature (801)..(801): n is a, c, g, or t
  misc_feature (805)..(805): n is a, c, g, or t
  misc_feature (813)..(813): n is a, c, g, or t
gagcggggcggtgctgacagcagctggagggcagaggaggcggcgcggggtgtcctgtcctcgccatgaagccgcagcaggcgccggtgtccggaaaggtgttcattcagcgagactacagcagtggcacacngctgccagttccaganccagagttccctgcggagctggagaaccggattgatatggcangcagtttgaatgaaacagttcgaactctaaataacctttgatgcaganagcagagaagctcggcggccagtcatatctcgaaggttgttatgggcttgtttaacagcnatagtaccatncttccntatgcatggaaacgtcattatgagaaggttctgaagaaagtctccaatagtacattcaangagcagaactgagaagatctatgctccacaaggcctcctcctgacagaccctattgagcgacggactgcgaggttattgatacattaccatttatgaagacagaggcatgagcagtggaagataaaccgaagaattgaagatcccacnttccagccgggcccctcatgtatccacgtggccgaccgtangagtgtcccttacctcctctccagagcatcattcctttctatctgctgncagagccacggtgccattntactcnnaggactcactttctaaaattncacacctggnagtgacctctagtcgctcangcatccactttgtgtttccaacattgtgtaggactctggtaatccttntgattagtnnctgagaaaacacnatgaangcacttcacgtttntttttnattccacnnccntttnattaaacncaggttggtcagcccgatgcaaagcgtggttgtgtggcaccgttcattgccgggggtctcttcattcctgggccagctcccaggggctttgaacctcaaaagcggatctcaccggtctatcttgtgccccg

SEQ ID NO: 561504 - DNA, 559 bp, Homo sapiens
  misc_feature (116)..(116): n is a, c, g, or t
  misc_feature (118)..(118): n is a, c, g, or t
  misc_feature (122)..(122): n is a, c, g, or t
  misc_feature (125)..(125): n is a, c, g, or t
  misc_feature (152)..(152): n is a, c, g, or t
  misc_feature (154)..(154): n is a, c, g, or t
  misc_feature (174)..(174): n is a, c, g, or t
  misc_feature (184)..(184): n is a, c, g, or t
  misc_feature (203)..(203): n is a, c, g, or t
  misc_feature (220)..(220): n is a, c, g, or t
  misc_feature (222)..(222): n is a, c, g, or t
  misc_feature (225)..(225): n is a, c, g, or t
  misc_feature (227)..(227): n is a, c, g, or t
  misc_feature (229)..(229): n is a, c, g, or t
  misc_feature (235)..(235): n is a, c, g, or t
  misc_feature (246)..(246): n is a, c, g, or t
  misc_feature (257)..(257): n is a, c, g, or t
  misc_feature (261)..(262): n is a, c, g, or t
  misc_feature (280)..(280): n is a, c, g, or t
  misc_feature (424)..(425): n is a, c, g, or t
  misc_feature (441)..(441): n is a, c, g, or t
  misc_feature (456)..(456): n is a, c, g, or t
  misc_feature (458)..(458): n is a, c, g, or t
  misc_feature (484)..(485): n is a, c, g, or t
  misc_feature (502)..(502): n is a, c, g, or t
gagcggggcggtgctgacagcagctggagggcagaggaggcggcgcggggtgtcctgtcctcgccatgaagccgcagcaggcgccggtgtccggaaaggtgttcattcagcgagcntnccgncgnggacccacggctgagccgttacccgcncncgttccctggcggcgtgggnagcccccggnttggctcaggcccgccagnttggcccgccccccgtncngcnancnccctcncatttctgacnccgccgcgccnatannaggaaacgatactctaanccggttgttatggattgtttccccgaactctaccctattcacatccagcctggcccactccattctgcgccggttctgccgcccaataaccctcacaatcccgcgaagcctgcaccgctctcatgctcaccccggcctactcanncccgcacctcttgcgnacggcctggcagatncntgcccttccactttctgccgcccgcnnccaagcacagtgagccnctcccacgccgccttcccagctacccatatcccagcagggatttttctgtctaacct

SEQ ID NO: 561505 - DNA, 127 bp, Homo sapiens
attagagcgatgcttatctggtatcccacccctcggtctcagaagtaagaaaaaaaaagtgtgtgtgtggggggacgggtaactaaatagagcaatactgtatatgtaaacatacagcaatggtatg

SEQ ID NO: 561506 - DNA, 234 bp, Homo sapiens
tcatctagaggattccccttaatgggccagaatagttaaacggtcatatactgtactactttctaccaagatcacgcagattgcagaagacctgtcatattacaggctatattcaactagaaaagctgtcagcgattatatacgctaaagaaatgcagtatttactgtgtgtcaggagacattagaaatcatctatacattatatttctgctgcccattgcaagggtaccgagc

SEQ ID NO: 561507 - DNA, 284 bp, Homo sapiens
agccttacccttaaggttcaatcaattttcaccttccaccagaaattttcacttagtctctggacactgactatatggttttttgttggttggtgggttgggttttaatgaaaaaggaatttctgaagaattaaatggaagattaagttacagagaaaaggccatatggactatatcctatttccaggattcaggtaataacaagagcttatctgcattttctgggaagaaagcactcttctggataggaacttgaagcagcagaatgctttctggccaagagc

SEQ ID NO: 561508 - DNA, 319 bp, Homo sapiens
gagctgacattgatcacgtacctatttggtgtaagaacagccaacgacagcgagtcatgtttagacagagtgaaaaactgaatggtgtcctagaagcgacgccgtctctgggataacatgcggaagctgggggagtgcatagaagaggcgcaccagataactcatgacggctacttgaaactctggcagtctgagcaagccttcgctggcctcttttgacgccatctttgtgcatgaggcccaggactggacaccagctatcatgaacatagttctgtctcagccctgtgggaaactctttgtaagggatagaccgcga

SEQ ID NO: 561509 - DNA, 316 bp, Homo sapiens
cacgaggggtccaagcatttcctaggatatgcggcggtctgcaatggtttcaagacagcgagtcctacaagtcatgtaggacatcggcgcagcgcgatgcaaacctgagcggtttttatcggccggcacgccgtcgggcgttgcgcgcccgtccggcgcgtccccccggatcgcgaggtggcggcgggtttcggtgtcacgccaaagcctttgacgatgaatccggcaaatgacttcgcgtgatgttgtactgactttatatttgtttgtggctcaccgcaatcggaatagactggtcctggagtccgggcgcctg

SEQ ID NO: 561510 - DNA, 456 bp, Homo sapiens
gggtggcccgggcagaagtgtctgtgctgcaagcaggagcgctcatgctgggaaggcagacacgtggcccaggcgtcaggtttgaacattcttgacagcaagtggctcacccgtcagcgtgctgctttttcccatcccaggagttggacttgacctgtggacatttggctgtttttctttttgtttttaagccagaaacactgtcttgtttccagtttaagatgtagagagggtgaaacagtcagaaactgggtcagaagcagcgtggttctcgtggcagggcggcacttggcccaagactcgtgctttggcgggaggctcaagtcaggcgtcccagcagcttcggtgcaacgcctcctgcccggctgcgtggggaggccctccaagacaccagctggtctcaccgcgaggcctgacttcgagccagagcagcgagtacattgcgtctccgtgtgg

SEQ ID NO: 561511 - DNA, 310 bp, Homo sapiens
cgcaacctctgcctcccgtgttcaagcaattctcctgcctcagcctcccgagtagcaggaattacaggtgcccgccactacgcccggctaattttggtatttttagtagagatcgggtttcaccataatgggtaggcgggtctcaaactcctgacctcaggtgatacgcccacctccgcttcccaaagtgctgggattacaagtgtgagccaccgagcccagcctctgtggcaattcttgaacctgaccttgatgagggttatctttttttttttggaagaggagtctcgctctggtgcctggccggaat

SEQ ID NO: 561512 - DNA, 1215 bp, Homo sapiens
gccttgctcgtctttcttctcttcgttggcgctcttgttcgcttgttgtgtgcgttgtcgtgttgttttgggtcgtgttcgttatgctctgtgttgtgtgcgtctgtggccgctttgtgtgttgttgtttgtgtttggtccttgcgtccttgtgtcttcttgtgttctgtttctcagcggggggtgcatgggtgtcgcgcccgattcccatggggggctgcggcgggtttgtccgcggatgggcccgtgtgcggtgttctactttcctggctctcgtgctgtcgttcgtctccgctgattgggcgctacctagtgattgtgcgcgagtatctggggttgtcgtctgcggcgtcaagcgctgcgtttgcctagccttgccttgggatgctgccccatggcgcacccgttgtcggtcagccttgaagtatcacgtcccgatgatatctgtcgtgtttcttacagactcagcccatcgcacggctcgacggcctgttcctgtaaggcgcgacatcgacgtccgggtgcagattggttcatcgagtacctgcgggcacttggtcagtccgctcaggtgttgatctgacaagcgggagcagttctcacgatgtggaagtcgcactcgggtggcctattacgttgccgcatgcgatgactcttgagtctacgtggacgctcacgatgccattggcaatggccgcccggcgttcactcaagccactgcctgtgagcgccaagcgtgcttgcgtcctcgggtcatgccacgtgtgagggccagaaatcacattgttatcattccgccctggcgccgcatcctggcgtggttgaggagcgtcacactacgactacaagttcctccatacgaggagtgccacgcaacaaggcatgcccgtggcaagctgtggctgccaaggcagctgccgctcggttcccttaagctgaggcctgctggcatgcgccatccagcgagcccgctgcacagcctcctagcgtgccgtcgactgtccatctgtgacccctagcctgggggactccgctagcccgctcgccagagcatgtcactccccaccctcatgttacagggtggatgtgggcatgcaggtgacaagggcccatgcctccacccctccagcccatccagcaatcagccccctgttctgactcatgggggcgccaggatgtagatattgtacaaaggtttctaaatcccttcttttt

SEQ ID NO: 561513 - DNA, 905 bp, Homo sapiens
  misc_feature (41)..(41): n is a, c, g, or t
  misc_feature (70)..(70): n is a, c, g, or t
  misc_feature (94)..(94): n is a, c, g, or t
  misc_feature (97)..(97): n is a, c, g, or t
  misc_feature (108)..(109): n is a, c, g, or t
  misc_feature (117)..(117): n is a, c, g, or t
  misc_feature (126)..(127): n is a, c, g, or t
  misc_feature (139)..(139): n is a, c, g, or t
  misc_feature (141)..(141): n is a, c, g, or t
  misc_feature (147)..(148): n is a, c, g, or t
  misc_feature (151)..(151): n is a, c, g, or t
  misc_feature (156)..(156): n is a, c, g, or t
  misc_feature (158)..(158): n is a, c, g, or t
  misc_feature (164)..(164): n is a, c, g, or t
  misc_feature (173)..(173): n is a, c, g, or t
  misc_feature (177)..(177): n is a, c, g, or t
  misc_feature (181)..(181): n is a, c, g, or t
  misc_feature (192)..(192): n is a, c, g, or t
  misc_feature (199)..(199): n is a, c, g, or t
  misc_feature (201)..(201): n is a, c, g, or t
  misc_feature (209)..(209): n is a, c, g, or t
  misc_feature (217)..(217): n is a, c, g, or t
  misc_feature (229)..(229): n is a, c, g, or t
  misc_feature (235)..(236): n is a, c, g, or t
  misc_feature (250)..(250): n is a, c, g, or t
  misc_feature (259)..(259): n is a, c, g, or t
  misc_feature (272)..(273): n is a, c, g, or t
  misc_feature (289)..(289): n is a, c, g, or t
  misc_feature (324)..(324): n is a, c, g, or t
  misc_feature (332)..(332): n is a, c, g, or t
  misc_feature (387)..(387): n is a, c, g, or t
  misc_feature (392)..(392): n is a, c, g, or t
  misc_feature (398)..(398): n is a, c, g, or t
  misc_feature (409)..(410): n is a, c, g, or t
  misc_feature (417)..(417): n is a, c, g, or t
  misc_feature (422)..(422): n is a, c, g, or t
  misc_feature (433)..(434): n is a, c, g, or t
  misc_feature (437)..(439): n is a, c, g, or t
  misc_feature (442)..(442): n is a, c, g, or t
  misc_feature (451)..(454): n is a, c, g, or t
  misc_feature (463)..(463): n is a, c, g, or t
  misc_feature (466)..(466): n is a, c, g, or t
  misc_feature (468)..(468): n is a, c, g, or t
  misc_feature (473)..(473): n is a, c, g, or t
  misc_feature (480)..(480): n is a, c, g, or t
  misc_feature (490)..(490): n is a, c, g, or t
  misc_feature (494)..(494): n is a, c, g, or t
  misc_feature (498)..(498): n is a, c, g, or t
  misc_feature (500)..(500): n is a, c, g, or t
  misc_feature (520)..(520): n is a, c, g, or t
  misc_feature (531)..(531): n is a, c, g, or t
  misc_feature (538)..(538): n is a, c, g, or t
  misc_feature (541)..(541): n is a, c, g, or t
  misc_feature (566)..(566): n is a, c, g, or t
  misc_feature (583)..(583): n is a, c, g, or t
  misc_feature (679)..(679): n is a, c, g, or t
  misc_feature (734)..(734): n is a, c, g, or t
  misc_feature (818)..(819): n is a, c, g, or t
  misc_feature (886)..(886): n is a, c, g, or t
gaggcttttgaaaacctaggcaaaagatctctggaagcagntaggtgcctgcccaagagcgttcatcttnatcacttccaaagaccaaccccanacntagcgctattnncccgcagnagacatctnncctttactttcngngaattnnttntggantntttagntagtcagtntctnccanctaaactcttncagtccnanataaagangtgccagnccacggaaggantctttnngatgaaattaaagnagattttgncaagcttcatcannagtattgcctcaaatntcctgggcagatgacagtgcctttatgtattggantgtctacngataaagcaagtatggaagttcgatatcaaacatttgtcttttttggttttttanttccntgttcnttatttttagnntttctcnttttnttgcttttttnntcnnnttntttgctttnnnnattcttctnttntntactncaatttntgctccttcntctncatntnttgctcgtgccatcatcganggttggcacgngggaccntcngttccatgcaaaaagtcccaggctntcagaaccccagggctncggacgccagggctattccctgggtgcctcagatggggtggacaacaccgtcagaccgggagaccagggcagctcttcacagccctactcagaagngagaggagagaacacgtcttacaggatggaagagaaaagtgatttcatgctaganaaattggaaactaaaagtgtgtagctaggttatttcggagtgttatttatcttcccacttgctctctgtttgtatttttgtttnntttttgattcttgagactgtgaggacttggttgacttctctgcccttacaagtaaatattagtaacntcggttccatcagaataac

SEQ ID NO: 561514 - DNA, 298 bp, Homo sapiens
ttttgaagttggagtcttgcctctgttgcacaggcctggagtgcagtggcgtggtctcggctcactgcatcctccgcttccccaggatcacttgtcatgacttgagaccagccctggacaatatagatacagcgtgtttcttcaaaaattttaaaaaattagccaggcgtggtggtacatgcctgtgattcgagctgctcgggaggctgaggtgggaggatagtttaagcacggaagattgaggctgcagtgatctttgatcctgccattgtactccagcctggcaacagagtgagaa

SEQ ID NO: 561515 - DNA, 552 bp, Homo sapiens
  misc_feature (358)..(358): n is a, c, g, or t
ttccacagcggccaattcttcagagcacaaagaacggggcgacgcaggccagaggtggtgggagtccagccctttggttcggaatcccggctctccactggtccagggtggttctcagcaagccctcgggctttctccaatgcacacgcatgggttcctacaagcaattccaacactccagaagaagacatcccagtgtaaaatcgggatggcaggggacctggggacaccggttgtgacggggcagcccctggggctccgagtccacacactcccacggggaggggcaggggcccctatcctggctcacacgcgggggtcccccagccctctgattctcacagagtcctctgtccanagaacaagctggtgcacacacggggcggtcagtcctgggattcaggggggcccatcggagctcgaactcaagggcctgacctagggacgcctccagtcccacccctaccttgggggggtgggagaatcaccgtgcaggtcactgacccattggacacagatcaccattctctcccgccccagtttcttcctccg

SEQ ID NO: 561516 - DNA, 1189 bp, Homo sapiens
ggtcgtcgcctgccatcctcgggcgagtcgcttctttcggttctactgggagaatccaccgccatcctgccgaccatggtggaacttcagggtagacagatccggccatcatggacaagaaggccaacatccgtcaacatgtctgtcatcgcccacgtggaccatggtcaagtccaggctgacgagactcccgtggtgtgcaaggcgggcatcatcgcctcggcccgggccggggagacacgcttcactgatacccggaaggacgagcaggagcgtaggatcaccatcgaagtcaaactgccatactaccctctgtctacgagacgtctcggagaatgacttgaagcttcatcaagcagagcaaggacggtgcacggcttcctcatcaacctcatggactcccccgggcatgtctgacttcgtcctcggagagtgactgcttggcctccgagatcaccgatggacgcattggtggagagtggactgaagtgtcagggcgtagtgcagtgcagacggagacagtgctgagagaaggccaatatgccgagcgcatcaagcctgtgctgactgatgaaacaagatgggacccgggcccctgctggagacatgacaaactggaggccagaggaagctcgtacaagaactttaccaacgacgcaatcgaggggacgacacgtgaaacgtcgactcaatctccgacgtaagggagacgggcgacgacacgaggcacacaatggggaaaacactcagtgaagacagaccgcatatgaccatacgaggacacaaggagggcgacaaagagacgaacatggcacaccacacgaggggagggggaccactacaagaacctagcacagaacacgagaaaagggcccgacacaaatggaaaattgatgggggccaaagagctaaggacacggaccaacaaaggaaggaggtgaacgggacgacccagagaaaggagggaggacaatgaacacaaaaagaagggggacaccaagcaggaacaaacggggcaagcacagggggcaccaatgtcgatgtgcaacacacacacccgagagaggtgaaccacgagggaaacacgcacatgggcaccccacaaaggaacacaaaggagggaccagcagacgtaacgaacaaagagaaaagagacacaaagtgacccgaaaaagaggggaacaacaac

SEQ ID NO: 561517 - DNA, 236 bp, Homo sapiens
ggtcggaccgtctctccccagaataagggactacaggcgtgtgcaacacacccggctaatttttgtatttgtagtagagacggggtttcatcatgttggccaggctggtctcgaactcctggcctcaagtgacacgcctgcctcaacctcccaaagtgctgggattacaggcgtgagccaccgcacccaggtgaaagctattttctgtaagcccttgaaaaaaagttgtgccactt

SEQ ID NO: 561518 - DNA, 169 bp, Homo sapiens
tcactcgccagggtcatatcttcgcatgggcttcaccgcatgagccagtatagctggcctgtgggacccggtaacgcagctggaggcttgggttttgctgcgtcgcgtgaaggatcctgcgctggcgcccccacctggtgatgccgagtccctgggggcgggcagaggg

SEQ ID NO: 561519 - DNA, 948 bp, Homo sapiens
  misc_feature (75)..(76): n is a, c, g, or t
  misc_feature (83)..(83): n is a, c, g, or t
  misc_feature (118)..(118): n is a, c, g, or t
  misc_feature (144)..(144): n is a, c, g, or t
  misc_feature (158)..(158): n is a, c, g, or t
  misc_feature (170)..(171): n is a, c, g, or t
  misc_feature (173)..(173): n is a, c, g, or t
  misc_feature (192)..(192): n is a, c, g, or t
  misc_feature (379)..(379): n is a, c, g, or t
  misc_feature (394)..(394): n is a, c, g, or t
  misc_feature (463)..(463): n is a, c, g, or t
  misc_feature (506)..(506): n is a, c, g, or t
  misc_feature (552)..(552): n is a, c, g, or t
tgcaggaattcggcacgagggttcatctacaatggttaccataaaaaatctggcaggattttaaaactcaatcannctttccnttgagctagtgacttgaaaagaaagagagaagganaagagaccatattaagtccatgccanttgcttggctagantatgatcaacgnntngtagtagactcaagttttnaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacanagtgctcttacacanaaacttgaaaatttgaaaaacatgacttttttaagcttctcatctcaccagtcttggtgttatattganatctatcaaagtagaaataattgtgctgatacacatacatggnaacataaggagtggatcctctggataaatgaatcacactctggtancaactacagaacctcttgatcagccagtagtggatcaggctgagccccgatgcccacaacactgaacatgacagaccttcgaacctgcgtctgtgatgtttaggctttgaagtgcaatggaatgatatgccgctgcggttatgaaagtggactaagcagagtcacctcttagtatggacgattcaaggaggttgcttgccaaaatttgcctgataagggcctgatcctgaaaaaaaaaaaaacattatcctaatctgtaaattatttctacatactactaaacagaaaaaaactcgggggccggaccaatgcctctatggcggtccaaatatgtcggcttaaacacggctggtaacctggggcccactaaacttgaaaaacccttccctgggaaat

SEQ ID NO: 561520 - DNA, 123 bp, Homo sapiens
  misc_feature (67)..(67): n is a, c, g, or t
atacgttaattatcatctggggcattaaacaagacttaatttaagttggcccaaataccaaagcatntgaatggccccaaatgggaccagaattttaaattcagatggggcttaatcacatta

SEQ ID NO: 561521 - DNA, 820 bp, Homo sapiens
gctactgccagctgtatgcctgagtgatgctaactacctgcgccgtggtgccggggccgggtcctgtggcccgatgtccccgctgggtccctggtacctgcgaggaggacgtgcgggggcctggagcccgcgtcctgtggcccgctactattgagggtcacattaacatgtcactttgaggatgctgtatgcgaattgcatcagccagatgtgggtgactagaggactgtacaacacaacttggtaactggagaatattgtcctaagaaatcaaagcgttctagaacacctatccaaaagtgcatgtgttagcatataaggcacaggcctctggaaatgtcagccaatgatccgagtaccatatttacgtcaggttgtacccagttaggttaagaaagcgtatgcgccgtgagacccttcacttgtctgattgatctgtcagggagaagtataagtccatgcaggtgtttgaccaaaaatgataccaagttcttgagatgagatccgaagcgaaaagagataagcatgcattgtgaagaaaacagtttgaagaagtcgaccttttcaggatgcaggcagcatgaggaaacttgcagcaactagtttcagcgaaatggatgcagcaaagcaacatggcctcagcaggaaccgaaagcaacagcaggagctgcactggccctgaaagcaagacccgtcgggctcagagcccagaaggccaatcggccatactttcctgaaaaaatctgaacaggccaggttggacctagctgagaagttcaaggaggcttgaatgcagaaagaaatgggagaacttcttgag

SEQ ID NO: 561522 - DNA, 216 bp, Homo sapiens
cattttttttaaataaaaatactactaccaatttagaacaggtcagttaaaattaggtttctccaggtaaacacaggctttacagaaaacattatatattgattattctgaatctgagtgctctaagtaattttatgttatttattattgttccataatatttcattattttgaattgttgatacacaaagaataaacttgcccttgaaaaaaaaa

SEQ ID NO: 561523 - DNA, 104 bp, Homo sapiens
cattggataagcggatgaggggaagatagcaggtttcaaaggtcatttgttctcgtcatcagctcaccaccagctgcctcagtcggaatcgcctcagttgatag

SEQ ID NO: 561524 - DNA, 202 bp, Homo sapiens
cggactctactactgtatctacctagaaatgaaatggacgtacggacattaagagaagaatcttcagagagagtaacaatctgaaataacaggaagggaagaggaaaagaaaagatccagagccctagtatattaatatggagacccaggctgtaggaatgaacaaggaccatacatttttttttttttttttttttttttt

SEQ ID NO: 561525 - DNA, 1161 bp, Homo sapiens
  misc_feature (314)..(314): n is a, c, g, or t
  misc_feature (322)..(324): n is a, c, g, or t
ggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctattttagatggagttgctctggttcacacacctctgacatgatcattgccnacgcgctnnngcctcccgggttcaagagatcctcctgcctcaccctcccaaggtgctgggactacaggtgtgtgccaccagctcggctaatttttgtattttttgtagagatggtgtttttccgtgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagtgtaacgtaaagaagggcagatttattcggagaa

SEQ ID NO: 561526 - DNA, 984 bp, Homo sapiens
ctagaggatcccgttgccttgtctggccatataagggaatagtcagaggttcgggaattaaaatatggacatacgttttgcagtgggccatcatccaacccattaccatgggaatgatctggaagagaaaggtaacactgatgcagaagggtgaacccaaggagggagctcttgggaaagctggaggatacaacccagagccagaaatcttcctgccaagcttttttattttttatttttttttgagacagagtttcgctctgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagtgtaacgtaaagaagggcagatttattcggagaa

SEQ ID NO: 561527 - DNA, 378 bp, Homo sapiens
  misc_feature (46)..(46): n is a, c, g, or t
  misc_feature (67)..(67): n is a, c, g, or t
  misc_feature (241)..(241): n is a, c, g, or t
  misc_feature (360)..(360): n is a, c, g, or t
ggccacgtttgggagaatcatttgaagcccccgggagttgaccaanccctgggcaacataagtgaanaccttgtccttattaaaataaataaataaataaataggttgggcactgtggctcatatctgtcatccccagcattttgggttgccaatgcaggaggattgcttgagccccaggagtttgagaccagcctgggcagaatagcaagactccatctctacaaataataaaatattanccaggtgtggtggtgtgcacctggggtcccagccacctgggaggctaaggtgggaggtttgctcgaggctgcagtgaactgtgaatgcaccactgcattccagcctaggccacagaacnggaccttgtctataaata

SEQ ID NO: 561528 - DNA, 960 bp, Homo sapiens
atactaatcgctgtgcattatagctactctcataaccctcaagacccactccctcttagccaatatgtgcctatggccatactagtctgtggcccgcctgggaggcagcggtgggcctagccctactagtctcaatctccaaccacacatggcctagactacgtagataacctaaacctgagctccaatgctaaatgctatagtcggtcccgaactcagtgtgatattagctaccactgacgagtgactttcgcagaaaaaacgacataagttgagagatcaacacaacccgaccccgacaggcctagatttattgagcatcgatcccgtcctactattttgtatagaccataggaatcaacgagactaggaccgtattataggctgttccgccaagccttggccctccgtacccccataacaaaccgccccctcgtagtacttaatttacctgagtcctagccctgcacaatcatggcaagccgaacgccgacttagtcgcagggaaccactagtcacgaaaagaaactctacgctctctatactaatctccctacaaatctcgctttaattaatagcattcacagtcacagaaactaagtcatattggatatcgttcttcgagaccacgctgatgcccacctgggtatcatcacccgatgaggagaccagccagaacgcgtgaacgcagtgcagcatagttcctaattcttagacccgtagttagggtcccgttccgcttactccatcgcactaagttttacagttcgacagaaaacctaaagctcataaaacattctataatcaagctcacggccaagaattattcaagtccggaggcaacaatttatatgactagttacagcaagttggtacgaaaagaactctttaggtccacttgatcctaaagccagtaagccaacgggtcaagattgcggacccaacggggggtagcccaaa

SEQ ID NO: 561529 - DNA, 336 bp, Homo sapiens
ccccccctttttttttttacccccaaggggggttgagggggggttttccccccggaaagcccttttgcccccccccggaaaaaagggggttttcccccaaaagggggggggcccccccccccccccccattttgggccggggggtttttccccccccaaaaggttttgggggcccccggggggtttaaatgggggcccaaaaggggggggggccggcccccccccccccggggggccccttttccccccccgggggggtttttgcccccccccccccccttttaaaaaccccggggggggggggttccctttttaaaaaaaaccttttttccttca

SEQ ID NO: 561530 - DNA, 964 bp, Homo sapiens
gtccaagttagccatggttacctttaagccggcattaccggaattattggccccttccccaggccaagtttaaagtcaccatcttactcattccccccaatgtctgataagcttttccgagtgaggaaaaagttagtgactttttagaccagacatgcgccgtaaggcccttttttttttttttttttgagatgagagtgtctcattcctgttgcccaagactagagtgctgtggcatgatctcagctcactgcaacctctgcctcccgggttcaagcaattctcctgcctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagtgtaacgtaaagaagggcagatttattcggagaa

SEQ ID NO: 561531 - DNA, 347 bp, Homo sapiens
  misc_feature (225)..(225): n is a, c, g, or t
  misc_feature (232)..(233): n is a, c, g, or t
  misc_feature (261)..(261): n is a, c, g, or t
atggtgtgtagacagcatggaccagctgttgagccagattgggcaggaaaacacagaggagaaccgctgttctgaccgccaggttctgatcagtgctgacgaccgtgtgaaaaagtgcattggaggcgtcattttctaacatgagaccctgtaccagaaagatgataatggagttcccttcgtgcgaaccatccaggataaggtcatcagcgtgggcatcaaggntgacaannggtggtgcctctagctgggactgatggngaaaccaccactcaagggctggatgggctctcagaacgctgtgcccaaatacaagaaggatggtgctgactttgccaagtggcgct

SEQ ID NO: 561532 - DNA, 236 bp, Homo sapiens
cccataccggtgataccccatagtgctgggattacaggcgttgagccactgtgcccagccaaagtttatcaagtctttctaaggcctaaaacaaggcagaaattactaagagtctcactctattgcccaagctagagtgcagtggcacaatcatggctctctgcagccttgacctcccaggctcaatcgatcctcctgcctcagccttctcagtagttcggtactacgctttggca

SEQ ID NO: 561533 - DNA, 864 bp, Homo sapiens
agacagggccttgctctgttgcccaggctggagtgcagtagcatgatagttacaggaaaggggtcccaatctagaccccaagagagggttcttggatcttgtgcaagaaagaattcagggtgatgccacagtgtgaagtgaaagcaagtttattaagaaagtaaaggatgaggggcaccgtggctcactcctgtgatcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagtgtaacgtaaagaagggcagatttattcggagaa

SEQ ID NO: 561534 - DNA, 205 bp, Homo sapiens
cgtacgtgggttaccgtatgtacctcatataaattttagttgaatgtaggggcttcatataattgagtttaagcatttgcagactcttccataggtaatatggcccatttgtttttaatttccagatatagaaggcacaggtatccatcctatctcacttcataagtccactacttcacctggctcccctttctaagtactatgg

SEQ ID NO: 561535 - DNA, 259 bp, Homo sapiens
aatttagcatcttggccctaagtcttctctccctcaacgtatttatcccaaacagttttctatatataagaggaattctgctgtctgcccgtcaagatcataaaccttatttaacttgtcagttgacactgagcagcatgggcctcctggagtctagggtcgcatccatcttggtcctataggagcgtgtcctgagcaactgcagcgctgcctccccctgcatcccttcccccttgtgttggaaattaagcctttgcaa

SEQ ID NO: 561536 - DNA, 1065 bp, Homo sapiens
gatcgaggcaagatgcagctcatcatgttctgtgcattctgtaggacttatctgtgtatatagtgtacataaaggacagacgagtcctaattgacaacatctagtcttgctggatgttgaaagaggttgccacgtggtatgacaaaacgtagagttagtaaactaatatatttgtacattcgttttacaagtcctaggaaagattgtcttctgaaactggatgtcttctgggttgatggagatgggaagggttctaggccagaatgttcacatttggaagactctttcaaattataactgttgttacatgtttgcagtttattcaagactgctgtatacatagtagacaaataaactccttacttgaaacatctagtctatctagatgttcagaagtgcccgatgtatgttaaatgtataaggtagtaaaataccacttgtaaatatcttttgctaaaacttccctacggaaaaatgcttttggccacattggacattagtgaagcccacctttggtgaaccaggttatacgtaaatggtactaatacattggttcccaactaaggttctagaaggaggcgtacgggcagggacaagcaaatatgccacaacagggaactacttaactacacggtgttcactaccttcggcacgaatcatagaggacaaaccagaataccacatctgatatagacgagcatatcagtatagcacctgtataatacaaataagacggaacgccacatagacactacacgacggaaacaagagaccgaatcagcagcagcgacacgacgagcagcagacgacaaacacgagccagcaacaaacaagcagaagcagcacgagaaatagaagagcaggaagagaaggcaaaagaagatgacgacaaaaacgagagcagctagagagagcacacagcgcgaggtaggagaacagccaacacagaacaagaacgagaagacgaaaagaaaaaccccacaatcgccacgacacagcaccagcgcaccaaacgaagcagcagaagcagaaagaacagacaaaagcaccacacaccggccacca

SEQ ID NO: 561537 - DNA, 284 bp, Homo sapiens
ctgtgcttgggctgtgatgcggatcgcgcgtggatgaagatcgtgtcaggaagaggcaaccatctaggatcaggcggtcgtcccgcacgaccgtcctgccatggttcctgcacatgcaccgtgttcacgtggtccagggtctgcggggccaggtggtgcccaaagcaggatttctggaaagcgttagagctcttcgtcactgagcgcctggtccaggtcctgatctgagagcctgaagatgcgcgtcagacgcctgggcgcacgcgggcctcaactgcttggcc

SEQ ID NO: 561538 - DNA, 396 bp, Homo sapiens
  misc_feature (80)..(80): n is a, c, g, or t
  misc_feature (91)..(91): n is a, c, g, or t
  misc_feature (118)..(118): n is a, c, g, or t
  misc_feature (150)..(150): n is a, c, g, or t
  misc_feature (241)..(241): n is a, c, g, or t
  misc_feature (343)..(343): n is a, c, g, or t
  misc_feature (372)..(372): n is a, c, g, or t
cacgtctcgcctcctccccactactttctgggttccctaaggctgccgaagcgatggacctggagccgggtagtgtcccngcattgcgccnggtgcatccaaggcctcaacccgaagncacagccccgggagaggccaggcacgcgaggnagccacagctccaaggggcgccaagaaaagcaatgctcactcgccacgcacagggttcccgggaggtaagggtgcgttttcttcccatatncccggtgagaaaacgaggtcgagggaaaaggggatgatacaacttggagcatggcatatggactcagtgaacaaaggggacttgggagcaagaagcaacaancacggcaaaccgcagactcaaaagggctnttccggctttacgcacgcaaccct

SEQ ID NO: 561539 - DNA, 303 bp, Homo sapiens
  misc_feature (102)..(102): n is a, c, g, or t
  misc_feature (135)..(135): n is a, c, g, or t
  misc_feature (154)..(154): n is a, c, g, or t
taggtcagtgaaagggcaagtagtaagcggcctgcctcccttccctcagacctttccctcataattccagagaagggcatttttgtctttttaagcacagantaagggtggaacagtccatccttatccctcttntgggtggggcccggacccntaagtctttcccccggttaaggggtgggcctcattcctttccccccaagaatccattttagggcctcctgccagctgcccgggggctttttccaagggccatcagtgtcttgcctagcttgagggcttaagcccttatgctgtgttagt

SEQ ID NO: 561540 - DNA, 100 bp, Homo sapiens
ggtgtgttggggggagtagtcagtgacttcaggcaccctacaggcgctgctgctggccggctgcttcctcttcatctcccgttccaagccccagcgacca

SEQ ID NO: 561541 - DNA, 215 bp, Homo sapiens
  misc_feature (116)..(116): n is a, c, g, or t
  misc_feature (172)..(172): n is a, c, g, or t
aagagaatcaggatttcctccaggccccaggatggctctttcagttgaagcgccacaaaaggccaggcgcggtggctcgtacctgtaaccccagcacttcgaccgaggcgggaggntcacctgaggccaggagttttagaccagcctgggcaacatagtgagaccccatttntaaaaataataataataataattagctgggtgtggtggcatgc

SEQ ID NO: 561542 - DNA, 301 bp, Homo sapiens
tctggctgctcttgaggatacactaaagccaaccctcgacacacacattcacagttgcaggcgtgcaggtcggtggtgttacattcacacttgcagacgtgcaggtcgggggtgttacacacattcatgctgttgcaggcgtgcaggtcggtggtgttacacacattcacactgttgcaggcgtgcaggtcggtggtgttacattcatgctgttgcaggcgtgcaggtcagtggtgttacacacattcacgctgttgcaggcatgcaggttggtggtgttacacacattcacgcttttgca

SEQ ID NO: 561543 - DNA, 151 bp, Homo sapiens
gtggcacctatgatcctttctcgagctctcccaccaagagctaaaagcccagaacacaaggggcttccacaagccctatcccagtccaggggtagtatgtggtgtgatgggtcagtatccatgacatattcattattttttaaaatatcct

SEQ ID NO: 561544 - DNA, 386 bp, Homo sapiens
agggttaatgtagacacaataaaaggagggctgaagttgaacccaacttcctgggaacttcgggaaggagccccttggcccagcccttgcccatgagctccgctaccctgggggcgattgtagctctgacatctggatttgaactccaccctcatcacccacactccctattttgggccctcacttccttggggacctggcttcattatgctctctcttggcacccgacccttggcagcatgtaccacacagccaagctgagactgaggcgttaccacactcatagacattggcgggccactgttgcttgttgctcactgtgctgcttttccatgagctcttggaggccccaagaaataaactcgtaaccctgtcaaaaaaaaaaa

SEQ ID NO: 561545 - DNA, 851 bp, Homo sapiens
tgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaataaataattttaatatactagtcatgatgtgtgttgtattttaaaaattatctgcaacttaattcagctgaagtactttatatttcaaaagaatgaataacattgataataaaatcgtactttaaggggtttgtccaaaataatattgtggctttatttattcacacctaattggtagaacagtcattatttcacttctacactgggtgcggctggcttacttaaagacagactttttattaccaatcctaattggcctaaccacagaaaccaagattacggctacaacctcgctgtgacagtcggtaccaaaactccttgccgcgcgctaaaggagaagccccacattaggggggcccgggctaaccttggggaggcacacacgaataccgtttacccccgggagaacccggggcacgtgcaacacctcacgctcaag

SEQ ID NO: 561546 - DNA, 110 bp, Homo sapiens
tctacaggatccccctctctacacattcagccctgcctgcggggagggcgaggacaagccgtgctccggccgtgcgggcagctgccagtgcgggcgcagtctgttgatca

SEQ ID NO: 561547 - DNA, 99 bp, Homo sapiens
cccccccccccccccccccgggttgattttttcaggctttggccccccccaaggggaaggggccacccccccaaatgggtttttaatgatgctttgata

SEQ ID NO: 561548 - DNA, 960 bp, Homo sapiens
  misc_feature (595)..(595): n is a, c, g, or t
ggcggaatgggagtgggaattctgtttggtatgtagcgttcttggagtggatcgggcctctcgcgtgttctgatactccccgttgcattctgctgcctcggtgcaacgtaggatagtccactgggcacacgcgcatctcaccagggaagctctacaaaattgaatgtctgaaacataaggtcgaatatcaccatgagcagtgcgcaatagctgtggattaccatacggtgctcctgtctggctagacgcttccaaagacctgtgagcttggaggctcatggaactagctcttgtgcggagcatttggtatatcaagacgtcacgtgacactaaccttgcctagggtccagaaattggcctagtgaaagaacggaaagcaacaacctatcagctactggcaagacagtcattgcctaaatagaagataacactaatagaatggctcattgagaaaaggtgacctaatgtctggattggccagttgaccatgtggtcatgatgccatgtgccaagaagtcaggtagagcctgacgtccaggatagtcttgcatgcctctgtttatcacgcaacgagataaaccttgttcgtgctgangccctagtttctggggttgattaacgtagccctctacctaactgccaattgaaatagctactctgggactggtgcctccatgacagacacagtaacgaccctgatgatcaagcgtctttactcctgaaatggtacagtttcttggcagctaggactgagtggtgtaatgcgcggagcttgaattgggacgtctgaatcccaaaacctctttcgctattgggacactaattggttgaaccggatactgtagttgcttcattcttgaggatcaactcttgatggcaaatgcgaatgaagtcggaatgcaaatattacctagatagggtcctgggaatttcggtgaatactttgagaggccattctaa

SEQ ID NO: 561549 - DNA, 149 bp, Homo sapiens
ttcccttgatctcttaggggccagctgagcagcagcttcgaggcacctactgcgtgggcacccccccaacagtcaggcagcccctttcctggcagcacagcatggctctcttctccctgcccactgggaggagctccttgtggacatgg

SEQ ID NO: 561550 - DNA, 119 bp, Homo sapiens
catggatttgctggtgcagtacaactaggcttaatactcgaattcgaggctttattggatgctgctggtgtggcctctcctgttaactacagcagaagttgtagtcacagaaattccca

SEQ ID NO: 561551 - DNA, 470 bp, Homo sapiens
  misc_feature (36)..(36): n is a, c, g, or t
cagctccatctgtccggatgcctcttgtggcccccncagtgtcagggctgctctgagttggctgagcctctgtccagggctaggccatggccctccccgccccacgcactccaggccaggggcagtcagtgaagaggcaggaaggtccagacagctctacccctggccagagtgccagcccccgcaggcaagagggcttgctgggcagaacttagttggcgagggtgaggactgctgtggtcacaggcctcccgaaggacagggaccacagaacctagagggtgggaagggctgggagcaggtctggagtggggctcggggctgagggtgcacacagggggcctgctcagggacaggaaggacagctgctcaccctcaagcttcctgctggctatttaaagactcccttttagtctagaatagtggccttcccacagttttggtattaaaatgtccttttgtgactggaa

SEQ ID NO: 561552 - DNA, 252 bp, Homo sapiens
cgttttgcgagcttctctagcactatccaccttcggggtcgctattgctgcctcgtcgattatgcagacagcctgcttgctgctgcggtgtcatctagagcacgctggagcagaaggctgttggagctggcgaagtcaccaagtctgcccagaaagctcagaaggctagatgaatattatccttgatacctgccaccccattcttaatcagtggtggaagaacggtctcagaactgtttgtaccttttgggc

SEQ ID NO: 561553 - DNA, 228 bp, Homo sapiens
tctagaggatactggcgccctagcacttccggacgggctgcgcacaacgagggcacacgggcagtggacagaagcgatccatttcctcgagcgtcaggctcccctggagccgatcgaaccgtcctgccctgctcgcccgcgccgcgcgcgaccatgtccgcgagcagggtcccagcgggcgcaccgggcatatctcggccgatggcggcaggaattgctagggcggcc

SEQ ID NO: 561554 - DNA, 345 bp, Homo sapiens
gcggggctcatctctgagggctgcgttctggggtaggagtttcgcctcagtaactgcagcacttatctgcccatggcaacctgtgctgatttcacatatctcagaaaatcccgctcttggagtactacacttgtaacatctgcttagcacattttgaaaaatcgacgatgacgagtaataaagtgtggacaaagctctgcagggagctcgtaagaaacgctgatacgaggccgggcgtggtggctcatgccaatattcccagaacttgggacgccgaggccagcggatcacgaggtcaggagatcgagaccatcctggccaacatggtgaaaccccgtctctact

SEQ ID NO: 561555 - DNA, 399 bp, Homo sapiens
cgaaaacgcaagaagactgaagactcttcttcaggcaaatcagtggcgtctgatgtccctgagggtaaagttaaaatgacatttttttcttacccatatgaaatctaaaagtcggccgggcgcggtggctcaagcctgtaatcccagcacttcgggaggccgaggcgggtggatcactaggtcaggagattgagaccatcctggctaacacggtgaaaccccgtcagtactaaaaggtacaaaaaattagccggacgtggtggcgggcgcctgtggtccaagctactcgggaggctgaggcaggagaatggcgtgaacccgggaggcggagcttgcagtgagccgagatagcgccactgcactccagcctgggcgacagagtgagatccgtctcaaaaa

SEQ ID NO: 561556 - DNA, 288 bp, Homo sapiens
tctggggctttatacagtgcacacaaagtcatactgaaagtaagacccatcccttgggcggcgtatctggtataaagtaactttactccatatgtacgtgtgacacagaagagctttacaccacgtgtcatcatgtaacctatagagacaaaactactaccacaagtaatatgggcttacaattataacacacaacctgtgagagggcatgatacaattaaatataggatagccatcttggatcattatcactactactgtctgctcaaatttctgtgcccataccaa

SEQ ID NO: 561557 - DNA, 521 bp, Homo sapiens
cggatccttagttcgacggacattcacatatctgcatgggctgggctggacagtgtcatgcaagggatgtgatacaagtgcaggttaaagcagaagtgtgtgaaagtagtaggatgggtgagttaagagtgggatggaggccaggtgtggtggctcatgcctgttatctcagcactttgagaggctgaggcgggcggattgcctgaggtcaagagtttgagaccagcctgactaacatggtgaaacgctgtctctactgaaaatacggcaattagtcgggcgtggtggtacgcgtagtcccagctacttgggaggctgaggcagaagaattgcttgaacctgggagacggaggtcgcagtgagccaagatctcaccactgcactatagcctgggcgacagagcaagactccctctccaaaaaagaggaacacaaaaaaggacgaagaattgagatgtataccaggcttaatcttcagggtacctctagatcaaggctcgtctaacacttgtggcccaggat

SEQ ID NO: 561558 - DNA, 335 bp, Homo sapiens
  misc_feature (7)..(7): n is a, c, g, or t
tggtaanataatgggggatacactgcacaagaactctcttgccaacaccacgtaagtcccatggctttccattcgtcttccaccatgatagtgaggtctccccagccatgtgcaacatgtgagccgcataaaacttcgtttcctgttaagaaattacccagatttcaggtcatgtctattattacgcgccacgcagaacatgactaacacacagtagctacaatctgctgatcacttggaaaggggcctcctagcaagacgaatgtcacactagcacacgactctcacaaaccactgacttttccacattgccctcaagttcagcagccatgggt

SEQ ID NO: 561559 - DNA, 141 bp, Homo sapiens
gaccacgcagtggtgatcctgagagagaggaagtgtgccctgcatcttgaggctatgggtctgtccaataattttaagcccctgggctatgctaacccagtgcacttatacacacacacatatgaatgtgcacatacatac

SEQ ID NO: 561560 - DNA, 134 bp, Homo sapiens
  misc_feature (34)..(34): n is a, c, g, or t
ttatccggtaccacgcagctggtttgccatttcntgccatgtatgtgctacaaagagtcgggaaagggattccatgaggccaacagttcggatataggacaaaaaaaaagaaacttttaacctctgttctgaat

SEQ ID NO: 561561 - DNA, 148 bp, Homo sapiens
tgtgtacagcatttaccaagatagattgtaggtaaagaagggcagatttattagagaaattgtgaaaatatgttagcagatgggcagctcagacagagtaaggggcatacctgcaaacgaggcaacgggctaggaggaaacgtttaat

SEQ ID NO: 561562 - DNA, 999 bp, Homo sapiens
  misc_feature (422)..(422): n is a, c, g, or t
  misc_feature (454)..(454): n is a, c, g, or t
  misc_feature (549)..(549): n is a, c, g, or t
  misc_feature (647)..(647): n is a, c, g, or t
  misc_feature (664)..(664): n is a, c, g, or t
  misc_feature (891)..(891): n is a, c, g, or t
caccgagtgttcagctgggcgggggcaggaattgggtggtcagcaggccgccaggcgttgcctgggtgccgaagcgcttgagcagtgctgcttgcttgtcggcactgaggcggttccagacttcgaccatctgcaaggcagcgtcgagtacagcggcgtccggcgtgtcggaaggggaagtggtcatagtgaaggtctcggataattcaggcagtgtggaaagcgctcaaaggcgcgctttccacacggtctggtacggcgtcagtctcggctttcgcgctcgactggttttgcttctttggcctcaggctgcttgtcgctggcctgctgcggtgttggctgctcagttgggtgcaggtttgggaaggggagattaggtatctcgtgcatcgtggtcgctcctcgcaaggtctgttttttcnatcgcaggtgattccgcgctctcaaaaagccntggcaggatacagcaccgtaaatgacaaaaagacttttatctccacagatgcacaatttttaatggttcaggcgcaagtgacatgaggtcacacncctagaacggcaccttgcccaggatcatgtcgcggtacatcacaaaatcccccagcaagctgtagaacgggtgctgaaaggtggcggggcggttcttntcgaagaagaagtggcnatccaggaaagctgtagcctgccaggggcaacgccagcagcagaaccaatgagcctctgccgatggcgtacgcgagaatgcctattaccagggtggtgccgataaagtgcaggcgtcggcaggtgctgttgccatgttcgctcaggtagtacgggtagaactcggcaaaactgttgaatttcttgatgttttccacggtcaccggccctctggttgctgtgccgccnacgggtgcgcggcggggagcttatttgagtctagagtgatcagtgctaacagccagtgacaatagatgccactttagtatccttggagataggcgcgtaaatagcggc

SEQ ID NO: 561563 - DNA, 473 bp, Homo sapiens
  misc_feature (42)..(42): n is a, c, g, or t
  misc_feature (49)..(49): n is a, c, g, or t
  misc_feature (60)..(60): n is a, c, g, or t
  misc_feature (112)..(113): n is a, c, g, or t
  misc_feature (170)..(170): n is a, c, g, or t
  misc_feature (471)..(471): n is a, c, g, or t
tgagaaaggggtattgaaacttccaactataattatgatttntctgttntctttacagtnctctcagtttttgccttcatatatatatacatatatatgtatatatattatnnttttttttttttttgagatggagtcttgctctgttgcccaggctggagtgcagtggngtgatcttggctcactgcaagctccgcctcccaggttcacgccattctcctgcctcagcctcccgaatagctgggactgcaggcgcccgccaccacgcccagctaattttttgtatttttggtagagacagggtttcaccatgttggcaaggatggtctcgatctgacctcgtgatccgcccagcttagcctcccaaagtgctgggattacaggcatgagccactgcacccagcccatatattttaaaagctctgttattggggtacattaaacatttagggttgttatatcctttgatangg

SEQ ID NO: 561564 - DNA, 201 bp, Homo sapiens
  misc_feature (201)..(201): n is a, c, g, or t
aggacatccttcagagattggcaccattccttaagatgtatggagaatatgtgagaggatttgataatcagttggaattgggttaagaacatgacagaacgtattccccagttcagatcagtggttgaagagattcagagacagagaatctgtgggagcttaactttgtcagcatcacatgctagagcctgttcagcggan

SEQ ID NO: 561565 - DNA, 332 bp, Homo sapiens
tctatccttctcagtatctcagttacctgattcactgaggattctgggaccagttcatacaagttctatgcacccctcttctatgtctcattagggcagactcccaatgtccctgagactaacccactttcaatctgcccttcaatgtctcttttattcctcaactccaacaatcttcatccataccaaagaaactcatttctcatggacagcagcaatatgcgaattactctgcctctaaaatcttgaactatagtatctcaacagctagtagttcttcagctctttacaattaacaacagctgctcccagggtcattctgtctccagtat

SEQ ID NO: 561566 - DNA, 636 bp, Homo sapiens
  misc_feature (23)..(23): n is a, c, g, or t
  misc_feature (27)..(27): n is a, c, g, or t
  misc_feature (30)..(30): n is a, c, g, or t
  misc_feature (72)..(72): n is a, c, g, or t
  misc_feature (91)..(91): n is a, c, g, or t
  misc_feature (102)..(102): n is a, c, g, or t
  misc_feature (112)..(112): n is a, c, g, or t
  misc_feature (135)..(135): n is a, c, g, or t
  misc_feature (145)..(145): n is a, c, g, or t
  misc_feature (189)..(189): n is a, c, g, or t
  misc_feature (214)..(214): n is a, c, g, or t
  misc_feature (314)..(314): n is a, c, g, or t
  misc_feature (397)..(397): n is a, c, g, or t
  misc_feature (563)..(563): n is a, c, g, or t
  misc_feature (575)..(575): n is a, c, g, or t
  misc_feature (590)..(590): n is a, c, g, or t
cttctggggtccggcgccctggnttcntgnttctgccgctgccgccgccggtataccagtggctcggcgtgntcggctcccacaggcttgnagaatagaatnagaaaagaanttaggggggcgcggtggaaagtnggccggtgtnggaggaaaggtgaaatgaatttttaagcgaaaagctaggggaanaggtaacaaaatcttgtttgcaaanaagaaaggaagctaatgaatatctgcaaagtaaggagtttgactcagtaattttctcattcatgcataaaaagaagctaaaaatgacacagcttatttancatgcccctgacactgcactgagcactttatgagcttgaactctgttaatcctcacgaccacctcatgagactctccagaaanagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaaganagtaatcaaaangatgagcgttctaantctctgctgcttagtggccaagaggtaccatggttgtcatcagtca

SEQ ID NO: 561567 - DNA, 469 bp, Homo sapiens
agcgggggtgacttcaaccccctcttcgggaggctggtcgtcatgatccggaccccattgtcggcctctgcccatcgcgcgtgctcctcccaggactcccgacggccgacccccgacgcaacatgcagcccacgggccgcgagggttcccgacgcgctcagaccggacggtatctgcggcgtcatgctgctccatgctactgtctgctgtctgctgcggcatgcccgtaacccgcgcggagaccacggccgggtcgtccccgcagagaccctcgtccacgactgggctgcccccaggcctcttcaccacgtccggggtgtcccgcagcgccctcgacataccccaaggcctcacatacgcgcaggcacacccgcaaaagccctgggaccttcggaggtcagcgcgcatggcccgtgatgcgagagttgtgcccagctcgtggacaggccgacaaaatgacctgcaccca

SEQ ID NO: 561568 - DNA, 421 bp, Homo sapiens
ctttggttatagctgtctttctctttcttattcggcgattctctaaatagtcgttcgatgtagattattgttatcaggtcgctagggcgccatgtggatgaggaagaggtgtagaacaagatagtccgtattgggtgcgtacgacggacagagtggagtgaagaagagcgcgcaatcgtgccggccagcattcgttctatgacggccacgccggcgatgttggaatgcacacatcatcgatggtgtcccagaggcttgtgactaatatatgatagaggacgcattcgtatatatagtaaaattaattctcgttgtcgcagcgcggctcagaagtggtatcataactgtttgcaccggccgtggagcacccctggtataaactgtcgcccacccctttgtccgcccaatacaatagacaaga

SEQ ID NO: 561569 - DNA, 138 bp, Homo sapiens
gcccgcctcgtgaactatcacaaattgtccattactcagctagattaagaggtttaaagccacaggacgggcagagttaagagcaatataaagacattgagggattggctgaggctttccctgggaacactgggagag

SEQ ID NO: 561570 - DNA, 122 bp, Homo sapiens
gccgaatgatattcctattcgcctacacaattctccgattcgtccctaacaagctaggaggcgttcttgccctattactatccatcctcatcctaacaataatcgccggtcactagatgggg

SEQ ID NO: 561571 - DNA, 344 bp, Homo sapiens
tgatatagcccatctcagccccgcaagagctaggattaaggcgtgagacacgaaaacatggaggccaaatgagagtattctatagataagaaatagtgtgtgtactcaggagaaatactgatatagagatccaggaatgctgcagacagccataggtggcctttctggtatctcggcaaggagtttgcctatttttccctctctgccgccattgattttcacttgctaatagataactagagcttacccaagaccaggtcatgtgagacacagaatctaagcatagctgctgaagggatgatttagtaaagatctaacctcttctttgggcacacattatggag

SEQ ID NO: 561572 - DNA, 669 bp, Homo sapiens
  misc_feature (644)..(644): n is a, c, g, or t
  misc_feature (669)..(669): n is a, c, g, or t
gcatggtggtgcatgcctgtaatcccagctacttgggaggctgaggcaggagaatagcttcagaggttgcggtgagccgcgattgtgcgactgcactccaacctggtaaacgagcaaaactttgtctcaaaaattacaagaaaattcttgattaaaaaaacaaaaccattatgtgggacgctgaggcaggagaatggtcttgaacccgggagggcagagattacagtgagcagagatcatgccattggtactccagcctggtgacaagagcaatactcggtcctcgggggaaaaataaatcattatttaatcatggtggtttggattggcagggctcaagtaaagctctttgtgacaggggccttttcagcttaaatcaagatattcctgtttcaagggaacatttaagagatttcctagttcaaattaacaggtatgtattaatggctctggcagaaatattaggggtaagatgtgacccatttttatgttacatgtgtagaaatttttataacgtggattggtcaatgccaaataaatgggggtttcaagataatacgtttacaacaattctctgtattcaaaaaaacctgagatggtaatacagttgaacaaattaagtccaagtacggatacgatatgtntcgagaatgttatcggataactttn

SEQ ID NO: 561573 - DNA, 538 bp, Homo sapiens
  misc_feature (48)..(48): n is a, c, g, or t
  misc_feature (57)..(57): n is a, c, g, or t
  misc_feature (115)..(115): n is a, c, g, or t
  misc_feature (119)..(119): n is a, c, g, or t
  misc_feature (122)..(122): n is a, c, g, or t
  misc_feature (125)..(125): n is a, c, g, or t
  misc_feature (130)..(130): n is a, c, g, or t
  misc_feature (170)..(170): n is a, c, g, or t
  misc_feature (172)..(172): n is a, c, g, or t
  misc_feature (297)..(297): n is a, c, g, or t
  misc_feature (338)..(338): n is a, c, g, or t
  misc_feature (356)..(356): n is a, c, g, or t
  misc_feature (439)..(439): n is a, c, g, or t
  misc_feature (479)..(479): n is a, c, g, or t
  misc_feature (513)..(513): n is a, c, g, or t
  misc_feature (537)..(537): n is a, c, g, or t
gaagcgcgcccgaacgaagccgcggcccgggcacagcatcggcccgcngcggcggcngcgctcggatgttcggcagcctcctgctcttcgccctgctcgctgccggcgtcgcagntctncangcntgctnctcccggagccccgaagctgagccagcaagatcaaggctncnctcgcgaggcaacctctgggccaccggtcacttcatgggcaagaagagtctggagccttccagcccatccccattgggaacagctccccacacctccctgagggaccaagcgactgcaagctgangtcatgatctgctcggaatcctcctgctaaagaaggctctngggcgtgacttcaagccngccccgcaccccaaatccagtacaggaggctgctggtacaaatacttgcagaaatggacaccaataatgggggaagacacaanagcgtggcttagattgttgcccaacccagggaaaggttgnttgaattgggaaccttgttgaatgggccccattnttggattgtaaatcctggaggctna

SEQ ID NO: 561574 - DNA, 522 bp, Homo sapiens
atgtcgcgctgctgcggtagcgccgcattgtctgcgctttctgcaatatatggtcgtgcggaactgctccagtttcctgatcaatgaggaatactcatgacctacagtgaattagaacgcacataacttgcatggcccgcacattccttccgcatactaatggatgtgatttcagcgcaagactgtgggcgtgaatgattaggcaggctcgacggtcaaaggtgtctcttgtggtcattaagcggagatccggccctagctggaatcctgccacctcctatgtgcggaccaccatcaacaagaatgctcgcgccacgctcagcagcatcagacacatgatccgcaagaacaagtaccgcccgactgcgcatggcagccatccgcagggccagcgccatcctgcgcagcagaagcctgtgatggtgaagaggaagcggacccggcccaacaagagctcctgagcccccctgccccagagcaataaagtcagctggctttctcaaaaaaaacacaccacaacag

SEQ ID NO: 561575 - DNA, 132 bp, Homo sapiens
ccccgagcaagacgacgaaaagagcagatagaacatacaaaaacgaatgataaacgaacataggaaggagaaaaaagaaaagaaatgaagaaaagaaacaaagagagaatagcacaaaaagaaagagattaa

SEQ ID NO: 561576 - DNA, 266 bp, Homo sapiens
gaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactca

SEQ ID NO: 561577 - DNA, 107 bp, Homo sapiens
aaaacacacaacgacacacgaccacaccctctattaggtgacctatagaacaagtctgttttattaaagcaggctggtacctggtcctggaattcccgggatatctg

SEQ ID NO: 561578 - DNA, 1008 bp, Homo sapiens
gtgcctggggtgtgctgctggcgttgggccctggagctgcttgagacgccttcgtcttcccggtgcgagctgctgctgctgtctgctgcggatgatcatcttgcctgctggtggtgtgcagcttgatctgtgctggctgcctgccatgcctggacccctgtgctgctgctctgtgccgtctggtgctgcctgtggctgctgcgtcatttttccttgtgtcatccactgcttgcttgtgctgtctgtgctgctctgtgacgttggtgcttgtgctgctcgtgctcattgcatgcctggtgctgcctgccatcctgcctgcctatcaacctgccctcctgttgtggatgccctgcggtgcatgttgcctgagaacatgccccccagcaatggagtgtgctctgattcagttccttggatcttggcgaggaaatatcttcccttccaaccttggtgtcagcagcctttcgctcatactctaccacactatgcaagcacgacggcaatatcacctggaaccagggttgacagtgtgccctgtgtgcggcacgcgaggttggagcggcgatgcaccctcctggagacttcgtgcaattgtttgccctcgtctccgcctgttggaccgcatcgctcgacacatcttgcggtagcccttgaacatgggcgatgcattgtttcaaaacacgcttttactctccaacatcccatatcacctagccgggacacccactggagtaccttgagtcatcccattggactccattgattgcatcacagccaccctgtagcggcatccatagttacccttgcttttggcctgggcacaatcactcctgctacgaccttggacccaattatgcccttacaccatcctatgtgcacccccattggcaaaacactaccctatcctggtcaccgacctgccctggggcaccacccaaccaactgagctccctggttacaaggccccccactctaacacacccctacaaccgtacaaaacccctacag

SEQ ID NO: 561579 - DNA, 254 bp, Homo sapiens
gttcgacgcagctctaggtgtccacgatcactgtaatgcacaggactccctacggcatcgctgctatatatgacgaatatgatcctatacatcgccgaatgctccttatgctatccgatctcactgatatatgacagatgcttcttatcggactcttactcctctgctgcaggcatatgagatcttatcaattaggagcgatgtatggtcttaaggacatagctattcctatgtcatctggattcatatggcgt

SEQ ID NO: 561580 - DNA, 441 bp, Homo sapiens
  misc_feature (322)..(322): n is a, c, g, or t
gagtctcactctgtcaccaggctggagtgtaatggcgcgatctcggctcactgcactccagcctgggcgacaaagcgagactctgtctcaaacaacaacaacaaaaaaatatcttagccctgccttgctgtacaaaggatttgagatggcataaactacagcatctacattaaagagaaaaataatagtagaaattaagagttggaaaaaggaagcatttagagcataaggccagtgtagttgctgttggtgcgacagctaaggcaagaaaagagacagtcacccctcaggtagttgttattgccaagatggaagagcaaanctgcagagaaccagattgcctggatgtgacttctggctttgagcaagatctttaacctttctgtgtctcagtttcctcatctgtaaaatggggacaatcttaatgcctacactagtgga

SEQ ID NO: 561581 - DNA, 264 bp, Homo sapiens
  misc_feature (1)..(1): n is a, c, g, or t
nggtgtatgcaggaacagctataactggtcgtcgtgtttcactgaggatagagctataactggtcgctcagttctgactgcgcaatagagtaataatcggaagaaaattaactatgactaacatctcagacgcgcagagacatataaaccgtctgaactatcctgaccggcatcatcctaatcctcatcgccctcccatccctacgcatcctttacataacagacgaggtcaatgatccctcccttaccatcaaatcaattggt

SEQ ID NO: 561582 - DNA, 521 bp, Homo sapiens
  misc_feature (114)..(114): n is a, c, g, or t
  misc_feature (402)..(402): n is a, c, g, or t
ctctactaaaaatacaaaaattagccaggcgtgatggtgggtgcctgtaatcccagctacttgggaggctgaggcaggagaatcacttgaacctggaaggtggaggttgcagtnagccgagatcataccattgcactccagcctgggcgacaaagcgagactctgtctcaaacaacaacaacaaaaaaatatcttagccctgccttgctgtacaaaggatttgagatggcataaactacagcatctacattaaagagaaaaataatagtagaaattaagagttggaaaaaggaagcatttagagcataaggccagtgtagttgctgttggtgcgacagctaaggcaagaaaagagacagtcacccctcaggtagttgttattgccaagatggaagagcaaanctgcagagaaccagattgcctggatgtgacttctggctttgagcaagatctttaacctttctgtgtctcagtttcctcatctgtaaaatggggacaatcttaatgcctacactagtgga

SEQ ID NO: 561583 - DNA, 225 bp, Homo sapiens
  misc_feature (85)..(85): n is a, c, g, or t
  misc_feature (185)..(185): n is a, c, g, or t
  misc_feature (200)..(201): n is a, c, g, or t
  misc_feature (211)..(211): n is a, c, g, or t
gttaaaaaaccaaaaaaaggaaaaaaaagactctccagccctggaaactataactcctctgcgagaggcggagaactccttcccnaaatcttttggggacttttctctcttaccccacctccgcccctgcgaggagttgaggggccagtttcggccgcgcgcgcgtcttcccgttcggcgtgtgnttggaccggggtaannggagggtccnggcgtactgcccgg

SEQ ID NO: 561584 - DNA, 191 bp, Homo sapiens
agcagctgtccaccttaagctgtagacgtcaaacggaacatctggtagctgtgttcgtcctggaattcaagaaggagagaggaattaggctgaggcatcagaaggaaagccattaggttctcgggctgctgcactgtccgatattgacttttctttctccttgctgtctgtcacaggaacccacttaaaat

SEQ ID NO: 561585 - DNA, 101 bp, Homo sapiens
agcacgtaggacacacgcgcctcgttcgctcttctcgggagccagtcgcgccacgccgccgccaggccatcgccacctccgcagcatgtcaccaggtccgt

SEQ ID NO: 561586 - DNA, 448 bp, Homo sapiens
  misc_feature (98)..(98): n is a, c, g, or t
  misc_feature (278)..(278): n is a, c, g, or t
  misc_feature (303)..(303): n is a, c, g, or t
ccaaactctgcccatcttacatcttccccgggtcaatccacacagggggtgtttgtgcctgagcccgccaacatgtgaggcgcccttcacacagcgcntgtgggaagatctacagccctgtttgtcttctgcgtgaacgccggtgtgtaagccgttgtaagggtgtaagcacgcaatgagaaaggcgcgtggagctgtctgtaaggcggcccacgggctcgcgtgtaagactgggttgtcccttacaaccccgccgagtgtctggaggagatggaggncccgcgttcgagaagatgtcgctcntgcccgccggcgccacacagcatcagagctactcgtccttggagtctcgaggttgaaaccacagattctggacgttcacgtgcactctcttcctgtaccgtatttattgttcctggcactttatttaaagatatttgaccctcca

SEQ ID NO: 561587 - DNA, 159 bp, Homo sapiens
caagcagttaatacagactcatggaatacaagtgagagccaaaaatacactgcctatggtcaactgattttaagacaagggcgtcaattctattcactgggagaaagaaaagccttttctttacagttaatgcaggccaaattattgtcgcgctactga

SEQ ID NO: 561588 - DNA, 231 bp, Homo sapiens
gagcctggtccgaaaaatggaggaaacactgggcacggtggctccacaccctgtatccagtgctctgggaaggccaaggcgggcaaatcacttggggtcaggagttcgagaccaacctcgccaacatgatgaaactttgtctctactaaaaatacaaaaattagccgggcgtggtggcacatgcctgtaatcccagctactccggagtctgaagcagaagaatcacttcaa

SEQ ID NO: 561589 - DNA, 486 bp, Homo sapiens
taatgaagtcctataaaaagaaaagtgggttagacatggtggctcatgcctgtaatcccagcactttgggaggctgaggcaggaggatcctttgagcccaggagttcgagaccagcctgggcaacatagcaagacctcatctctacaaaaaataaaaattagccaggtgtggtggtgcgtgcctgggtgccagctactcagaaggctgcaatgggaggactgcttgagtccaggaggcggaagctgcagtgagccatgatggcaccactacactccagccagggcaacagagagagaccctgtcccaaaaagaaagaggaaagaaagagagaaaggaaggaaagaaagaaagaaggaagtaaggaaggaaagaaggaaggaagggagaaggggaagggaagggaaggaaggaaggaaaggaaagggaagggaggaaagaaggaaggaaaaaagaaaaagaaagaaagtagaaaggaagaaagaaga

SEQ ID NO: 561590 - DNA, 275 bp, Homo sapiens
cctgcagctctctctatgggacatttgagcaccttattcatgcccagagcacacttctgaaggttcctgtgtcttcctgtgctcagcattctggactgtgcatcttatgccttgctcaggagggacccatactgtgggtggtgcgtgctccttggcaggtgcagtcgccgtactgagtgctcgaggggccagggcccacagcagtgggtatggagcttccacgcttgacgctgggctgtctgcaagtcgctagacatatggtccgtgcaacatca

SEQ ID NO: 561591 - DNA, 148 bp, Homo sapiens
tgctgggattacaggtgtgagccattgtccctaaccttaatctttttaaagaaaaatccaaatacatgtggaatgtagaagcagtaaacactgtaaatgggcaagaaaggactcaacttaattcatttaatgagataccatgtcatta

SEQ ID NO: 561592 - DNA, 132 bp, Homo sapiens
atgtagcgactgttgatggtgatgatattggagaggtggtggtggtgttgatggagatgatggtaagaatggtagtggaggtggttagtggtgatggtggtgatggtggttgtggtatgtgatcgtcagtga

SEQ ID NO: 561593 - DNA, 301 bp, Homo sapiens
agaacagggctttgtcaagtttccattggccttagtggggaatgaatagactccctcaccttctctgtgcctggtctggaattttggctaacagcattaacatctaacttaatgacaaggaggaaggagattcttagaggctgtccaagatggtcaagtgttcagaatatggccttccattatatctctttagttctttctggccgattaggttatactgtcttagtcaggttggttaagtagcccaggggggcttctccattctttctgtatgccttatctcagcattaccatcttccta

SEQ ID NO: 561594 - DNA, 176 bp, Homo sapiens
  misc_feature (67)..(67): n is a, c, g, or t
  misc_feature (69)..(69): n is a, c, g, or t
gtcgggtccagcgcgtgggctgctggatggcggaaccccaggcggagtcggagcccctgctggcggngnccgcgcgcggtggcggcgactggccggcggggctgaccacttaccgcagcatccaagtcggccctggtgccgcaggccaggtgggacctcctgccagtttttgaata

SEQ ID NO: 561595 - DNA, 817 bp, Homo sapiens
aattggaatcaagagaaccacccactagctaattattagcatcatccccctactattttttatccaaatcaacaacaacctatttagctgttccccaaacttttcctccgaccccctaacaatctccctcctaatactaactacctgactcctacccctcacaatcatggcaagccaacgccacttatccagtgaaccactatcacgaaccaaaactctacctcatctcatactcaatctcccataccacaatctccttcaattatacacgattcacagccaccagaacttcacatccatcttcttcatcatctctcttcgcacaaccaacacttatcccccaccttggctctccatcacccgatgaggcacaccagaccagacacgcctgaacgcacggacacatacttcctattctacaccctagctagagctcccttcccctagctcatcgcactaatttacaactcaccaagcaccctaggctccctaccacattctacgtcctcactctcaactgcccaagcaactcatccacactcctgagccaacacacttcatcatgcctcagcttcacacacatcgctcttcatcagtaccagatacgctcattacgagacctccacatcactgactccctaacagcccatgtcagcagacccacatcagatgtatcactcgtactttgcaggaataatctacacaactacggaggctatgggttataataagcctcacaacttcattataaaaacactgaacaaaaaacatagaataaacataagattgacaaataagtagaggtacatatcgaaag

SEQ ID NO: 561596 - DNA, 120 bp, Homo sapiens
tacttttccacacgggactcctggctgctttcgcactggtatagggaattcatgtagctgtgttgggaacactcctcatcagacactgttttccctagtgacagaagttaaattccccca

SEQ ID NO: 561597 - DNA, 844 bp, Homo sapiens
  misc_feature (512)..(512): n is a, c, g, or t
gaatacacttggtgtggggcagcggtcctgtgtgacccacgtcagctgttcaggtactgacttcatgcagcatggcgctgcgtgttatttcattatactaagctctgcctaccgttagtcgtgacgcaggttgtcatcattcaagtaactgctgctagtgctgactatactagtaattagacctcacgatgccttatacttcataacctagtgctatacttaacgaataatttcccatatccttaggatggacaaaacgtgaggctccggatccaattgtagctcgaccttggcgtctgtaagtcccatagcttgatcatgtagcatgggccgaatagagggcggctacaaggtcgttcgtcggtctgataggtctgagggcttggggagtctgcaagctggtgggctgcacaggcttggtatatctctgcgatgctttctgggaaaggctgatgacccacgagacatcacctctgagagatcacaggatggctcagaagaatagaggtctntggaccatacttacatgggagacgaatcgcgcgagtcatctaacggagtcattggttttgtagcaccgtcatatacactcgcaatacttccgattgtcgccacaagtgctcgattgcctcaccatttgcgcaacggtgtgatgtaaccaggtcgcaccgttgttgtgctttcactggagatagaacaggcactcatttttcatggcatgctagaggagagtgtttgtgcaccgacgtgttgaagtcctatctatagcagcaacgaacgttggacactccgggtcgatatcaaacagatttgacagaaaaacatccacaggacatcgtggttg

SEQ ID NO: 561598 - DNA, 179 bp, Homo sapiens
cggactagcctggatgagtcggggtaggtcgttgcggccgtgaagttcctgtgtaggaggtgacgactgtgttcttctcccccttcttgatgtccttcctgtcccagtgggccaatgcaggggccacaagcattggacaggacaagtgccacccatgatccctcaatgatctgtgcata

SEQ ID NO: 561599 - DNA, 127 bp, Homo sapiens
cgagtgctggagggtcggtgacgtgacgtcacgccagccctcatgaggctggagggtcgctgtacgtggaaccatcattacccgcacagccctagaggcggaggttgagctgagaagaggccagtgc

SEQ ID NO: 561600 - DNA, 132 bp, Homo sapiens
tttgacagttttcaagtattttatttgaaaagtagcaaaatgacaggttggacatatttagattgaggataactataaccattactgaatggattatgattgcttcagatagtacgatacactctgatatca

SEQ ID NO: 561601 - DNA, 583 bp, Homo sapiens
ggtggctgacgcctgtaatcccagcactttgggaggccgaggcaggtggatcatgaggtcacgacttcaagaccagcctgcctatgatggtgaaacactgtactctactgaaaatacaaaaattagtcggacttggtgatgggtactatgtaatgataagccatactgagtatcgttagtctcagacattcggaaccacgcgaagataattgttgtaaattagtatagatggggaattgtcatgtactaccaggcttggaccagatattctgtcgtttagagatacacttaggtagcatatatagagtgctcaagagaccagcctgacagtcaagaaataggctcttaacatacccactggttagctggattctaattgcctccttgaaactatgtaattgtgtctttttggatcctgtggagatatctttccacttgtttaattttacactgtaataagacacgttatcactgatgaaagaattacctgattcactgtcctgcgatttacaacttcgtgactgggaaactcattgggtacccaacttaatcggtttgagcacttctcagtttagacagctgg

SEQ ID NO: 561602 - DNA, 198 bp, Homo sapiens
tcacgccatgtcacaacatagtaatttccatgtaaatgtgagctgccatgatgatggtgatgatcatggttgtgatgatggtggtgatgattgtggatgttcattagtgtctgtgcattgaatggttagatgtttattgtagtcttcacagtctgggcttctttgtacctgtccttcttgggaaggctttccaagtat

SEQ ID NO: 561603 - DNA, 341 bp, Homo sapiens
  misc_feature (54)..(54): n is a, c, g, or t
  misc_feature (228)..(228): n is a, c, g, or t
gtacccaaggattgcagttgtgctctaatgccgttgtgcttctaatgcagttgngcctctaatgcagttgtgcctctaatgcagttgtgcctctaatgcagttgtgcctctaatgcagttgtgcctctaatgcagttgtgcctctaatgcagttgtgcctctaatgcagttgtgcctctaatgcagttgtgcctctaatgcagttgtgcctctaatgcagttgtgccnctaatgcagttgtgcctctaatgcagttgtgccttttatgcagttgtgcctctaatgcagttgtgcctctaatgcatttgtggctccaagtggcgatgggggtctaatgcgga

SEQ ID NO: 561604 - DNA, 166 bp, Homo sapiens
gccagtcagaacagaccgttcggcagcgcacaggttcagcatttgttgtatcggggactacaatggcacgtcggtctggtgtagtgctccaaggaggtgcaccgcatcgtgggcatcgtctggcaagctctcatcgtcccgtgcgcagaggcactgcgaggtagga

SEQ ID NO: 561605 - DNA, 190 bp, Homo sapiens
  misc_feature (32)..(32): n is a, c, g, or t
  misc_feature (189)..(189): n is a, c, g, or t
gacccccgacccttaagaaggattttgtatantctctccgccattgagaatgtgctttgtagatccaccccctgccacaaaaaattgtcctactccaccgctatccaaacctacaagactaatataatcccaccaccctttgtgctctttttgactcagccacctgacccaggtgattaaaaagccccnc

SEQ ID NO: 561606 - DNA, 113 bp, Homo sapiens
cagtctgctcccatcagaggaatgcaacagtttaaaaacagataatgaaagaaatccaagaacataaaattaaaatatacgaatttccagaaacggatgggagaagatgcgca

SEQ ID NO: 561607 - DNA, 253 bp, Homo sapiens
agcagtctcggtagtgaagacatgactggtctactatacaagtcttacctcaggatccacacatcagagattcatctctattactccaaagagcacaccatggctgctagtgtacctctccattctcttcttcctcttttagatacctttctgttatcttttagacttctcctatatttagcagtgaacctggcttggatatagctgcatggtcttgtaccttaacataatacatcccagatcttcaaacccc

SEQ ID NO: 561608 - DNA, 683 bp, Homo sapiens
  misc_feature (146)..(146): n is a, c, g, or t
  misc_feature (275)..(275): n is a, c, g, or t
ccagtgaaaaggtattctcagtagtatcccattgattaatgataataaaaatgttgattgcaatttaatttcagcttttgatcacactattctgtgaagttacagggcagtaactgccaaaataattttatttaaatgataatgcntatttatggcacatatattacatgtgtatgtttacaatatgaaaatacacataagcctacagtgaagatcagctaaattattgtaagattaatgccaaaagctttattactctagcaaataatcatcanatcacatttccattagacagcacctcagctcctctatacatacagcagttcgctggattgaatacacaatgaacaactgaaaatgatcaatttccatcattctgataacacgggcaaaaatttcaaactctctgttagaatacaggtactagtaatcaaaaagaaaatttcttgatatctcccactagcattttcagatttagaatttaaccatgaagtacatatctagaactaatgacagaaaatcgcattttaaaataatattacagttcttctgtaaacctcagagtgatttctgtgtggggaacttgctgaccagaaaattaaatgagaattttgtacatcctcagatagccaaatagagttaaagggccactcccacaccacccccttcaaaaagaaaaataa

SEQ ID NO: 561609 - DNA, 290 bp, Homo sapiens
ggttggaccaaaggatgaaggaaatgaatagttactgagcatatatagggttccatatctggtgctaacaatttccacctgttttcttatttaatcttcatacaagaccttaaaataaatattttcactgtttatattataaagggaggtggagaattagagaggttaaataatttgctcaaagtcatatagctaatgagtggtggaactagcatttcgacccagttctttctggcttgtgctcaatctgctctaccatgaacttctatgcatagagaaggatatttaaa

SEQ ID NO: 561610 - DNA, 161 bp, Homo sapiens
  misc_feature (15)..(15): n is a, c, g, or t
  misc_feature (31)..(31): n is a, c, g, or t
  misc_feature (46)..(46): n is a, c, g, or t
  misc_feature (81)..(81): n is a, c, g, or t
  misc_feature (99)..(99): n is a, c, g, or t
  misc_feature (107)..(107): n is a, c, g, or t
ctgccccctgccccncgcccccccagtttgncggttgcaacagtgncctttcttggttttaatttctgagcagatgaattngctgtgggaacagcacanagtgaggngcctagcacaatgtctggcacaaagtaggtgcttaataaatatttgttcaaatt

SEQ ID NO: 561611 - DNA, 522 bp, Homo sapiens
  misc_feature (10)..(10): n is a, c, g, or t
  misc_feature (111)..(111): n is a, c, g, or t
  misc_feature (166)..(166): n is a, c, g, or t
  misc_feature (440)..(440): n is a, c, g, or t
  misc_feature (512)..(512): n is a, c, g, or t
ctgttatgangatgatgaattctgggaatgaggagtcgtgacgtgctccttcagtgcccctgtactgccctgccatctcaggccaaagggaggggagcaagtggggacccngccatggccccctcagcaaaaaccctattccacagggggtgggggaaaacaccancacagctcctgctgactcccccttatggatcctcagtttgctcctttttatgggacctttaatggagagagagtaaccctccacagaatgtctgaattcttgcattctttacccttccatcactatattgattcttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggancctgttgggagttcacaagtgctgcatatactgggtagcaaaagaaaatggaaaaaaacccacaaaacaaantttaaaaaaa

SEQ ID NO: 561612 - DNA, 555 bp, Homo sapiens
  misc_feature (10)..(10): n is a, c, g, or t
  misc_feature (111)..(111): n is a, c, g, or t
  misc_feature (199)..(199): n is a, c, g, or t
  misc_feature (473)..(473): n is a, c, g, or t
  misc_feature (545)..(545): n is a, c, g, or t
ctgttatgangatgatgaattctgggaatgaggagtcgtgacgtgctccttcagtgcccctgtactgccctgccatctcaggccaaagggaggggagcaagtggggacccngccatggccccctcagcaaaaccattccaggggcccccgggggggggttgggggaccctattccacagggggtgggggaaaacaccancacagctcctgctgactcccccttatggatcctcagtttgctcctttttatgggacctttaatggagagagagtaaccctccacagaatgtctgaattcttgcattctttacccttccatcactatattgattcttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggancctgttgggagttcacaagtgctgcatatactgggtagcaaaagaaaatggaaaaaaacccacaaaacaaantttaaaaaaa

SEQ ID NO: 561613 - DNA, 115 bp, Homo sapiens
tcgcagcctgctgagtttaagttaagaataatgtagaactaacgtggtctataaagtttcataattaatgtcaaaaattgccaagattattaatatatagtttggcacatcacta

SEQ ID NO: 561614 - DNA, 292 bp, Homo sapiens
gggcccccttaagtttttcaaggcgggggataagggtgtgtttccccttcccaaaaaaggggctgaaagtggtggggccattttttttaaggccaaacccattttttttccccccggggggaagtttaaaaaacccttttttttttttatgattgaaaaaaaaaccaagtttcccctttttttggggaaagggggggattccccccaaaaaaaaaggccttttggtccttaacccctcccctccatcccgggccccccccctgggtgaaattaaaaaaggggtggggtggga

SEQ ID NO: 561615 - DNA, 100 bp, Homo sapiens
aacacacgtacattcccactcgtgcctatgcacgctcacacatgctcacacatgcacgtacccacacacgtgcctgtgcatgctcacgatcacacacagt

SEQ ID NO: 561616 - DNA, 487 bp, Homo sapiens
ccacccaaataaaggggggtaggtccccccttaggcccccccgggttttccctttatttttccggcttgtattttggggggaaatgtgagcggaaaacaattttccccagggaacagctatggcccttttttcccccagcttgaaattaaccccccctaaaaggaacaaaaagtgggggtcccccccggggggggcccctttaaaaaaaatggatccccccgggtgcaggaatttgggcccaggaaaaacctaggagggtccagcccaacccaggcccttttcccctaccctggggcccaaatttttcctcaggggcgggggaaaaccctaaaggccccaaatgccctttccctgggaaccattttgtcccccctattcctttaaggagcccggggccccctttttttgggttttccaaaggaaaggggttgcaggaaggagggtttgtaaaaacaacaggaaaaaaaactgggtttgagccccgga

SEQ ID NO: 561617 - DNA, 317 bp, Homo sapiens
  misc_feature (59)..(59): n is a, c, g, or t
cgatctagaggatcgcgttatacactcccaggtcagaaagtgcatctcagcctcctaantagctgtgatcacaggcgtgcgtcacaggctgggataaattttttttgtatcttagtagagatgaggtttcaccacgttggccaggctggtctcgaactcctgacttcaagtgcctacctcggactcccaaagtgctgggattacaggtgtgaaccatcgcacctggctgtaaatggtggtatagctagctgataccaccattgctctttggtaaaaatgcctgctttccaagtacttcgacttgcactattagaaca

SEQ ID NO: 561618 - DNA, 366 bp, Homo sapiens
cggcagcatagacattgccagcgtattcctgtccatgtacacatcaggcaaagtctatgctgcttcaatgaatataagcattgggagatttttaatcaagtcgtgagtgcgacaaaatcctggcggtgattgcccaagttcaagtgctccgggaccagctttgtaaacattgtactaccattaacatagattccacgtggcaagatgagagtaatcaagcagaagaaccactgaatatagatagagagtgtaatgaaggaagtacagaaagacaaaaatcaatagaaaaaaaatcaaactctacaagaatttgtaatctgactgaggaggaatcttcaaagagttctgatccttttagtttatgga

SEQ ID NO: 561619 - DNA, 412 bp, Homo sapiens
ataaaatgagtttttgagtttcaacattatataaatttgattaatggatctatcaaaagtgtgcatatgcttgattacatgtgttatttcttgtttaatggtgtatgttgggcttctaatgtacccatcacccaaatactgaaggttggatcccaataggtagtttttcaaccctcaccctctcccacccaattgtttttatttctgaaagttatatttctttcttggtctgcctgataattttttaatagtttcttatttttcgttagttttcaaaaaatatcttgttgggcattttgtccatagctgtttcatatttaaaaaggtaattccaatatcggaagtccttaagaagttgtacttaaggtagtttgtttctttctgtatctggtgattttttttatgagctaat

SEQ ID NO: 561620 - DNA, 765 bp, Homo sapiens
tccccgaagtaggaggcgaggctacttattatatatagtatagcgcctaacttgcaggagcacccactcatagagcgggccccgatctggaacgccagaactgccatccgtactcctagcgctcacagcagaagcttctgccgcagggaaccccaaactttttcttggggggagacgagacaccgataggacccttaaagacggctcccatgtggacgaggagaggcccgaacggttgtacagagcgccaaaaactagattccctaacccaccattagacaatagaaggtaccaaagcgtgctgaaacttacaacctcacaaacggacagccgaccacacagacctgccctgaggaaataaccacatttacatgacaggaatctgcttgcaataggatagagaatgcagaactgataccaccaccaatatcccccatattgcttatggggactccacaaaagtggctcagctcttgcttcaggaagcccgaaggacccaaaaaacaagcaaggccgggggcagcaagacaagacaatgccagactggagaaagatatgagacccactcacggagagaatgagagtgagaggttcggaacgcaatcaaaaaggttcctgttccaatggaaaagagaaaaatgtcccatagagaataagggttaagcgtccccagaacacagccttgtgtcgcatacggagcccttcaacaaagagagagttgtgatataggagcacccgtgcgaggatagcatgagtcgtagaaag

SEQ ID NO: 561621 - DNA, 286 bp, Homo sapiens
  misc_feature (4)..(4): n is a, c, g, or t
  misc_feature (44)..(44): n is a, c, g, or t
gtanctctgtttggggctctcagctctgaaggctgtgagacccntgattccacttacacctctatatttgtgtgtgtgtctttaattcctctggcaccactaggttagggtctctctgaccaagctggtctcagcaacaggcatgcaccaccatgcctagctactgttttggttttttaggagatgtgatcttgatatagttcccagcgctggtcttgaactcctgggctcaagcgatcctccctcatcactgggattacagccatttaggtagggtaccgagctc

SEQ ID NO: 561622 - DNA, 189 bp, Homo sapiens
cccccttttttggggttcagttccctcaggaaaaaatgaggccgtcgccctctttatgtgccttcagtggaaatgtcccctgctcacgaccatagtgcattagagtctaaagaagtagtggcccgaacagggcagagtaggtcccctccatggccctgaatcctcctttggtccaggggtggcctttgc

SEQ ID NO: 561623 - DNA, 439 bp, Homo sapiens
tggtttaatttggtcaatatcagctcttagagcagtagcagctacccatcccccacctccaaccctatggcagacagctgtgcatatgttcctggagtagcttgcacacagcttacaggagctagggtgggccaaaagaccctgtcctccaaatatcagggatttgtgctctgattactgcttctgataacagagatgtagacaatgatgcaggtggccattgttgttgcaccttctcccattgtttttattttttattttatttttatttttattttttttttatccccaaagaatagattcttgtcaaacttagccacattatcattattccacctaaaaattaataataccccctaaacattaccaagattcaactggtgttcagatttcccaaaacactttcaaattctttgcttttccacttactgaaaaaaaa

SEQ ID NO: 561624 - DNA, 250 bp, Homo sapiens
cagaaagaaagaggttcgttggacgttatggtacatatggctggggagactcacaatcacggatggacggcaaggaggagcaagtcatgtctgtacatggattggctagcaggcaaaacagtttgtgcgagagaaactcccactttttaacaaccatcagtactcttgtgacgaccccaattcatctatctatgcagaacatgcatgggtaaagacccatccccatgcattcaatcacctcccaccagtt

SEQ ID NO: 561625 - DNA, 155 bp, Homo sapiens
tgtgttccctcaaagaatgaaggaggatgtaaagttagaaaatagcaacagaattttgaagtcttaaaaaagcccccacatttagcttttttttttgaacaaaaacatattccatgctttgaaataaaggaaagtgctctcctgttaaaaaaaaa

SEQ ID NO: 561626 - DNA, 479 bp, Homo sapiens
ggtgacagcaggaaatgggaaggatgttgttgaggatggaatatagagtgataactgtgaagatatggaaagacttagcgagagagtgacaggttagtggttttgacctaattttggggaacaaggttcatatagacttttcctcttctattatatggaaagtaccataaaaatatgattagtaataatcgtgtgtatcagtttatcaatttttctgtagccaactctgcttttatgtacaacaaatgagaaagcagcccctaaaatatgccagagtgaagaacatcttcacgttttgtgtgttcagttggaagtgtttcagtaatcatccagggctgcttccacagtctccgtgttgatattgtagcagtttctcaggtttgtgggcaagtgactatagctattccacttggtggacaaagcagaatgcatgatcaggccgtctttggtgcagttcacagaatcatcacctgtgcctg

SEQ ID NO: 561627 - DNA, 1175 bp, Homo sapiens
  misc_feature (447)..(447): n is a, c, g, or t
  misc_feature (679)..(679): n is a, c, g, or t
  misc_feature (685)..(685): n is a, c, g, or t
agaaagatgatggaggtttctgattggtgcctgtaaaccgccttaagaaaagagcgaaggaatttcgaccttagcgtgatactattctatgcgctctgctataagacagtattgcctaacacggatgcttcgaaccctgcaaggtaggagaggcatctcttatgtaaataactcggtgcactaatctagcacatgggaattatatgcgccgtactgtacgaacttgattatattcgagttggcagtaggataggtaagagaaagctgggtaacttacttatgatacctagcccgacaactcctaatatgagttgtacagtactatcccgaatctatgaaggttttcgctgagtaggtagtagaccgatgtggttgcagatatcggtgttggctaattgtgcatcacgtcgtatacagtctaccatacttgcacctgggaaacctgtngatgaatgacttctagaccatagtgctatcagtatgcaaacagttgctgcaggcactaagtagagtgccgtctaattagtattagagagcgagtgctccctgagctctagacagtcgtgatatgacatgaatactatcatcctaaccatatgcgggtggtaatattggtgtcatcactctatatcaaggaagagactgatatatagcgtgtatgaaaccagaatatacgccntttgantgttgcttctaatgcttctatgagttacatttacggctctctgtctgcctcggagagaatgtttgattccattgaagagtctttacgtgtaagtgacaaacgcttcacagaggcaggtaacgttcgtgtggtgcgtatcatattgtcttctaccatcgaagtggaatgtaagcagtaagaccgtccgttggaagaagagggaatgggacaacgggagaactaatgcaaacggtgtttccgtatgaggttgggggtgtaccagaatattttactacgcgcgtggtatcggcagtccgtctttggaatgtgttacaacgaacagggcgtgtggcgtctagcggtcctctgtgtgcgcatgttatctgcccgggttgttttacaggggccgtatagagcgtattatatgtaagggcggtactaggtctgggacgctcgagttgtggccccctgtgggaatagctcaccgcagtgcgccgacaatagatggatc

SEQ ID NO: 561628 - DNA, 466 bp, Homo sapiens
  misc_feature (466)..(466): n is a, c, g, or t
taatggaagcacatagggaagaggctggatgattgatgtaaagttggtgtgatagacagggcggaggcttttcgcccactgaagggaaaagcagatgaatcagcttgtgatcttcattatgtttctatgattctcgatggtaggctggaaaacaaaaggacaaatgtaagtcttattagaaaaatggcatgtgttgttcaaacctattaaaataaatgccaaatgacttagatcatctttctgcaatttacaccagtgaaaacaatttaagcctgtgctagacttacggatgctgaattcttctgttgggctaggcaaggggacacaccaataaatgttgtcataagaagataagtcctattaaagctcagcatgttgacaaattggaaatgtaatagcagattcttcactataaagttcacagaaggtagatccatcatattctccaatggaaaggatgagttgn

SEQ ID NO: 561629 - DNA, 172 bp, Homo sapiens
ttcctggtggcattagccactccctgcctctcactccagacctgttccctcaactggggaggtaggctgggagcaaaaggagagaggtgggacccagtttttgcgttggttggtttattattgattatttggatgtcagcgaaaaatctgaaaataaagacacagagagaaa

SEQ ID NO: 561630 - DNA, 307 bp, Homo sapiens
gcacacctgtagtcccagccactcgggaggctgaggtggaaggatcgcttgagcccaagaggttgaggctacagtgagttgtgttcacaccactgtgctttagcctaggtgacagagcaagactctgtctcaaaaatataaataaataaataagtaaataaataacagaactttctaagggcttgcactagggcagcactttgcttcaatctgctgtggatacccaacatacccatctgtgtcgccagatttgagtcttcacttgctaatcattcctcagtttcttattttgtgtccatgtaggttt

SEQ ID NO: 561631 - DNA, 106 bp, Homo sapiens
taagtaccattcaaactagagtcatcaccaagagtctagaaaaaggttcaaaatatttcttgctgtctccatcgtggtgctttcagtgcatatggagagcatctca

SEQ ID NO: 561632 - DNA, 117 bp, Homo sapiens
cacctctgacgagttccagtttatacatcctgagtcaatgccaaaaaaacaaaaacccaaaacaaaccaaaaaaaaccaacttcaggccttgccattctcatttggtttctgtggcc

SEQ ID NO: 561633 - DNA, 156 bp, Homo sapiens
aatcggcgtgacataaggagaagctgtgatacgatcagacctggactacgaacaagagatggacacaggctgctatccagacatcctccctggagaagagctacgagactgccatgacggaccaggtcatcaccattgagcaatgagcggttccgc

SEQ ID NO: 561634 - DNA, 477 bp, Homo sapiens
ccctataaccttattgatccgccttgcctatcggttttggccatcgtcgtgaacggacagggcgggtgttgcccttctgtctccgcgaaaagtctaatccttggccagcggcggccctcggttgccacgccgaagcgggtcggcgtgcgcgagaaggcggacagcccgctgagtgccgcaagcggatgcgtgatgatatagaccggcgtctcggtcaggatctggcgatgcggtgccttgtcttcgaaggcttcacggaaagacgggtgtttcagcggctccacgattttctggacgatgccgccagcgagatagacaccgcgcgcgccatgaaggtcagcgcaaagtcaccggcaagacggccgagataggtgacgaacagcgacagggtttcctttgcctcgcggattcgccggaaaggccggccgcggtgatgtcggcagggtctgcagcgtggcggcgttccggcaaccttgc

SEQ ID NO: 561635 - DNA, 272 bp, Homo sapiens
  misc_feature (256)..(256): n is a, c, g, or t
tgcatggcgagcaccatttccgggcgctcagtccgtgtcggccttcagtcatctccaccacacaggtacagcagcgctttctgagagtcgcccttagtgtcttgctggatataacagtacagggactcgccgcaccttctcttgaagtcagacctgattatcaacatgtgcacttcactgcggcagaccatgactctgatcaggaccttatctcgcgtccccttgcccttcatggagtcatacagacgatcagcanaatacaggtgcttgtt

SEQ ID NO: 561636 - DNA, 855 bp, Homo sapiens
agaaagtgaaattccctctcaaaaaaaagaccactctcagtatctctgattgtcgtgaagatgtaccaaaaaaatatagcttcatatatctggaatgagcactgagccataaaaggttttcagcaagtgtgtaacttatttggggctaaaaatgaggtttttggtggtaaagaaagaaatatggtgcttatgtatggaacgaagtgtaccttttatataactgatttttcaaaatgcccaaagggactagttggaaacgcttcttttaaaaagaattcctctaatatgactttatgtgagagcgggataaatacagtgatcaaataaactcagttaatggttactgtaaaaaagaatgtgtaaggcagctcagcaccatgcttctcgtaaaagcagcttcaattatccactgggtaatcttttgacaactgtgccattatctgatgttacacaattcaatagcaagcaagttgtgagacaatcgcagtttaaaagcatgaaccatttaacaaaaagtggaataattaaagataaagcacttcttcccaaaggaattatcacctagtgaaaaattgatgcatttcatctactcagttacgactgaagttctctcctcgctctagctctcaagcttgggggatattcctgtgaaatatattttccacttgaagtcatactcaatcaaaaccctttatgagtgtgagcactgtattgcactgttgtttctccggcctttttgtactttgtgccttgtaccagattggtgccgcttccaaggcgtgggaaccggcggtgaaaacaaagggtgcaggcagtagcagggaacccctctagggtggaagagaagggagggaa

SEQ ID NO: 561637 - DNA, 793 bp, Homo sapiens
gtgcccaggaggatgctgaaagtgagtacctgcagccctgttctcattcaattggatgccctccagactatctgatgatgccatacatgctttaagccatttgtgtagcatctcttactaaagttggcaagggctgtggaggcgaagttacgtgttcaatggcctgcgttaataaggtcatgttgcaacatgcactaggtcgtaatacaggtaaaattgccacgttctcttactagagaatagcagacatagaagttgtaggccgggctttggtggtgggtgtgcctgttagtcgcccaggctactcgtggaggcttggagagcagagggaatggttgtgaacccaatggagtcgggaacttgtgagatgagcactgaggatcgcaacgcgaggtgcgcatcatagggctgtgggctcgaagagaaaagataaaagcttattcgggtgatgaatggggggagttgtagatttgataccgtgctaggggaggttttcggggggtctgggatgagaaactcttgaggggtgatgggaaaactgagggctgagtcgtggatctgtgtgtgggtgaagcaagtatagttcgaggggatcggtacaaggcgcgtgatgaggtttctgatgcagtgatattgcgtccagagtttcaggaaaaggccccttatgagcatgatgtggggattggcatttatgcgtttcgggggggaccgagtgccctgactatgttcggtaaactcaggatttgacgcacggcatgctgttctttgccagagggttttcaatggtttgtta

SEQ ID NO: 561638 - DNA, 1314 bp, Homo sapiens
  misc_feature (292)..(292): n is a, c, g, or t
  misc_feature (392)..(392): n is a, c, g, or t
  misc_feature (600)..(600): n is a, c, g, or t
ggctaagattgctgaggaggcggcagggtagctggcaggcgccgacttccgaaaggccgccgtccgggcgaggtgtcctcaatgacttctcttgtggaaccatgtccgtgatcttgttatgcctgacgatggtacgggtaaggagatggactgcccgctctcagacactctaacgtgagtatttaaccacgacgctcgaagatatttgtttggtaattcggcagcgatgagcagtggcgtcgaaagacgtcttatgcacgttgtcgaacatggggtcccagttatccagtgntgcgagggtgtctagtcaagacacaggattgttgagcgtattacgatatagcacttatattgcgtctcttattcggggggatcgcttgggcacttgcagntcgagcatattcattgcattcctttgcaccatgatgctccaagccagacccactgtggccatgtcattgctttccatgggaaggaaccccttgatgggtggggaactttcaccacagctttccgtaattgaccaggctaccgttgcatatttgagccctaggacctcccagggggtccattaacggacatttcttctattgaacggtntttgaccatggcgagtccactttcacgacaaaggtgacatgtctggcatcatttacacctattgttaaagttgaccttcttcgagcattgggacgtcgcaaggctctgggaaacaaaacagttcacgtggcagggaagctcaaaggtttgccaagcctaccaagtcgggatatcctacaactcctcgcgaatggaaaccactagaattggttgtgccacaacttggggcgcggtggactcgacactcgtggtcccagcagcaacctggaattggccagcctctcggcacgccctgagctacccttaacatattcccgaaagttggcaaacccacatgttgaaacacggaccctgggggagaatattcgcctgattagccccgttccattttccttccatcgcattcaatgggctgagtcgcctgtgaccctcctggaaaaacttccaccagatttactgtacaaggagaacgagtttccacccccattgtgtacagaaaaaccacaattgtctatttaccaagggggttttgggcaccccaacgtcaaggggagaatctggtcgacaccactgcaattggagcgcctaataaccacgcggtaccatctatctcgcggacggcccacggccacttgcaccacgcagggcttactacttggagcccccacagtcagacacaagcaccacagccaaggggcgccctcatacaggcgg

SEQ ID NO: 561639 - DNA, 548 bp, Homo sapiens
gtactctagacatccttcggttgtgctcccccagatactgtacaggccgatcgagacttctgcaggctgctttggggcgtcccacgtgctgctctcgattcatgtgctatccttgaatagtgtcttatactctatcctccggaagttggctgggactatgggcgagtggcttggtgaccagatgcagacaggcttcggcggcaaggcgagggaccgagtggaacaggactatgtggcttcagctaatgcacgggggacagccatgaccgggtatgagcgtctcacctctgtctccagctccgttgcactatgaccaaagggacaatggtaactgtacctggctgacagccatcttcaggataaaggatgctgagatccgggacaaattgtgggggcgatgccgtgaaatacctgtactttcaggcggcacatcatcggggctgctggtggttgtgggggtcctctccgtaggcatcgtgctgcctgtcaacttctcaggggcactgctggagaccaatgcctacagctttgggagaaacaccattgcc

SEQ ID NO: 561640 - DNA, 1699 bp, Homo sapiens
  misc_feature (255)..(255): n is a, c, g, or t
gacccacgcgtcgcccacgcgtacgccgccgtccgtcgcgcgtcgtccgtgcactgcagtccccaggccccggcctctcatccacgtctgccttgctgtcctcgtcatagcactacggtgcccagagctgcaaccagagccaaggcaggctgtcaggcaacacgtccgtactcgagctctcacatcaacagatgctagccgatgaccgtggaactcgatccagagctctctcgacagcatatccagattctagcnagtagcgtcgctctcgacagatagatacccgaagcaaatgctgcgctgtctagctacccatcagaccggggcatgtgaccctggtctgcagtctaactatcgatcgtatacacctcggaggcacatgtagtctgaccgattggagcgccactcttgtgcataccagagggcagtgacctgttccaagctcatcgcaggaatctgaagtcgcggcgcgtgtgtgctcccaatctaggcccgctcgagtgccgtaatcttttccttttggtgtgaccctttccatgttgcgtatgccagattacgtgagtacattagcatgtaggcgtagctctcgtaaatacatataattcgtatgcgtagtgatcggcttgcatcattccttggttgtataactagtactatgagattcgaagagtggcatcatatggcttatataactattatatgatttccgatgcttttaagcttaggcttaagacttgttggctagccatttagaacctgacgaacctcgctgaaaaaccacaaagaacgccctacataaatgcgtgcttccatgctttttcatttggcaagtagtattgcaccatggagataacaactaataatagagggccaaattgttcgcatcgtaataaatgcacagagttccgcacgcacggcacagagttccttaagaaccgataggcatagaaggagaaataatcccccgaaaagaattgtgtgaaaccccccaaaaatattgaccaaccgttgacacgtagggcgatatgccttgagtggctctcaacgaagcgtgaacacccacttacaggtagacatcaaacgccaaatgttatggcaactccccaaacttccaaatatacgggaacgaacgagtatctgtattttgggaacgaaaggggatctatggaacaaagatgtagagaaaaagcatgagcaaaaatatagggaccaagatacacctgcgaggaagagtgaacacacaacagaaaatcccatgttagagtagagtatatgagcgcctgaaaccgtaacacgaaaatcaccaggagcaaccaagcaaatgaaccaccgcggtgcacagagacacatatgaggacaatacccataaaaaatacaaaaacacaggcaacaaatatccccatcaaataaagacaaactacaacaaaatcactagaaaaactaaatataaaaaccacacaatttaatacacctaagacagacaacaaaaaatttaagaaagaaacaacaaaaaaaaaacaaaaataaaaataaacaaatatacaaaaactaatatcataaccacgaaaaacattaccacaatctacaaacaaccacagcaaaacaacaaaacgacatcagacaaactacaaaaaataccaaaaaccaaacacactatctaaacacaaccaaacacataatcactaccaccacaacacac

SEQ ID NO: 561641 - DNA, 764 bp, Homo sapiens
  misc_feature (56)..(56): n is a, c, g, or t
  misc_feature (114)..(114): n is a, c, g, or t
  misc_feature (222)..(222): n is a, c, g, or t
  misc_feature (254)..(254): n is a, c, g, or t
  misc_feature (300)..(300): n is a, c, g, or t
  misc_feature (305)..(305): n is a, c, g, or t
  misc_feature (319)..(319): n is a, c, g, or t
  misc_feature (333)..(333): n is a, c, g, or t
  misc_feature (352)..(352): n is a, c, g, or t
  misc_feature (361)..(361): n is a, c, g, or t
  misc_feature (366)..(366): n is a, c, g, or t
  misc_feature (382)..(382): n is a, c, g, or t
  misc_feature (384)..(384): n is a, c, g, or t
  misc_feature (388)..(388): n is a, c, g, or t
  misc_feature (390)..(390): n is a, c, g, or t
  misc_feature (440)..(440): n is a, c, g, or t
  misc_feature (448)..(448): n is a, c, g, or t
  misc_feature (492)..(492): n is a, c, g, or t
  misc_feature (510)..(510): n is a, c, g, or t
  misc_feature (541)..(541): n is a, c, g, or t
  misc_feature (556)..(556): n is a, c, g, or t
  misc_feature (566)..(566): n is a, c, g, or t
  misc_feature (586)..(586): n is a, c, g, or t
  misc_feature (588)..(588): n is a, c, g, or t
  misc_feature (650)..(650): n is a, c, g, or t
  misc_feature (653)..(653): n is a, c, g, or t
  misc_feature (658)..(658): n is a, c, g, or t
  misc_feature (703)..(703): n is a, c, g, or t
  misc_feature (721)..(721): n is a, c, g, or t
actgaagtcatactaaaagggaatttacaccacttactgcctacattagaaaagangtctcaaatcaatgcaaatcaatgacttctgcctttacagtaagaaaccagaaaaagngcaaataaaatccagtaagcagaagaaaggaaacaaagatcagaacagaaattaatataatcaggaaaagagagagagggagaatcattgtaaccagaagtttggggnaaatcaaatcatttggtaaacctctagccagncagatcagaaaaaaacacgaaagacacaaaccagtctcagaaatgncgggnagcctcattaccancattaaaaggatangggcatgttaaaaggatangggtatcantaggntcccccccttgggtgngntatntnaaaaatttgaactctttctcagtgaccagggcctgtgcttgggcatgggngggcgggnggggccggcatgccagccgcccagggctgggtttgtcgccaaanttatgtaaccctgcaganacccttcgagaaacctcatctcgaccaaaanctaaagctgattggngagtatgggnctccagaacaaatgtgaggncnggagggtcaaatttaccctggtcaagatccataaggccgcccgggaaccgctgacgcttganganaaggncccacggcgtctgtaaaaaggcattgccctgctgcagtggctggnccgcactggggtgctggntgagggccagatgaagctgggttacatcctgggcctgaagatc

SEQ ID NO: 561642 - DNA, 723 bp, Homo sapiens
  misc_feature (723)..(723): n is a, c, g, or t
ctaggtcgaggctgggtgttaatcggccgaggctcgtacccgacgatcaccatcagctacctcccacacgcgccgcccttcgccggtggccacccggcgcagctgggcttgggccgcggcgcctccaccttcaaggaggaaccgcagaccgtgcctggaggcgcgcagccgggacgccacgccgccggtgtcccccatcaacatgtgaagaccaagatgctgcatcaaatgtgtgagctgcaagctggctgcgtgaacctggctggctgtgccaccaatgtgcctggaagcggaatgctggatgctgcatctgcgctgcctgtgatggacaatggtgaagactgctcaagtgcctgagaactgcggggctgtcgagtaccgcctggcctcctcctgtggagcagtgtggcccagctcaaacagaaggtcattgacccactgtcatgcaactggctgtcagctgctgcttggggtcaatgtgacacgccttctgaactgtcccctgcccctttactggacaccccctctgcttgtgactgtgctgtggcacactgcctcccactggggtccagtggagcaggctggtgggcacccaccctgggacctaggggcgcctgcaaaccacactggactcctggccctcctaccctgcgcccagtccttccacctcgacgtttacaatgcccccccttccactttttttgtatgtttttctgctggaan

SEQ ID NO: 561643 - DNA, 307 bp, Homo sapiens
gataaaaaacccagcttggaccaggtgcggtggctcatgcctgtaatcccagcaatttgggaggcagaggtgggcagactgattgactccaggagttcgagactagcctgggcaatatggcaaaacccccgtctctacaaaaaatacaaaaaattagccaggcatggtggtgtgcacctgtagtcccagctacttggaaggctgaggtgggagaatcacctgaacgggggaagtggaggctcttgtgagccatgattgggtgcacctttgcactctagggtgggcaacagagtgagtccttgtttgg

SEQ ID NO: 561644 - DNA, 1716 bp, Homo sapiens
  misc_feature (719)..(719): n is a, c, g, or t
ccaaccactgacagctcacctggcccagggctctttcctttacctcgtggcggtcccgcgcctggcccctgctgggcctcgcctccctcgcgcaggctctcctctcagctctcactgcggcaccacaaccactcactcccctcatccaacacaccacctgcacacgccctccgccgccacccctcacacactccccctccccgcaccctcatcccacacacacgccgccatgccctccacccacaccctcacatcagcgctcgcccaccgcgccaccacagcctggcccactccccactcccaccctgcgcgcgcgcacgcgcctaacatagcgaccaccatacggcggcccccggcgccacctgccaccccaaccacccctcccctgcgcccgcacgccacccctacgcgactgccccccaacggcccgcacagctcgcgcctaacccccaactccccgcgccaccgcccatcgcgcacctgccttccccgcccacacgtccctacacccgccccacgccacccccacacaccccccccccccacccctccaaaaccccctgcgccaacaactacacagccgcctcgcccaccggcccaccaccccccaccgccctgcctgcacactcgctcggacacgcgcggcacttcccccctgccacctaactggcgcaccaccacacacacgccacaccctgggatggcatatccacgcacancacccctggaacctcaccaccccacgggctccagcccccgggggaaccacagttcacccaacaccaccacacaccaggcagcacaccagcccccccagcccgctggcccccccccccagcgcgcgcaacacacccccacacgtcgccaaccgccccacatcagcccacggcaacacaagcacaccaagctccccctcccctctacccccggcccccagcgcccccaacgcgcccacactacagcgcatggccaccacttcccgcctcgcaccaacaccaccacggggcacacccccaccgaccccgcacagccgagcacgcaacgcaccccccccacccaaccacccgccccgggccgcacacccaacgcccacacacatccaccccacacacacacgcccaccaccggacccccacgcgtcccccacaccgcacacaccacacacacctgcgccacaacattcaccccacagccccaacgtcgctgactagccgctggacacgcacgaccaggcccatacaagcccgctcactcatcgcggcaccgcagccatagccaacacaagctaggcacataacaatacatcacccaaccacgccacccgacgcgacccgaaccacgacagcaaatcgacacaccaagagaccacatacacatacacaagcgcctcgcaccactcgacaggacacacacacaacctggcgaccaccggccacactagcacaactaggcgccacactgacacacaccacgagagaccaacacagacactcaccccaacagccacgcacccaaaaaaccacacacaccagcgaccaccaacacctcctggcaccaaccacacacacgccaagcagccacactgcacgagcccaacaaccaatcccaccagccgcgcacacaccaggcatgaacaacagctcccaaacccaaccacatcacgaccgacgcacaccactccaccacccacacaacacacacgcgcacccacaccaa

SEQ ID NO: 561645 - DNA, 486 bp, Homo sapiens
ttacatctatataatcttacataacaaatgtatacctacacatattagcaactcttctaatacatgacgtataaaaattaagaagaatacaaatattccagccccaaatgagaaatcacacatattaaattgtacaagaaaatttcttagaacactttagaaagtttttggaaacttagaaaagagggaaaaaaatccagtgttactagtaatttccatggtaatacagataaaatacatacttttaattctgggaaattagaaaaagtgaggtgatctttccaggaaaaacatgtgtaacatctgcttatcactccagctccctcctcctcctcctctccacgttcccttgagtaaatgtctgggaaagtatgaagcttgatgcaagaaccctgttgtactggcgttttcctcccctgtgacaacgtaactactgttgggagtgaattgaggatgtagaacggtggtggaaccaaattgtggtca

SEQ ID NO: 561646 - DNA, 283 bp, Homo sapiens
gtgacgtgcaggtgaaggacaggaaggggcatgtgagcgtaaatagaggtgaccagaggagagcatgaggggtggggctttgggacccaccgggccagtgctggagcttgacgtctttcctccccatgggtgggagggccccagctggaagagcagactccagctgctacccctccttccatggagtggctttcatcttgggagatctgactagtagactaacataaagatataaaggcataactatttttgtgagcactttttataactccaaacaaaacct

SEQ ID NO: 561647 - DNA, 838 bp, Homo sapiens
ggctctccgccaatttctctcagatttccacacgagacgttcgaatgtcatgaaaaccagaatgtatcgacagctattaatgtacatgggccgcatcaggtaatgagatgtgagccttgtgcatgtgggggagtagggagagagatggactgtccataaatgatgttccccctaaacattggctgttataggcctcaatgtagtgcaggaatactttgtgatgtcaccatggctgactattccatggttccacgagaggaggccttatcaccaggagtgtggaagttgaactgctccgtatgctcacgtccctggaatatacggagcttcagaatcgtggggctccataaatgcatgaatcaatgcaagcccagcctcattgggaatgtcctgggacagtctgttctgctacagctcgcttgcaacgagtcgtggagaattggcatcgattgataagcctatgagtcgacaatcgttctgtcgaagatgtgtcgtctacatctactactgtggcttggagtgctatacatgggagcaccgtgtccaggtagaccccagagcatggtcatgtaagaggctttacgattgtccctcatttgtggattaagagaccactgtgtgtcgctggtcactcccattggaaagcccttttgaatactctatggcaaagtgactcatggaccctgaagcaatgccaatcactggctgcggacaagactgtgaagtggtcgctccagggaaaactggggcgctgactggaccccgggtgttcggcaaaacatgtccatgcctccggtgacactaacagggtgcgatccaagtcatccggagtgaacgg

SEQ ID NO: 561648 - DNA, 486 bp, Homo sapiens
gttacatcactgagcccggaggcagagtgtgcggtgagcagagcgccactgcactccagcctgggctacacagtgagactccatctcaaaaaaaaaaaaaaaaaaggggctaaaaatagccaagatgtcgtacaaaatacagttaggatggttaacagactgattgttggtttcccaccaccatccctgtcccaaacttttcatttggcgtgaaatcctaacccccaaactaaatgcagaaaccagcatgcgtgaaacaaacgggcaaagaaaccacaaaaaaactctttggggcataatactaagggtaataccttactaaaattctcaaaagaggaagagccaagcaaaattcagcctaagtgataaatagatgtgtaaacttatgaaaaaccaccttttaaaaatgaggaccgtgtcaccggggggttacagacgggagacaagatcaggacttaccaaaaatgcccaaggcccatttatgac

SEQ ID NO: 561649 - DNA, 872 bp, Homo sapiens
tttacactcaggcgggatgccttgctgttgcagcaacaggattttacagtatgctttactcaaagcttgcattcttaatggagatatcaaatggtgtaattccaaatataaatatgtttatgacactaatcatatgcttttaacaataactttttgataacttattgccctgtaagttaaagccttacacggagtggactgttgccatcagaaaatcccctttcacctgctagagagagtgaaagtagtgcgtggcctccacttttcagttaacgagtagcaagcttctagtaggggctgcttatctgacccatgtggggtcttgggccttgttactttcctgggttcgtcccttcagctggaaaggctgttgaaaacacttgccaggaaacagtaaagctgtgagagaatcttctagtcttagatatagagaaatgagtaccagttgatgctaacacgatacttagactttgaggggcttccatccaagctttggcatgaatctgttagacacggttttcttcactcctctgatcaatctttttttccagaatgggttataatggtcagtggtggtaggtaacaaattctaaacatccagtgttactttcggtccgagtatagtgacgtagaggtacggtacagttcaaggtttgcccttcaggaacagtcctttttcgagtaggtatcgatggttccctgtgaaactctcagcagtgtctgtgcaggctctggtgcatgcttggtattgagtttcggcttgaacaagggctttggaagtcaactgggattgtcagttcttggatgtcatcatgaatgggttacaacattttccaggttcatgtccttccaactccctttaatcttatcga

SEQ ID NO: 561650 - DNA, 231 bp, Homo sapiens
cactagtagtaggcatcactagattctagttcacaattaggtcgaaccctattactctatgaagaaggaacaagagaatgtgggccagttttcatttgccattcttccatgtgagttagtatggctcgtaagtattcctggtgatacgctagtattggcaattctgtgaggttgaacaaaggggtggtatggtgtgctagcgtgggaattaggagacctctgggtcttgac

SEQ ID NO: 561651 - DNA, 617 bp, Homo sapiens
agcggtctttcgccgccggcggtgcgtgggcacgcgcagaaaccgctaggtggcgacggtttcccttcccacgcgcggacgccggcgtgggccgactgcgtgcggagcgcccgcgcgtgcgcagagcctgaggccaggctgccctcgaagcggggcggggcgaaagcggggcggggcccgagcagggccggggcggggggcttgagtgttgattcccaaagccgcggggccgggctccagtgtggttgcggggaaaacccgaaagtgggcggcggccgccgtgcggggcccctggtcggagcacgcgcggcaggaagcttgggcccagaagacgcggggaaccggggccgggggcccccccggggaaccgagggcaaaagatgcctggacagggcacatcctggttccaaagatgctggccaagcttgtcttgacacgtctcccattaacaactcgcgaggtagcctttaaccccggggctccctacgcgagaacgtacaaggactcctttgactgcgagaacgggattcccctttcaagccaagttcatgtttccccttacatttagaagactaatcttgacaatgtggtgccgccatggtgcaggatcgcaaatg

SEQ ID NO: 561652 - DNA, 1005 bp, Homo sapiens
  misc_feature (1)..(1): n is a, c, g, or t
  misc_feature (380)..(380): n is a, c, g, or t
nctattcttgttggtcgttgtgttgtgtgttttagttgttttctgttgtgcgttgtgtttgtctcttgtggtatatgtttgttcccccccgcggccggacggcgcgtcgatagggggtcgcgcatgtgaggttgcggctcttttagcgtgcgtctgccaagacgcgcactcgctggtcgcccgttcgccagtgtctgtttttagcgccattgttccagtaccccgttgctgtccaggtgcctgccattaggactttgcccagaatgcgccctcttttgtagccaccggcagatacatcttagggctcttgttccagaggttcttttaaattctgcccaagtagggcattgtctctgtcacctggaaatgcccctggaccngcatttgctgactcttctgcaagtcctccagacacgcttaatgaagatggctttctagctaagaaacacgaggggttcatacacaagccaagagtacttccccaccttgtctctgagtggaaactcacagggcccttgtggaaatggcgtggatttgggaactcaggctgatgaaacttggaagccccgcccacgcccgtcagcacgtttggtccacgaacctcgtctgcaccctcccgtgttctagtaaatggaggaagggagaaggagatgaaactaattgacccttgggcctcttttatgaacccggcaactttgctattctcatccacgtgcttacctctggtatgttcacccctcacaccaggtgtttgtaagaccttgatgaaataacaactaggcttaagtacttagcacccacccaacctaggagctatatatgagttgtagctattgtaagtatcatcccacttatatagatgaaaaatctgaggctagaaagccacatagccgggactctaatcccactggctagttcccaagcccctattcttccaccaccatataaaatattgcttccccctctcttccttcttccatagaggttggcctgaaatcccaatta

SEQ ID NO: 561653 - DNA, 1355 bp, Homo sapiens
taatcttctagaacctttatttctcggtgaaaggggggaaaataaagggaataaaataaaaagggcacagtggacacacaaaaaaaaaccaagtgtcagggggaggcgcggggagggtggagcaagttaaagtggggggaggggttcccattatacagcagcgaggatctccaggtgaccgcgggagtgcctcacaatctctcccggagagggtggggcgggagtatagcccctttcactcccagagggtcagcgtggtcctgtgtgtccaacacgcgcggggcctcccctatagcccgcgtgtgggagggggtggaccgggtgtaaaacattttctccacgagggcgtggggacagagagggagagtacaacgcgggccgtgggcgtgaacagtgggtcacgaggggttacacgcaccacacgtgccacacaggggagagtgtgcaccagaacacaaagaggccccccacaggtgtttatacacacaaaacacagacgggcatctgtggcgggcggtgattgaggagcgggggttgggccccacacgagagcaggcacccagagtggtaaggggatcactctatcataccacacacactataagagtgcgcgaacgcaagaacacacaaaccagcagaacgagagagcccaccaccgtggggagccaacacgaataataagaagacacacctccccaaacacacacccgagagacaacccgtgggagactcacaacacatataccatcccaaaaggaaacgttggggccactgtgaaaacttctccacaacctcagtgccaaagaggggcgagacagtgaaagagcacaaccagcgcaccgggcgacccccccaaaaccactacaacgacacacaacaccacatgggggaccccacacattgggcaaaaagcggcaccaaatgtgggacaccacaagggcgcttcccccaaaggcaccaagcgacccacccaacaacacccgggagcgcaacaccattgtctccctaagagcgagaacaatagatcacgagaaccaacaaacaccccacacaacaaggaacaaactggaaaccacacacaaaacaaccaacaccaaagaggggaagacccggcacaaccggaaaacacaccccgaaccaccgacacaaacacccgtagcggaaaactaaagcggcacacctggccccggccaaccacacaccaacaccacaaaacacacgcacaagacagaaaggcacagacccccaaagaccagctgcaacaagagtcaacaaaaacgacagaaacacgcaacaaccaagcaacacaagacacaacaaaacaaaccacacaagccaccaccccccaagcaaat

SEQ ID NO: 561654 - DNA, 938 bp, Homo sapiens
  misc_feature (463)..(463): n is a, c, g, or t
  misc_feature (581)..(581): n is a, c, g, or t
ggagcgtgtgtgttcgtatcgctgcgaactagattccatgttgcgctgttattaacaagatttaggcatatccccgtacggtgacgatgatcatggtggtgtctgtttcgggccaccgcatctagcagcgagttgtgactggctccatatactcatgcgctgtaccctttggatagtctccgacgatcacgcggggctctatgctttgcattaatctaatacgagtatatccaaagcagaacttgcttgcgtttagcgcgtgcagagtgtcttctgaaatgttcgtcacgaaaccggcggagatcagtggagagtcctgtctctggtgatgatgatctacttgtacacatccacggtatgacttggacgatgatgcacagctacaagtgatacagagtaagcctaaagtttgggcgcgtatcgcctttaatattgcctttgctcaagacaggtacaacatagnactggcgagctggttaaagtgtcgtcatgcgttacacattcctgatgataaatagatctggttctccagtcaccattggcggacgtagcactacgtgtacgtgtgtgtacaagcatgnaaagtttgggtcttcgtagcgagaggggtgcttcgctgccccttgcacactttaaccgcttagttgtcgtgggtgccttgctagttctcggctagttctggagtcccgttggccgcattgagaacaagggtaattagtgacattgcgacggtagcgagcgtacctcggtggtagtgcttcggtgtttgacctcagatatcgagtgaagggtctgcttcgcatgtttgcccaagtgtcggtccccttgcatcctcgagttgcatgctcatatcaagcacaccttttcaggagatcgggtgagcctgttgcaggtctaactttgacgcttggctgtgccgcttggcacttggttagacc

SEQ ID NO: 561655 - DNA, 100 bp, Homo sapiens
ggctagcttggcacattcggctctgctgatgagtggatctgcactgggaagagtagagcagcttgaccccccatcccttcttgcttcccctccccctact

SEQ ID NO: 561656 - DNA, 192 bp, Homo sapiens
ccctgtctccccttgcttctcctctctctctccactccctgaacctactctgccacatgctgggagagagagaggaagggaatagaaaagaaaagaaaagaactgtagatcagagtattattctccgccggatcgaggatgtgggagtaccagacctcgaaattcctacactcctagggtcatacgctactt

SEQ ID NO: 561657 - DNA, 187 bp, Homo sapiens
aacaaaaaaaaggagggggggaaacatgaaagtccattttaacaatttttgcaaaaccttttatttgcagacccttggatttatggtattgccctctcggggtgatttatcggatggatttgataggttttatgaattgttttgagttgtaaactcctaaaccctttatttaaatgggccttattta

SEQ ID NO: 561658 - DNA, 240 bp, Homo sapiens
aacagtctccagccctctgcactggactagatcagaagcacctcttctgttgatagaagttgatggatggttcattctgattctgctgaccaagaaatgcatgcttgctgcagcgacacctcattgcaaacaggatgagattcttcagaatttctgatccatatgtccaaagacctgctataatcactacatcacagaacaagtccatcggatgaatacaactaacttgccaatctcacg

SEQ ID NO: 561659 - DNA, 398 bp, Homo sapiens
cgctctagagtttccccatgctcatccctccttggaggaagacaattaatagctattatgtgagttaataaaataagcccaggatttataactaacctgttcccattgattttccttgtctcatgcaggcacagagctgatcaaaacagcaaaagcaaagcagtgcctctggcccagttctgaagccaaccttccttaatcacccagacccatccctggttaggacttgctgtggatcctcaggtgactccatctcaggatacagggactgagagtgtgtatgcaacttctcagacccagaaaccgttgattctgccaaaaaacacagcaataaccacatcccaccctcttgatttaaatgaaagggtttggaggaataaaagatgaacttctttttt

SEQ ID NO: 561660 - DNA, 1626 bp, Homo sapiens
  misc_feature (325)..(325): n is a, c, g, or t
  misc_feature (750)..(750): n is a, c, g, or t
gtggaagattacactggtgaattatggcttccggtactctataatgccctgtgtgtgcttctcggcgctcggggtactataaagttgtgctctgaggcatgctgcttttggtgtctgctggatctgaatcgcatgatgccgtaatgccagctggaacgcagcaacaaggtagcgaaggcgacgatattgtaaccgtgactatcatcaagtccatgacctataacacgtattgcatgagtgctacagttgcgctctagggacatcataagcgcctggagtctctcgaagtattgcacttatgaggtagctgcatgcctgggagtancctcgatgacgatgatgtctgtgcatgtatgtacctagaagcactcatatgtacaccgtgtcattgcgtacgtatggcacagtaatgccttgtggggacgaaggggaggcacactactttgtaatcctcttgggaccgacaagcacatcaaaccttaggtacttgagtgaattgcccgtctggaccacgtatggcgtgacagtatccttgtattgccctttgaccaatttgcctcgcttgtgtcattcccctagtcgagcaaattccctggccttaagaaagggactttgcgggaaggaggttctatgagaggcccgcgacgagcctaggccggatgtagtatgcctcgacaaccgaacgtggctctcgtagaggggaggacctacctaccgggagttcacccctagagacatccttgtctcctncaatgggggacactggaaagggggcgtccgtataacacataggcaagttttgccttaatcgagcatatgcgtgggcgttatggccattcgcgttccttccttttgcgccactttgaagagatagctaagggcaaattacacccaaagttaacttagccccattttggcaccatagaaaaatgggtatacctgggctacctctgtcttggcttagggaccattcgggttaccccttgggtatcgcaccaggggcacccttcggtatgcctataaccgtgctcaggggatagtggtattccccctttaaaaaaacggctcgctgtcgaaaccaagaataaggtgggttgtccgaaactacgccccccagaggaaggacccaccgcctttagggtatttatcatagtgagcccacatttgtgagggcaacaggaccaagcggcgtataacccaatttagcggcccttggtgcactgtctttccgtgtgtcagtgcgtctggccactcatagacaatgtattgtgtataaccattccgaaacctctgtgtgtcctttattacattttcaccgtgcgttgggggttacctctactttgatgggtttggacgacgttaacgctgagaacagactaacagcggtacaggccccaagagtgcgctatcttatacatatcataggagagcctacccgatcttccacacgcaatgacagcgaactagtgcgccattttttctctaagagtagatggcctaatcgcggcgacaacgggagggaccgcacggatatcatacgtagctccacggagccatactcacggactcactagacacctcccggagcaaacacgctccgcagacacagctctagggccacctata

SEQ ID NO: 561661 - DNA, 644 bp, Homo sapiens
  misc_feature (424)..(424): n is a, c, g, or t
  misc_feature (507)..(507): n is a, c, g, or t
  misc_feature (548)..(549): n is a, c, g, or t
  misc_feature (603)..(603): n is a, c, g, or t
ctttgtttgtagacaatataatcttttatttggaaaaacctaaagatgccacccatacaaaaatcagtagcatttttgtatggcaacagcaaacaatctgaaaaagaaatacagcaagtaagctcatttacaatagctacaaataaagtaaaaaacctaaaaattaaccaaagaagtgaaagatccctgtaataaaaatggaaacattgatgcaagaaatggaagaggacacacaaaaaacgaaaagatagtcctggatgaatcaatattgttaaactgtgcatattacgtaaagcaatctacaaattcaaagcaatgcctcttaaaatcccaatgtcaattcttcaaagaaatataaaaataattttaaaatgtatacgggaccacaaacgacacagaatatagtcaaagccatcctgagcanaaagaagacagctggaagatcacattacccgactcaaactatactattaactatagtacccaaacagcatggtactgacatangaaacagcacatggaccaatggacagagtagagacccacgnnaacaatcatacatttacaagtgaatcattttttgacaaggatgcccaaaatttncatcaatggacaaggtttttatatatatatatatctggttg

SEQ ID NO: 561662 - DNA, 382 bp, Homo sapiens
cccaaatggcgtctgagttatgagcctccagccagcggtcgagggtctcgctggctcatggatatgacgcaccggacgaacctgctaacgattatggctatgcaatctatggaaacggctgctagaccctgtactacctaattactatgcgacttgtacgccgcacataattccaactcagcagaggcatctgtggtgtgcatcatctaacacacaatcctcataagcttatcgacggatctcaagctatctgcatagttgccgagagcagatgcactcgcttactaagctgtgaactcgtacgcttagccctgtgggatattcgttcatctacagctacagactgagatgccatgtatgcgacgactctagtatagcctgg

SEQ ID NO: 561663 - DNA, 822 bp, Homo sapiens
cgctaacggaagataccttgcgatggctgaaaaagatcgccccttccagcgatcaccgagtacgcatgtcgaataagatggtgctgcaggggctgcttggcgacctgctgcacagtccgaatcgtggtgcgaactgtctgtccagagtccgcgcggcctatccgacgtgcggctgcagcgtcgactggctcgttcagcaacttgctgcgaggctcctagcgtgcgggggcctaggacgcggacctgccgtcatgcaggacctctgcggtgtgggcccgtgggctccctgtgccgccgcgctgagcgatttagagactgccttcacctcaggaagactacgcgcgcggcacttccggaggcctgcgtctgtgtggctcatcatccacggtatgccagacggggccctggcgcaaacatttaatcctgggctgtgctggggccgaggccgctatgcttattccttccgggctctacatgtggcatcaatgtggacggggtcagttcctgggcactgcgcgcggcattcgaatcccgagctggtgattgtttggcctgcagacatcccactgcataatgagccgtaggccagaccgccagctccgttgaagtcttgtgattggacaagacacagtgtggacgaaagacccctaagcctaacagagatgaaggtaggctgggtccagacacggcacctacggaagatgccacggaccgaagccagagagcctttcctctgcaagtgggactgaaactcttgacagatgctgctcaatctgactggtatagcaggacaagttaattccagggcacgatatggcttga

SEQ ID NO: 561664 - DNA, 395 bp, Homo sapiens
tataagtaatttcttatttgatccctagttaaaagaggaaaaaaagctccatggctgccgctctgcaccatttgggatgtatgaagagccaagcccagcaatagaggggagcctgcccacatggatctataggagcctaacaccagatttccccatggcgcgatcccggtgacggaggcagccccagccggcatgccgcggccactctgcagaatggagaatgaatgtcggtgacaggggcacacagggcctccagggagacggccctattgtgcctcttctcctgggtgtttgtcacctgcatgcaaatcctagagaccattcactgactcacgttttcttacctgtctccttagaaacagttcttaaaagctcgcaccctgtattccacttag

SEQ ID NO: 561665 - DNA, 142 bp, Homo sapiens
  misc_feature (20)..(21): n is a, c, g, or t
  misc_feature (33)..(33): n is a, c, g, or t
  misc_feature (40)..(40): n is a, c, g, or t
  misc_feature (53)..(53): n is a, c, g, or t
  misc_feature (72)..(72): n is a, c, g, or t
  misc_feature (74)..(74): n is a, c, g, or t
  misc_feature (85)..(85): n is a, c, g, or t
aggggttctttttgtccctnnttgtaccttgtnctccttncttcctttgcccnttaagccccaaaaagcttncnattttttgctnttttatggcttgcacaagagcctttgatttgaagattatattcttttctgaacagta

SEQ ID NO: 561666 - DNA, 157 bp, Homo sapiens
cttgcatgtctttacctctgactgacccgaatggtagttacatgccattcaccctcagagaatttccaagtaagctgaaatttctgtgtaggttctacgcccatccaagggacttgggtgccgtttgattgcaggcagaattggcttgtgcaggggg

SEQ ID NO: 561667 - DNA, 1370 bp, Homo sapiens
attctagaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaagtgattggctttggacgtctaagggggcggggttgtcccctccgggcaaattgccctttcaacccggacgactcatggtgcccactttacccggggctgggagagtgggtctcagggtccctacagggagataggcttcgttccccttaacttccgtatgtagcactttggctctggcaggagcctggccattctctaagcctgggtaagagggcactgggaatggtccggtacagagagacctagataggtcatgcaagtgagcaacgactcgggggaacactggagacctaaggcgaccggaaggacgcacaaagacaagcttggggcacgaccataaacacctccaaaggggcatactggccggacttgggtatcacaagcaggcatcagggaccagcatgggccgcggaacagcggcggcaccaacaggcccacaacgggaaacagcgggcacatatctccacaaaagggtcgagcaacacacgctcgggtggtccacacgcgtgcatcaatgaggcactgcttgtctcagtgcgcgcgagactctgtctcgcacactcacgcccacacaacacaaacaacaacccacaaggagcgggggggggaggaggggaggggacgacggaccgggaggcagggcggagaacagcgggcagcgggccgagtaggcggcggcaggccacagcagagggagcagaggggacaggcggcacgaggggagagacagggaaagaagcagagcaagaggccggacggggcgggagacgagagcgcaggaggagacaagcgcagggagagaaggggggcgcgagagggagcggggaacgcgaggacggagcgcggaggggggcgcgggcgaaccgagagagcgagaaacggaggagggcgggacgcgggcgggagagcggagagggacaaggaggtgggaggggggcgaggggagggagaggggacggaggggggagggagacgagggggagagggggaagggggcgggccgagcagcggaagcggggaggcgacggcgcggagaggacgcgcgcgcgagcgcgggcgagaggggcaggagcgagaggcgcgaggggggcaggcgggagacgaggaggagg

SEQ ID NO: 561668 - DNA, 746 bp, Homo sapiens
cgtgggtgtctgcagtgcccgggcacggcttcggcgtcgcgtgctcgctcctggtcgtggcgggatggcgggaggagccgcgtcgtgtgtgtgtggcgagcacgtgcacagacatgtgtagtgtgtagacgcagagggcggcggcctgtcagtctgtgtggtggtgtgcgggctagtggttgtcctgttggtgtcgtggggctgtgtcgtccttgcgtctgttggtgtttgtcgttcttgtgtctcgtctcgtcttgcggttgtggtgcgcgtacggtctaccgtgtgtgtcgtgcgctactgcagacgcgcgtcctttcgaggggtatcggagcttggcgcgccagcgcgtagttttggtcttgaggtggtcgggcggctcgtgggactggcgctggtgctggtgtgtgttcgtgggttttggcttgtgtttccgcgactcgtgtaccgagggttttgtttcttgccgtttcgttggctagtgcgcccacggtctttgttctgtcgcgttgcggctccgacttctgtgggtgtcctgccgcgttggtgcggcgtctgcttcggatgtcacggctctgtgttgggttggcgggtggcggactgttcttgttctgttgtgtataggggagggctggggtggcggtgcgcccgtgtggttgtgggagccgcgctgcccttcgttggcttgttgagggggggtagtgactgacccctcggtgcgtcccgcccccccttacccacaaaca

SEQ ID NO: 561669 - DNA, 130 bp, Homo sapiens
  misc_feature (23)..(23): n is a, c, g, or t
  misc_feature (64)..(64): n is a, c, g, or t
gcgacaacgccaaggcgatccgnctagctgcaccggtgcactgattcactataggggatctcgnagtatctttgtaagatcaccacctgcccgcctcggacgccatccacagatcgccttggcgttgtag

SEQ ID NO: 561670 - DNA, 820 bp, Homo sapiens
  misc_feature (319)..(319): n is a, c, g, or t
agtcatgtgcgggagattcacgttgccggcgaagtgggagagagaatattgggccaactaggctagctagaaagactgatcattcatcacgctgcacgatatgccctgggatttgtgattccctgtggggtgaacgacacttgtcggggtagccttcgcacgtatcgaggcaatgtggaggacttagcctccgcgggtcacttgcttgactaccagtctctgccgacgtgtggcgttgtcctaggcacacgtatcgaacgtgggacgaaactcatgtatcacttgggcctgaccgtcgtttgacgtggacctgcccgcntctactttcatgcactttccagtggcacagcataagccaatcacgggacttgcttcaataagtatatccaaattgccatacaactcgccgagtcctagcggttctgtgatgaagccatttctcgattccattgttggcaatccaattcgtaccatacctcgttgtcgagcttgccagttgccaattgggggttcaacggaaaggccaaggcattgatccccatcccaagaatctatggggattccggactaggactccaaaacggacgtaatcgaatctaatacggtgagtgataccttgttcagcggcaagcttgggggccacatccagtactaagtaagcgtgccccatggttgagccacgttgggtacattttacaactccccgggcatatacgacggcattgcatggaacaatggcatagcatgctaggaactagtcggttcccgattttttatgggtcttcacaggccctaagaaagggcaaaggtccaaggcgaa

SEQ ID NO: 561671 - DNA, 223 bp, Homo sapiens
tccactcgatggttcccacatgtcctccaggccctgttgacttttcttcagtcttttttctttctgttcgtcggacttgacagtttcaattgtccggtcttcatacgtgtattctttcttctgcctgcttagatcggcttttgaatccctctagtgaatttttcatttcagttttgtactttttatttcataggaatttctattctcgcttctttatcagcgt

SEQ ID NO: 561672 - DNA, 243 bp, Homo sapiens
gatcatgcttattttcctaatggttctttgtatccgtagtatttagttacaatactgggagattattccgaagcctggtaggttaataatattaacttcgagggtgacctgagaaatcagaataggtgttggtatagaatggggtctcctcctccggcggggtcgatacaaggtcgtgtcgcggtagctgtctgtgagtagtatagtgatgccagcagctatgactgggagagataggagaag

SEQ ID NO: 561673 - DNA, 274 bp, Homo sapiens
cttctgtaaactgctacccctgaggccttctgcaccccggggtgagcctcctgcctgcctggtgccctgtcccatccccatgtcctgtgcagggcacctgcgtgctgacagccatgctcttactccagccggggctgccagcgcatccagccagcccaaccctgtgaaagatggagctgacttgctgcatgggacctgatttatacggcaacagaagtcacactccggcctctcataattcacttgaagttcaattaaatacagtcacaccgcc

SEQ ID NO: 561674 - DNA, 482 bp, Homo sapiens
  misc_feature (12)..(12): n is a, c, g, or t
  misc_feature (289)..(289): n is a, c, g, or t
  misc_feature (393)..(393): n is a, c, g, or t
  misc_feature (395)..(395): n is a, c, g, or t
  misc_feature (414)..(414): n is a, c, g, or t
  misc_feature (453)..(453): n is a, c, g, or t
ttttttaacggncgtcgcatcgaagatccaatcgctgcttcttccttatcgaagcgatcccaagttccctgcaattcttgaagaattaacgaccgccaacataagccgtacaaaaagttacatgcgccagccagatggtgagcataccgcggtccgcaggccagccaatggcatgagcaagcgcgacgaataattacaacagcgacaagcccgtgatgacatctggcattaccagcggcgcggtgattcataaaggcaaagccatttgatccgcgaaacctgccaaagngcaccagcaccaccgccgcaatagttccgaggatcgccgccgccgtcgccggacaggccgcaattgtcagacttaaaccaaccgcactcatcatccgtcatcgngnaataactcaccataccagngcgttgaccagccggcccacaccgtcaccagcttcgagntgttaaacgaatagataaccagcatcagc

SEQ ID NO: 561675 - DNA, 106 bp, Homo sapiens
gaagcgtgctaaagaaagtgcatgaagaggagatcgtgagttgcaggctcagcgtacaggaacagcaggatccaggtggagatggacatgtctaagccagaacctc

SEQ ID NO: 561676 - DNA, 352 bp, Homo sapiens
gcgtcgacttttttttttgctagagtctcactcttttgcccagactacagtgcaatggcatgatcatggctcactgcagcctccacatcccaggctcaaacgatcttcccacctcagcctcccttgtagctgggactacaggtgtgcaccgccacacccagctaatttttgtgttttttgtagggacaggtttcgtcatgttgcccaggctggtctcaaacttttgggctcaggtgatccacctgccccagcctcccaaagtgctgggattacaggcatcagctactgtgccaggccccaattcccaactttgatttctgaacttcaggcccacttctctctcttgtcgacg

SEQ ID NO: 561677 - DNA, 99 bp, Homo sapiens
cctttacctattggcgtcttactctatcacaactgtgtcagcgacatccgacttcccagcccccctgcccgacatgtactcaataaaatgtgagtggtg

SEQ ID NO: 561678 - DNA, 410 bp, Homo sapiens
aagggtgaccgcaggcgggttacaaggccatagctgttaagagatcctctcacacacagatttccaaagtgctgggatggcaggtgtgattcatggcacccagacttggctgccttacttacgattatcgaggcccgagaacctcgaaactcaggcactgtatagatgaccactttcgtaaaatacggacctagcttgttgccaattgttgattgaactgcccataactccacttcgggtctgtacctctgtatactgccaccttctgtccctgtcatgagcctttaggtctccatttgcatatcgcaaatactatgttccatgtaggtagctcattcagggccatgctctacagttcaaaaaaggttcccttgaggactggccgtcaaaaagaatagcagtgtgcttcc

SEQ ID NO: 561679 - DNA, 905 bp, Homo sapiens
tggcctttctcgggcatttttagaagggctctttctatcaggcccgggaatttccgcgctccgcatgctccctgacccgcgatgtcggttatttccccagaaatctgccccgagggtctcctcaatttcccgctccccgcgggccccccccatgtgtgccccctctcacttcctgggaacgctttctctataccgaagattccaggcgaccctttccggggccgccggctttttttgtggttttacctgcacccccggggtggaccccccgaccttctcccggaggcattttatgttaccgcctcccgttacccattgccccctgggtaacaaccagatatcttcctctgcgctaatgtgggacaattgccccatccccaagcaacaaacaagggagcttccaccccaacgggctttgaaatcctggctgagaatctctgtgctcgggagaaatttctggcgcaatgacgatggccacccatattctccgcgggaaaccacccccatggggagagtctatacccctgaaatcttgtacatttctaccagagatctctgcagagattgttaaaaaagagatgcaggctgtcttctgagaaggccgtgaaccacaggaggaatttcagggtgaatggactcgctcccgctcctgagttcacggctactcagccccgaggttccagaactggttttgaaggtgtaacaggtgcccttctgtgcctattcagccattccctactgaagactggagcgctcaccccgccccggaagaatggtttcagctccccctgctcaggcccctgaatgggtaggagcaacccctgcactggtcttaaactgttcttgcataggcttttaaccaccatgggaaaattgttgatggaaaataaacaccacttttctta

SEQ ID NO: 561680 - DNA, 917 bp, Homo sapiens
tcacaacaacacaagttttatatttgatgcgcctactatgtgccaggcacggtcctagaacccccccaaaaaaaaaaacaaaaaacaagcatagtatggcagacaaacacaacattcttgatgttgatgatgagaatgtggtgtgcatgattgagataaagacgtgtgttaattgtggacactttgaagaagccttgatgtgttgatgtgggtggctcatgccatataagtgccttccttcatctctggccctccttccaccagaaactccctcacctcccctctatcattgctggttgtgcctctccgtggagaacacctggaagagaggaataccctctaagaaaaacagagaaggcaccagaccacaactggatacgtgctccactccaagcccccaatccgaggctgagaacacgcaccccaaatcatcgtgaacacaattagcccccactcgccctgtgtatgacaacccactgggtgacggctgagacaaaggagccatactcaccagaggctgagacatccaagtgggacagtgataggaaaacttattgcgctcccttgaataaacttgctggcatttttgaatcgagacagctctcactgtgagactgtagtgcgtttgctcgcctaatatcgtgcaccaactcctcgaaacattcgtggtagccattgttggacccacatcctttatagcacgtgcaccacaagagtgagagttgacacaacaccgatccccacaacagcaacatgcacacgtgatacataaggaaccaattatgtgaaatagtgtgagaatcacaaattacccaaacaaactacagaacaacattaagcaaggaaaccaattttaatacataggcaacctattaaaatgcatatttgatgctccaactagaacctaccattacatg

SEQ ID NO: 561681 - DNA, 164 bp, Homo sapiens
ctaggccccagtttgaggctcccctgggaactagagccaggaacagccagtggcactgacaatgtgacggagtccaaggcgttattgggccacctgacagctggacagaaaatttgcatacacacctattatgctatttaaaataaatgcatatttttacttgt

SEQ ID NO: 561682 - DNA, 209 bp, Homo sapiens
gaaaatagcccattttgaggaacaagagggtgacatgaagcgttcctacacttacttacgggtactttaaggagcctggaatttaagacagatgcctcaggcagcagattcttgcagcgatttcttaacttaccgcaggcaagggacgcgagaacaaattttacaggaaaccatttacaactttaaccttttcctttagagcagttcca

SEQ ID NO: 561683 - DNA, 187 bp, Homo sapiens
ctgtttttcacccaaacataggcctaacgacaaatatccattgtatctggccccatcaaatgatccaacttgaaaccccctaatgcatcaatgaaaacctctttgcaaaaaactttgagctactttcttttgagcaatctaactgtacctagctctatttgaatttgacagaccagatcatatgtcc

SEQ ID NO: 561684 - DNA, 155 bp, Homo sapiens
agagttcccttccatcctaaccccaataacctccagttccctcctccccccctcagaaaaccaaagtttagatcctggctgaaagcaaatttacggccctgaggtagaatagaaacagtctgatcaggaagcagtaggaagtagaatagagaggt

SEQ ID NO: 561685 - DNA, 213 bp, Homo sapiens
tgctgatgtgatctaaggatccctgaagaacacttgcacacgtctgctggccaactggctcaaggccgttcccagggactgggcctgaatatgaattgcgtcgtcagcagtaggccgacggcagtgcggcgctgacggccagtgccagggcgaggggtgcccaacgggatgatttattgtttttcacggcgagttttttcacgtcgaacggag

SEQ ID NO: 561686 - DNA, 176 bp, Homo sapiens
  misc_feature (23)..(23): n is a, c, g, or t
  misc_feature (45)..(45): n is a, c, g, or t
  misc_feature (47)..(47): n is a, c, g, or t
  misc_feature (54)..(55): n is a, c, g, or t
tatgccgggattttcttaagatntacaccaaatgagccgaatacnantgcactnnaatagagttcgatcaactggacaggaatggcattcttggaccattcgacaatgcagtccaggcagaagtaatgtgcacagttctccggcgtccccagcggcataatggtggggggtgatcc

SEQ ID NO: 561687 - DNA, 1555 bp, Homo sapiens
tatttgatgttcccaaattttaaaaagtcaggattcttacatcaataaagtaccctggtgctcaaccacaaaaaaaaaaaaaaaaaaaaaaaaacaaaaaaaaacaaaaaagagggggggcgcgcgacgcctagacgaggtatctctccccgagcgggggcagcacagacggatacgcggacgcaccacgtcatagttagtagaacgaagggggcgccccatatagcgagagcgcgcacgtacatatatatcacataaccgacagacggcgcagcgaggcgcagcgcgaagtatatatacaacacacgtcgcagagagagagcagggcaagaacaacagagagcagtaaacaacaacacagaagaggcaatctactttgaagaagaaagagagaactcatcaatcactagccacgcgagcgaggagcaaacacataaacggcgaggccaacagaaccaaaaatctaccaagacagacaaacatttaaaagaaagcacatacacagaagagcagacacaacctaaccaaagaaacatctaaacaaaaggagggaatatatagctgtggagtaataacaaaaaacaaacaacagcaaaataaaaaaaacaagaagaagagcacgaagacagaacacaaaagacaaaacccggagcacaaatacaacaacaagtagacaggaaacaaccgtgtaatataaccgaagcaggacgacccaccagcacgacaataaacacagcgacacgacggaagcactccagagaacaacgacggagcacacaaggaacacacgaagaaaacaacaaacaaagaagaggaagaacacagccgacagacacgacagagcacacaacccgccgcctgagacgaaaaagaagaagaaaagaacggagagagacagcagagagagagaagaaagagagaaagagacagaagaaaagagaaaaaaacaaacgaaggctagaaacagaaaaggaaatgaggaagagacatgcgaaaagacaacaagaatagaaaagaaaagagaacagacgaggcgaaaaagaacaagaaagcaggagaaagagcgcgaaagaagaagacactagaagcaagaacacgggcaggcgtgcggagatagaacggggaaagaaaaaggacggtagagggggcagagcggacgtgaacgaggaggataagagagcattagagcggcgtgagaaaggctaaacagaaagcgagcgagacacggaggacgacaagaggaaagaggcaaagataagagaaaaggcgaaaggcggacctgcggagagatgcggacacgtaccagcgataccgacggaggagagagagaaacgaggaacgcacggtcacggcgaggagaagaagagaacgagatagtaggcgaaggagaggaggtacgcctaggacgagagagtcggaggaggaccggaaaggagaacggaagggcgaagaaaagcgaaagagagagagcggcaagaagagaggaggggtgacgagggagacagaaacgcgcaaagaagaaaagcgaagcagagagttgagcagaggacgaatg

SEQ ID NO: 561688 - DNA, 717 bp, Homo sapiens
agctgcgagcgagtcgatggaccctcgcgcctggtgtgcctcagccatggggcttcactgctggcgcccagtgctggggtgcttcgtgggctcccgctttgtccacgagggagggtctccgctggtacgccggaactagcatagagccctcgtgtgtcacccgtccacagatgtagtgctgggcctgtctggggcactgctcatactcagccatggtatttacgggtcctatcctggtgtctggtaaatcaggcgtgggaggtttgtcacattagaagggctggtggcttcccacgtgaggacctcttacacatgggaccatgatggccctgtagactgggcatggacaccctcgatactttctcttcggttcgcctcgaccaacatggtgctgggcctgtggtggatctcactgctggtcagatggggcggcggtcggcattatcgtggtctggtagcatgtgatgcccgctggccggccgcctggctctatccctatctggtctggctggccttccgggaacatagtcaagtattcgcgtattggcgaggataaccatggtttggggcattgtgaggggacgagtgtgttgccatatgtagatgtgtccgggccaacatgggcatgtgctgactagaacgcagtgaggtgccaatcacgcttgtggaatgttgggtggcccgtcacgggctttcaatgaacatttggggtcttga

SEQ ID NO: 561689 - DNA, 127 bp, Homo sapiens
cccccccagtttttggggtcaggaaaaaaccctattttaggttgtgttttgtttttgtataggagcccccggcagggctaggaacagtttttaaataaaaggccccaggtcatgttcaattttttca

SEQ ID NO: 561690 - DNA, 522 bp, Homo sapiens
agacagttgaccgtttcctttgctgtgcaggaactttttaacttgttaaaaacaggagctttttttcactgctttttttctgcattgctaatgcaggagctttaaccatttgtccactttttgctttggttgcctgtgcttgtgggaattactcaagaaacctttgcccagtccaacgtcctagaaagtttccccagtgttttcacagtttcatagtttgaggtcttaaagtctttaatccattttgatttgatatttgcatatggcaataaatgggagtctagtttcattcttctgcatatggataaccagttttcccagcaccatttattgaagagactgtcctttcctcagtatatgttcttggtacgtttgtcaaaaatgtgttcactgtggatgtatgaatttatttctgggctctctattctgttccattgttctgtgtctgtttttatgccagtaccacgccgtttgggttagtatagctctgtagtataatgtgaagtcagaaaatgtgattcc

SEQ ID NO: 561691 - DNA, 1745 bp, Homo sapiens
  misc_feature (1296)..(1296): n is a, c, g, or t
ttctcctctcggccccttgatttattttcggcggctttaatgtgagctacgcgctccttgtggggggtcaaaaattttctgcgtagcactccaaggggtgactctcaccacatcacctaattgcgagcggggttagtcaacgagagaagagcaaagtcgcgcctcctgtcgttagtaatattgggcgcgcggcgcaactataaaagggggggtcgccactaactagagagagaagagtgggggtgtaggtaaagcacaacagttgtttgtttttagaaaaaatagacgtttggtggagtagtaagaataattggtagaaagcgcacgccaccccctcgttgattgtggtgtgtttccgtcacaatatatatgaagatgaatagtttagtgttggtgggtggaatgaaacaccgtccctttgtgggtctatcccacggggggccgctcttcactggtgatccccccctatatttcgtcgcattatagacttggatagggggtgtcttcccataacaaggaggtcctcagtttcgtgttgtggtgttattagagtatggagagtattcttgtttttagtgtgtgatgttgttcgcctacacagatcattgttgggtgaggtgagaggtgtcgcctcgcatttgttttgtgggaggagaatgatgttctcctactctcctgctgtgtaggtgttattcttcttgttacgtagaggatgtttgtctctacacgaggggggtggttgtgtaattagctctgtctgcttctcttcgtgcctgtgagaaaacatttcttctctcctagtgcgagccgccataggggaggatggtgtgttatactactctcgtcggggcgcatcgccaaaaaagatgatgtgtgtggtttcctgcacagcggggcgccgtctccacgatgatataattgtcgcgcgccgacacgccctactattgttgttgtggtgagacagcgcttctcctctctgctttgtggagtagtgtcttcttcagagagtttctctacgcgcagtagtggtgttgtgtcgacttctgtgtgctgtttcctgtgctctgctgtgtgctctgttgtgttgtgttgtgtgtgtggtgttgttatctgtatgatgatacactactccctcttccactctctctagagatatgtctcgcgtgagagatctcttctctctgtagatagtgtctcttccctctccacacacacgagcgggctctcgctcccacatactctctcgcgcgagagagagagagagatagtagtgtgagagtatctctactgtgctcnctcagagagagagggtcaacacagcccacacatagagactctgttataatgaaagagtggcgtccacataacaatatgtgaggtctctcaccgcacacccactgtgtgtgtaaagacacacataagagaaaagagagggtgccccactatgttttttaactcctctctctccactaaagatattttctgtgtttgagaaaagatataaaaagacgttgatgaaaacccccaatgtttgataatgtgggaagactctcatgggaacgttctcatgggtggagacgaccacatgaagtttgtgtggaaagaccccctgggggcaccaaacacacggggggttaaatgttgtacaggaggcgggggggaaatgtgcaccccccccccccgaaattttttttaagagtccgacattcccaaaaggggcccaaaaaaaaagggtatttttggta

SEQ ID NO: 561692 - DNA, 428 bp, Homo sapiens
  misc_feature (406)..(406): n is a, c, g, or t
  misc_feature (420)..(420): n is a, c, g, or t
tctttttcggcttttttttcatttctcctttttatatttttattctgtatgtataacatacatgcctatatattttatatgctgagagtaacccatttataaattaagagcacattatattcaataagttataagagggctggtcttaagtggactactatgtatataaattgggggagggcaagctgtatacatttttgggcaacggttatgcatattatttaccagaagaaaattttcttataaaatcaaacatttgaaacttaagtatgtattcagtcaattaaaatgtactatattgtaatttcaactatatttcttatactctaccatttaattatctcagctggaagaaaagcaactgtggcatgtaacagtaaatactcttctcaaacatgattctagnccaaataaaatttntcctttga

SEQ ID NO: 561693 - DNA, 101 bp, Homo sapiens
aatgatagtctctaattgaaagaacagagaaggaggagataaagggctcaatgataaataatggctccctaattggggaggtggaagggcctggaacagtg

SEQ ID NO: 561694 - DNA, 619 bp, Homo sapiens
agcaggctgtacggcccaatgctttagatggcttgcacggaaggcgtccatgacttgacatcttaagatgcgtcttgtcccctgcggccagtcattccccctctctgagcctcggttgtcttcaacctgtgaaatgggatcataatcactgccttacctccctcacggttgttgtgagcgactgagtgtgtggacagttttgtcatacaactttggcatgctagatgtactctagggtggtgtgcccaggtgtcgtttctatggcgagccttccgagtacccgagctcgcccgacccattctccctcttccttatgcccgggcgacgcgcgaactgtctcaatgagtatcgacacggctccttcgccctctgtgctcctggtcatgttccgattattggggacgccccagcagacatacactggatacggcaggcaggacggctgagtttggggtattgatatcccccgagtcccaccctgctagcatctaaggttgctatgtgactctcctgcctgggcaactcttgctgtacctcatgagcgtatctctaggattctggcaccgacgttccttccctgtgccccttagagcctagctgtgtatcggtgccccagccc

SEQ ID NO: 561695 - DNA, 412 bp, Homo sapiens
  misc_feature (189)..(189): n is a, c, g, or t
  misc_feature (367)..(367): n is a, c, g, or t
  misc_feature (409)..(409): n is a, c, g, or t
acagcggcacgatggataccaacccgtctctcaagaataccccaaaaattaagtttttctttttccaaggtgcccacgccacccctatgtcacgcctgaagtagttattgagaaagtcgtccctttccccttttctataaccaaatagacaggaatggaagattctcctcggggcctgaaagcttgcgngatgaataactcctcctcctcaggcccagtcccaaggtacaaacttgcaccagcaggcaagataggcagaggcaggaagagagctgggctgggaaggacacgttaccccctggaaggttcaagaggggaggtcgccctgggtactacataggcagttcacgtttaggcttggggacanttcctgtttttacagagggattttttaaaacccctggccccntcc

SEQ ID NO: 561696 - DNA, 1197 bp, Homo sapiens
gatttccagtatttaagagagaatcatcatcaatggcaccgataggtaactcagtggctgtgaccagttcgactgtctgccactggctgttcccatgagttcagctgtgacgttgcgcttcagtggctccagaccgaatttctcaccatctgatcggggggctccatatcggtacctggggactgggtctgagtagggtggcacgacgttcatggtctgtccttgcctagccagatttccgtcgcttctgtactgtacgttcttgcacgatgaggcgtagtgatacaacgttgctgctgatgtagagttctattactatggatagagcgagattgtacatcatctaggctaccatgtcatgctattgccttgtagcatagtacgtgaggtaagtaggacttcttcgcttgttccgccggatccggaagctatccgacacgacatacaactgagtctgaccccgtcgtacgaatgagaacgcgtgtgtggagatggttatcacgccctcagtagtagagaccacatggccgtggttggtttcattcttagtgtaacccccgtcaatctgcttggtacaatcctagttggtcccagttgtagtgtctacacgttcgtagccgcatgtgaggctgttgggccgttccgcacggatccctaacgggttaaggggagctccggaatttcatcgacatatcgaagccgcattgaaccacttctacgtgacaccgacatttgcttaggtaaacgacccggaaagtaccccgaatgcaacccaaccgattcaaggaggccgttagcttgcctgtgggtcatctgtgcgccaaaatcggggtgggtggagttcccttaccacattgggcgttatcaacattgtgcattgccgggtacctttacagaggcaccccgttgcgcttctcaacacctcggtgagtgtatagatatgactagactacagggggaggaaagccaaggcggcagatccacagagctgtgcaaatgggtcacaccagttaagaggcattgcaaggagacatgcgccattggtccccaactactaccattgggtgtgggaaacgacgggccttggcatgttgtctaaatcagcatttccccacacaggtaagtcccggctacagtcggcgcacgggcgcaggagcacaagtgatgtccatgacggtaagtgagcggcttcgcgca

SEQ ID NO: 561697 - DNA, 125 bp, Homo sapiens
cccacccgggacttccagttcttctacctgccctacttcgagaagtgatcgcggcgcagcgtggccccttgcgccatgggggcgcccctcttgccctgttccgttcccctcatcccgtgggaagt

SEQ ID NO: 561698 - DNA, 231 bp, Homo sapiens
agccgctgactcatcaacgccgctgatgatcaacgcgtcggatgggttcagatccccgaatctagtgcggagattggcgcggaggggtcatgtgcggtacgcgacgtccggaaagcgaggaccgggagagttctcttactggtgaggcagggagcctggatgtgtgtctgccgcgagagaggggcccgtgccttggaaagcgtcgcggcccgggcggcgttggatggcagt

SEQ ID NO: 561699 - DNA, 1749 bp, Homo sapiens
  misc_feature (37)..(37): n is a, c, g, or t
agtgctgctcgtacctgcgtgactaccgttggctgtncgtccctgtgcacgtgggggtcccgccatttctgtggtaggttgcgctgtggtgatggcgcgggggtgtctgcttctggggttgacgggttgcacgatggtgttgttcccccgcccgctctgtgtgtgtgcccgaccgttcgttctacccgccgtgggtttttgatggagtattgttcatgggcccttttcggatgtgctctatcagcgggctattttcgagagggtgatagtcggtggtctcttcgctagggtttcacaggaggggttcccccggctgccacgaccgctggtgtgtaccacgaggctgttctgtgtatcatatgccgtgttggggaactgattgtgtttttgtccccgccggcgctaagccccagagagatgccttgttgttcccgccgggcctctcccttggggacaaccattaggcgcccagtttgtccccggtgatgttcccctgttcgccctgatggcaatctttttttgagacctcctctggtgaaagcgtttgatgaagacaggaatttcttggttgcccaccatgagggggtgcctccccgtggggcggttccagaactacgcgctgttcgcttgggtgtctccaagggaacacaattatctggttaggttggttctgataaaatcttcgcggtttttaaaaggagattttggggcgggcacccaccgatagtgattgttatcggaacctgggcatgccgcagagggttcgaccgccctatgtctcccacgggccccatcgcgccaattgtggcacccaagcacattgtgtccccccccgctgtgggccttttgcgctcacgctggggcactttgttgggacacgccgtgttataagtgcgccacctgaagcccccaggcccacaacactacgtggggcgcccctactatcatgggctcgcccgcgccctatgtctgtttggaaaagcctttgccttggggcggccctcccactctgtggcacagggctcttctctctgggatatctctctctgggttacacaagagattcggaacctctctgtgcgctctggcacccggttatatctcagagcccaggcgctctcagaacgctcacgtataatgtttaaagaggcgccaagagagatcccataacactttgtggcgcccccagagtatagattacgcccccacgagcgttgtaagaagaagacactctccggttctccgggcgcacagagtgtagaatatatccctggggggtgtgcccctcccacccctcgtgcctcagaggagatatttaccgcagtagcctctctctctcgtggggttacctgtaagaatctcttctgtgcgtgttctcttccgctcttctgcctttaacccacgcgggagagtgttctctcaagagagagcatagagttgactcttcttctcctcgctttgttcttatagtgtgcacctgtggggattttctgaacttgaggcaccacttcttctccacgccacgcccctgccttgctttgtaaataattaagtgcccctgaagctggaactggggaaagggggaacaagggtcacgttctgtcgggcggggcccgaaatccaatcagccccaggatataaattaggattaattacctaatagagcaatcctaactatatcaccccaagggataccactataaatgtaataaaatttaatgtctagaagtttaccaaaaagaaaaaaaa

SEQ ID NO: 561700 - DNA, 428 bp, Homo sapiens
caggaccagtcttaaactcatggcctcaggtgatcctcccatcttagcctcccaatttgttgcagttacaggtaagagccaccacgcacagcccagcactttcaatttccttcaagaactttacctttgcattcacaatgtgactaagtgtttagcacaagagacctagccttcagccagtcttgcattttgacatgccttcctcactaagctcaatcatttctagcttttgatttaaagtgagacatgcgactcctccttactcttgaacactcagaggccactggagggttattattggtgtaacttgaatatttttgtgtcttaggagatgggggggccgaacagagggagagagactggaaaacagccagttggtggagcagtcagaacacacgtcacacttatcaattaagactggtcctgga

SEQ ID NO: 561701 - DNA, 111 bp, Homo sapiens
agagggggttttcctcctgttgccccggggggggggcaatgggggttttttgggtcattgcccccccccccttctggggtcaagggattttcctgcctttggtccctttta

SEQ ID NO: 561702 - DNA, 920 bp, Homo sapiens
cgttggactcgagcgaacaagcatcgttaaagtcgtcatcttcatcgcctgccgtcatgtcatagagtcagagatctaccttaaagagcccggaacagctgagtgaagctctttcatatggatgggttgagtctttgtaaatcattcctgatagagatgcctgatggagccaatttgtagagacgatggggaacgctcacagtgactgtgtggctaatgtattagatccaacacacacagagccgcgtccagcgggactttgggttaagctcacaagtaatgccaactggtgcgcagtgagggtggctgcatggctatgaaaatgcaaggtcacacaagagttggatggcatcagtattgctggaaccaaaagtagagcttggtctcccacgaacaaggaattcgtcacatacgaactcgaggatgcaccgacattatgcttggtgagcacacaggattacttggggtccggtgtggcatttaacatgatagaggactgtcgcaagagacctctcactctcaagagtatctagtttgtccgaaccacttatgagtaatagaaattgtcaagtgcattggaaatcaatgtactgtacccgcagggcagttgggcgatggacaacacgtgggtcgttatgccttctagtaacctctagtatggacactatgtacatctcgatggtagtcaagatttgtccattccctgaaagtacccatatcgtgtagaactggcgcacacccctgttcgaagtttaagaattgacgccctgtctaacgcacatgagattgggctgaagtgtgttccatcccaaggcaagtgatgtcggaaagtggttctaggaaaacttatggtggagggtcgtggaaaggtgggttacgggggggcaattgattacttccgtcctggggagggaagaact

SEQ ID NO: 561703 - DNA, 252 bp, Homo sapiens
atccatatagttcatatggagcagaatgaacatactatatctgtctctgtactgatggaatcgtgtccagattgtgtacatctatctctagaggcctgttaagtgcatctgagttgctaaactccttattagcgccactccatatgtgtcctgggtttagctcctgcttgtaggattagtcacgagataacccgggtctgctcgtgatgcctttttccaaatccttggtatcagatatatggctattaattg

SEQ ID NO: 561704 - DNA, 489 bp, Homo sapiens
  misc_feature (68)..(68): n is a, c, g, or t
cccaaatatttgggtaccgtcttccccagtgaagttgacacaaaattaaccatcacagctgccttccntgggcctcatgttatatgagaacagtattgggtgtacacttaaagcgttctgggaatatgaatcccttctgcaccctggaatcaccagtccagccatgcatggagctggggaaagcaggccctgaattgtctagagagacttggtggaggaggccacggcccgccttgtccctgccgggtcccggccaggtgtgtgtgtgccccagctcgactctcggtggtctccaggctgcagcagaaggaataccttggtatttgtttcattttagtgtccatccttaccctcctggtctggtagagcctatggttattcttggattccacatacatgaaaagcgaagatttttctttgtttttatgcttaagctaaccccaattctgctttcccacaaaataaacctaatgccatcaggcaaaacaa

SEQ ID NO: 561705 - DNA, 362 bp, Homo sapiens
agaccaagtagaacaggacttgaatcttaccaccaccacttactcagatgtgattctagaaagttcatccttattgataatacgaggtgccattgactgagtgatcgtggtgatccaggcatgcttcatcctttacctctaactcttataattgctcctcaatgtagctatttcttttttcttttttgctttttaagggccgcacccatggcatatggaggttcccaggctaagggttgaattggagctgctgcctccggcttatgccacagccacagcaatgtgggatccaagccgtgtctgcgacctataccacagctcacagcaatatcggatccttaacccactgagcaaggcaaggg

SEQ ID NO: 561706 - DNA, 293 bp, Homo sapiens
cacaagctctgtggtggcatcagccagctgctgccgccagcgtgcatcacaagcccaaatccagcatgcagcaaggctggctggttgccaggcccagcaagccgtgtgtgtcagtgtcaagcacaggcacagcaaggcttgcttgtttgtgttgttcaagcaagccagcaagcaagcctcgtgtgttgggcaacacacaggccagccagctcacacaagcaacaccagccccgtgcaacacagcaggcctgctcacatccagtgtgtcggggggtacctgcagctctgacatt

SEQ ID NO: 561707 - DNA, 189 bp, Homo sapiens
agcaatggttgctgcccttttaaggtgtcatccaccgtcatgatttcaaaaatggtatcgttataataatccaaaccacgcaccattgtcggatcaacttcaaatgggatatcaagcgcagtcaacagtgcttggggtttttccccagtgtgcttttgcatcatcagaaagataatccaaaattactgg

SEQ ID NO: 561708 - DNA, 153 bp, Homo sapiens
gctgggactacgtgtgtgcgccaccatgcccagctaatttttttgtagtgtttgtagagacgggatttcaacttttattgccccagggctggatcttcaaacctttccgggcttcaaggtgatctttcctgcccttcggccttttaaaaggtt

SEQ ID NO: 561709 - DNA, 486 bp, Homo sapiens
agtggggcatgcttatagctcactgcagctcaacctcttgggctcaagctatccttccatctcagcctccctagtagctgaggcaggaaaatcacttgaacccgggaggcagaggttgtggtgagccgagatcgcaccattgcattctaacctgggcaacaagagtgaaactctgtctcaaaaaaaaaaaaaaaaaaaatcaaatttggtatcaaaagtcaccgtgtggtaggaaagataccttttcttcttttccataagggtgcatagtcttggataagggactcagtatcctgaagggcagcttttactagttaaaaacaccaccaagacacacttaccaggacaggacaggtaagtaaaggaagtcgggcattaaaaagatcctcgtgccccttttcttttttcctcggccaggtggagtcaccatgtaagggaacagggccggatccggtcatttccacctttgggtttggaaagggtcgc

SEQ ID NO: 561710 - DNA, 262 bp, Homo sapiens
ggtgactctaaggatccctttagcacgaatgtacattgtttacgtgatatgtggtgtaagcgccaccggatgcagttgggcccacttgcgtgcaacttgatgggcgcttcacaggctatcggaccgctgttgagcaagtatgcctggtcgctgcaggtgtggtggcaccgacgatcgacaagatccagttgcgcgcggttgttcaaacccaggccagggttgatcaccggtgtgcatctgttgggcaatggcgtcgcgtacg

SEQ ID NO: 561711 - DNA, 346 bp, Homo sapiens
  misc_feature (10)..(10): n is a, c, g, or t
  misc_feature (156)..(156): n is a, c, g, or t
  misc_feature (184)..(184): n is a, c, g, or t
  misc_feature (289)..(289): n is a, c, g, or t
  misc_feature (333)..(333): n is a, c, g, or t
tggcgagtantaagtttattaggacttacacacagggcactcagcaagacagctcgagagatccagcctcccccaatgtctaaactgcttttcagttaattttctggctctttgtctactatatatgagcaacgagacttttacttggttggttcncagatactctccaggatgtttggattcncagagacacctggtcctcagctgggcaccatggaaatggctcattacccggccttcagggttcaagcaggggacatgcacccttaaataacctaaaggggacctntcacactacaaccaccaccaccatcatcaagaagccactggctnactcagatacacc

SEQ ID NO: 561712 - DNA, 389 bp, Homo sapiens
aatcttcgtcccatcagcctccaagtagctgggtctatgggcacatgccaccacatcccgctactttttatagtttttgtagagataggattttaccatgtagcccaggctggtcttgaactcctgagctcaagtgatccacctgcttcagcctcctgagtagctgggattataggtgcccgccaccatgcctggctaatttttttttttttaaatactgatgccatctggcgtcccatcagggaaaatcaaatcaaaatcatcacgatatactacttcacggtcattagtagtgcctatattaaaaaagggttaaagaaaaagaaggtgtggtcaaggatgtggggtaagtggaaccattatacatggctgagtgggagcaagatgcg

SEQ ID NO: 561713 - DNA, 1662 bp, Homo sapiens
tcgtgcggtgctggtatgttcggtggtgtctggtggaatacttgcgcgggagtgacgttgtcgtgggttcttattgtcgctttgttcgtttgcggcagcagggtgggtcgggtgtgttacgcctgtgcgtcgtgggctcgttgctcggtactttggggtgtcgtggctgcttggtctgtcgtcgtattgtccccttgtcttctatcggctgctcgctgcgtggtgcgtctggatcgtgggccgttcgtggtgctgctgtcgtgttctcttgccccgggataggtgacctcttgttgtgtcttggtgctgccgtgtatgtgtcgagttggggttgtcttcggtatggtgcgttagtgtctcggtcttcgtaggggcgggggcttgtttcttcgggtagtccgtgtgggctgagttgctgttgcctcgtgtgcgttagccactccagtgcctgacgatgtggtgcgcctggtgcggattggggtgtgtgccatgtgtgattggtcgggctgagtggtcggtgccgctactgctgtgtgtgtccgtgccggtattatgtgcgtgtgtgttgtcttgaacgtacggtcgcggtttcgggtcacgacgctgtggtctctaaggttggttcggatccctctggttggggccggtttggtgtcatgctcaggttccgatgctggtagcgccgctcttgtgctgtgtggatgtgcgttgcggtgtttgcgttgggggccccacgttgtggcgtgggtccgttgtcagttagggtgccacgggtggtcgggagctttgctccacaatgctgtggcgtttggcgctaggtgtgttccgtgtggtcgaggagtgcgcgtcctgcgtgcctcatcgcttgggtttgatggtcttgtgctgagctcgcgggatagtgaaggtgtctgtgattgaagcgtgccgacggtagcttgcttggtaggtagccctgtgtgttagtgcgtatacgtcgtgtgactagcctgcgttcttggggctgcctgggggtgaacgagtttgggcgtataggtactgcccaagttggtgagttcggcttggggaaggttcctatcttgaggggttcgggtgctttcggcctctgtgcgacgtctatggtagttggtctgttgaagtggcgcatgggcctgcggatatgatgaagatcctctgtgttcgggtatatctgtgatggatgccagcgggaccactgttggtgggcctggtgagagtgtatctatgttcgcgattggtggactcatgcatgcatgggctgtgtctttccgcacgcaagtaatgatggactgcatatatagcataagcgatgtatctgccaagcaagagtctggtgattttgaaggtatgtgctagtacgagtgtctctctgttagctaggtttctgacgttaggttatctacgttacctaatcgctgcagtcctgcacgtcaccgtatactatgtatttaaatgtatgttaactgtctgagaatgcgctacccaccaatgaatgaaatagacctttatgaaaactgtgcaatgtgtgtgcatgtttgtttttatgttcacttgtagaagacattgacagttaccattgaatgagatggatcagtggatattcaagatgaggttacaaattgttgtaagttcagccattatgag

SEQ ID NO: 561714 - DNA, 154 bp, Homo sapiens
cggaagaaatacctaggaatacagttacgcagggcgatgaaggatatctacaaggagaattggaaaacacggctcaaggaaatcagagatggccgggtacagtggctcaggccggtaatcccagcacttgggagaggctggggcgtgcaggtgg

SEQ ID NO: 561715 - DNA, 159 bp, Homo sapiens
aaaaaacaaaacaaaacaaaaaacagaagtttaggtaatcggataagaaaactttcgtcgtcctcctcctcctcctcttcttcttcctcctctttcttcttcactaacttcttctccttctctttctctttttccttctctttctctttctcctcctgg

SEQ ID NO: 561716 - DNA, 339 bp, Homo sapiens
ggcaaaaagaggaacgctgtgattacctaaagaatacactttctcacagtaagcaaagaattcaagaatgtgataaagtaatgaattgggatgtacaaggttatcttaacgcttatttgaaaccactttatttttttattttattttattttttcgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtt

SEQ ID NO: 561717 - DNA, 203 bp, Homo sapiens
gactctacaggatcttaccctggtgcgtcattaactggtactaagttggcaaaagagaggtagtagcagtgaataggagaaacagactaatctaacaattggataagtagccctagaataacgaagaaggcctaattaaaacttcaaaagccttataacaggtgattctaaccagtcataaaactgtcacctccctggatggt

SEQ ID NO: 561718 - DNA, 198 bp, Homo sapiens
aaattaaaaaaaaaaaaaaaggggccgaatttaagttgggggggaatttttaaaaaaaaaggaaaaaaaccccttttccttagggcttagggcccagtttgctttaaagggattaaaaatttgcttccaaatttaaaatttccggtttgggtctcctgcgggagtttgcaattgtggaaaaattaaaatcaatcttgg

SEQ ID NO: 561719 - DNA, 159 bp, Homo sapiens
  misc_feature (1)..(1): n is a, c, g, or t
nccccccccccttttttcttacccaaaagtccatttcttcccaaagagtattggactgggaatttcccccccttgccccactgacaagggttatggaagtgtctagatgccctaaaagggcttggggctaagcctcagcttgtgggcagggcgccgaac

SEQ ID NO: 561720 - DNA, 198 bp, Homo sapiens
ccccgactagcttaacaggcctgaacagtgaggggcctgtccctgttgctggcctgccgaaggcagctatgagtgctgcggtcctgactggacaacaccagtgtccagtgaagcgtgggaatccatcaaacgccaggatgtagctcagtgtgcatggggtgctgcttgtcgggctagtctggggggtgtactgatgct

SEQ ID NO: 561721 - DNA, 754 bp, Homo sapiens
agcgggaaagaccgacgcgatgaagcccagacctgcagggttcgtggataataaactcaagacagcgagtcatccagtatagactatggtcgagagaagaaagaaatgcttgtaggattcaggtagaaaagtatttagcataattagtagtgagaaggaacttaagaagtttaacagaattagagagatgaacatttggcaaaaagggcgagacaaggtgaagaggataatgagtatactgaaagctattctgatgatgattcaagtatggaagactacccagatccacgagtcagcaaatctactagtgaacatgttccctgcgtgtcttgtatatcggagaaggataatcctgatgtctgtttcaagatactcctgagatggagcaaagagaaaccacgctcttcaatcacgcactgaataagttccacaaatcaggctccattcccttgaagacccctgccaaagattctgaaggaggatggtgtatggactagaaagcccaagtgtagaagaacagacagtttgtccttggacctgtcatgtgagaaaagtaatcctaaggaagccaatacactgtagatacaggattcaaaagattcttctctatcggagagtgactatgaaacggaaaggcaaggctagagcaatacaggaagcgaacaggacgcacagaagatcttcaggaagtagatggagcaaattgaagctgtcctaccacagagagctaaagccggggggtagaatgccagga

SEQ ID NO: 561722 - DNA, 193 bp, Homo sapiens
tagcccgagagatgataggatgttacatgtggtgtatgatcggggtagtccgagtaacgtcggggcattcggatagggcgagaaagtgtagtggaaagaaagttagattacgcggatgaatatgatagtgaaatggatttaggcgtaagtgtggtctagggtgtagcctgagctgtcggggtaatcgggggga

SEQ ID NO: 561723 - DNA, 174 bp, Homo sapiens
gcacagctctgagatggaaagcacagattaaactgaaaatttcaacaacctcacagagcaggtcaggatagcatctagcgagtgagcgctcagacatagtagtgggtgctcaggcagcagtcaacgtcatcactgctggcattcccatcactcccccaatgcccacatggcggc

SEQ ID NO: 561724 - DNA, 163 bp, Homo sapiens
  misc_feature (5)..(5): n is a, c, g, or t
agtantgagatggctggctggagtttgggttgcattttctggtgtacccggatgctgaagacttcctggcggtgcctcctccccaacgttctgatcttgcactcaacaggcaaacatggtactgcaatatcactgctttattcaggtgagctcgcttgcactg

SEQ ID NO: 561725 - DNA, 722 bp, Homo sapiens
gcagccaaggcaggtggaagtagagctttgtcccggcagagcgggctctctggccgacaggtagcgcgtggttccgtcgccgacgcaaccaggaccggcccagtctcctacaagaagttccgagaagccagctggagattcacattttacctgcatgcgcttgcattgccggtcactggccgttcaattgtggataagccctggttctatgtacatgaagaaccggttgggagggatatccccgatacagagcactatcccttcccaggtatggggactacatgagttgaaggtttccttctagctggtccgctgctcttcaggcattgcctctgatgtcaagcgaaaggactttcacaggaacagatcatccaccatgtggccaccatcattctcatcagcttttcctggttgccaattacatccgagctgggactctaatcatggctctgcatgactcttccgattacctgcttggagtcagccaagatgtttaactacgcgggatggaagaacacctggaagcaagcatcttcatcgtcttcgccactgttgtttatcatcacccgactggtcatcctgcccttctggatcctgcattgaaccctggtgtacccactggagctctatcctgcttcttgggtattacttcttcaattccatgatgggagttctacagcttgcttgcatatcttctggggctacctcatttgcgcatggcc

SEQ ID NO: 561726 - DNA, 846 bp, Homo sapiens
ggcacccggaacaacaaagcaaggaagacggagtcgagcctcgggggctctagcaacgggccggggcgggagtccatggagactggggagcgcgccgtctcatcctcatccttggtcctccagcttctccttcgcatcgaagcaaccggagcaggctgccggcggtcctcagccaccgtccctcttcccacggatgtgatctccgggggaagcgctaatttttaaaacaaccccagtgggatgcagacagtgatgtcggcatgggacattctatttacaaatgtagtcggggttttgaagaaacaagagtgtcattttaacactttaagggaagatggttgcgaacggacgcaaatgtgtaattttactacaaggtgagtgtgcgggcacacggttactacggagggttaagaaaaacctagaatttacaggtctacaaattgtgggtcctcaggaaacattttattgggcacgggagcaccaaggtggaaggaaagaaggctaaaatttggggggtgccaagaacgcttttagaccggttaggtcgtgacagacaacctagagttccagggtacataatttcaccagattccagaggtgggtcaagcggtttctggcaggggtgtaacatgccattggcacaatccggtgtgcccaggacttccaccaaaggaatcgtgagagctcatggccagttaagaaccctgaaattaatcctggtgggtggtatcgggataaaattctctaggactacatcaccgctttggtcacaggacgttccagtaagggggcaatgtaagggggggcaggggggaaaattacccttggttggacggcgagaaattt

SEQ ID NO: 561727 - DNA, 143 bp, Homo sapiens
agcctatgtatccgaggattcgacctctagggacttccacagtggtaggagggctgccctttttattttttttggttgtggctgagaatgctggagatgctcagtttctctccctcacaaggtaggccacaaattcgttggtg

SEQ ID NO: 561728 - DNA, 391 bp, Homo sapiens
cagaatttaaatttcgtaaaatatgcattgcaccagaataccatttaggccaaacctaactcttcgtgaaagtgaaattggcagtattccattatagtaaaggatagggtagttagttatatgaaactttaagctattggagtccaaaatcggttttatcagtaaatgataaagtcatatatagtcagatgctaaatttaagtatatatatatttacattgaagctaaactgttaagcaaacaatgcccatttgtcggctacagctcttccggagtctagagcctgttggtgttctgtcccactttaagaatttaattgctcacttattctgaaagctttgttcaaacaagatgatattaaatttgttttccctaaactctggaaaaaaaa

SEQ ID NO: 561729 - DNA, 255 bp, Homo sapiens
atgctgatacccgatcgacctcgtacatcgtgggatcgcatccagagcttacgaagggtgatgataatggtccagtgctcgtactactggtggggctcaatgggtgcaggagctggagacagttgctagactcctctggactgtgggccagccagtaggttcaggtctccctactgatcttcccactgtaggagttagacctcatctgaggggtggcatagtggtgaaagggacgacagaagggaccgatggggc

SEQ ID NO: 561730 - DNA, 877 bp, Homo sapiens
gagagaaagggaattcctaacttctgaggcaacacctatcaaacatcaggaagccattaagagattatcattggctgtacagaaacctaaagaggtgacagtcttacactgccaggtcatcagaaagtaaaaggaaagggaaacagaatggaaccaccaagcggatattgaagccaaaagagctgcaaggcaggaccctccattaaaaatgcttatagaaggacccctagtatggggtaataccctccaggaaaccaagccccagtactcagcaggagaaatagaatggggaacctcaagagcacatagtttcctcccctcaggatggctagccacagaagaagggaacaatactttagcctgcagctagccaacggaaattacttaaaacccttcaccaaaagctttcacttaggcattgatagcacccatcagatggccaaatcattatttatgggaccaggccttttgcaaaaactatcaagcagatagtccagggactgtgaaggtgtgccaaaggaaattaatcccgtgcactggcagtccaaagttttcaagtccctggtatctttaacctccttggttacagtctgtctcttccagaaattcgaagctgtgaaggctaccaaatagttcttcacactggaggcccaggatggcgtccactgagctaaactctagcggccgaacccctgggactggcctggtagccatgtgctcccaatggtcaatgggcatccaacggacagaccttcaccagggaaatctaaaatgtgacaaggcctaatattggccccgattcacgaggaaagcagctaagaacgggccgttgtgacagctttcccaaaaggcattggagttacctagtgaaaagtgg

SEQ ID NO: 561731 - DNA, 655 bp, Homo sapiens
  misc_feature (47)..(47): n is a, c, g, or t
  misc_feature (64)..(64): n is a, c, g, or t
  misc_feature (102)..(102): n is a, c, g, or t
  misc_feature (107)..(107): n is a, c, g, or t
  misc_feature (122)..(122): n is a, c, g, or t
  misc_feature (226)..(226): n is a, c, g, or t
  misc_feature (249)..(249): n is a, c, g, or t
  misc_feature (279)..(280): n is a, c, g, or t
  misc_feature (282)..(282): n is a, c, g, or t
  misc_feature (377)..(377): n is a, c, g, or t
  misc_feature (513)..(513): n is a, c, g, or t
  misc_feature (522)..(522): n is a, c, g, or t
  misc_feature (530)..(530): n is a, c, g, or t
  misc_feature (536)..(537): n is a, c, g, or t
  misc_feature (575)..(575): n is a, c, g, or t
  misc_feature (578)..(578): n is a, c, g, or t
  misc_feature (587)..(587): n is a, c, g, or t
  misc_feature (589)..(589): n is a, c, g, or t
  misc_feature (655)..(655): n is a, c, g, or t
ggtaaactcagtgaaatcccagttctgtgttcctacagatgtttcanccataccttccataganggttctctttaggttgatgtgacaacaccaaaaaagcntaaangctaacttaatagtnagcaattatattccagacttgactaaccctaagaacgattttgaaaggtaggaagatatacagagagtttaccagatcttatgccctgtttaaaaggcgggggngtatccccaaaatatttaagacnattatatatgctgatgcaactaattaaacnnangaccacttctaccattcctcatgtaaagccttttgggctaacagggatattttctttttgtgacaggggctctgttgcccacgttagggtgcggnggccccatcttggctcactgcaacctccacctcccgggttcaagcaattctcgtgcctcagcctcccaaatagttgggtctacaggggcatgccaacatgcccagctaatttttttgtttttttttgttttttttnatagagatngggtttcncccggnnggcccggctggggtcacaactcttgtcctcttgtgttnttnctctccttngnctcccaaagtgctgggattataggcgtgagcaactgtgcccggccaacattaatattttttattan

SEQ ID NO: 561732 - DNA, 244 bp, Homo sapiens
ggcaagctatccggttcaatgcactatcaaaataccaagacattcttcacagaaatagaaaaaaaaatcttaaaattcatatggaaataagaaaagatcccaaatagccaatgtaaccttgagtaaaaagaacaaagaactggaagtatcacactacctgtcttcaaaatatactactgtagtaactaaaacagcatggctgtggtctaaaaacccacatagaccaattgaaccggatagcttg

SEQ ID NO: 561733 - DNA, 242 bp, Homo sapiens
cggcaggagggctttcagtccctcccacttttggttcagttcgtgaagcttgcccttcacatcctttgcagcaaaatgcccttcctccaccatggcattccccttttgtgtaattgctttgatgcgtggttcatgtccagcaatttttgcttgtaaggcttgatgtttctttagcagattttggaccccattgccgcatttaccaacagaggtaaggatttaattggggtccggattttgca

SEQ ID NO: 561734 - DNA, 242 bp, Homo sapiens
gaagtatacgacacgttgctgaatacttgaagcttgccaacagtgcagacaaacagcaggctgcccgcatcaagcaagtctttgaaaagaagaaccagaaatctgcccaaactatcctccagctgcaaaagaaacttgagcactaccacaggaagctcagagaggtagagcagaatgggatcccccggcagccaaaggatgtcttcagggacatgcaccagggtctgaaggatgtaggagca

SEQ ID NO: 561735 - DNA, 386 bp, Homo sapiens
tacatagcgttcacacttccattcttccattcagttccacatatccccattttgttcactgccttgtctataggactgactgagaccacctctagagtcaggtgatagagccagagcattccatcatcttcaaaagcacatgcctctcacatgagattactctgatttattgaagattaatgtcactcagtctgtccttttttccattcctgtcatgactattgataggctccaatatttctacactgcactgcatcccatgtgtaatcacatgagacgttctgacactgctgcatggctcctgtagccgtcattgcctagattcacatgtgacgcgttctcgcaagtactatggacaacagagtcagagggattccaggagccgt

SEQ ID NO: 561736 - DNA, 127 bp, Homo sapiens
tatacagtgagggcagacaggacaagaggattacccttggtggttgtagcaaccgcaaggggagacttgggctgacaggcaggagttggggctgccaagggatgacgagtcctggaaaagactgctg

SEQ ID NO: 561737 - DNA, 152 bp, Homo sapiens
  misc_feature (14)..(14): n is a, c, g, or t
  misc_feature (68)..(68): n is a, c, g, or t
  misc_feature (88)..(89): n is a, c, g, or t
  misc_feature (102)..(102): n is a, c, g, or t
atttaaacagatcngggcatgcaaccaaaagcagtttaaatgaaatattttaaaataaaatatcgggnagctatttttagattttttnnggcttatgtttanactttaggaccctcattgtttttttattaaaaaaaattatttcctgtgca

SEQ ID NO: 561738 - DNA, 4421 bp, Homo sapiens
agcgggctgtctttatccgccatgttagattcaccccacagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgc

SEQ ID NO: 561739 - DNA, 1066 bp, Homo sapiens
actttctgctagtccccccgggggttactcgttcgccccccttgtgtgcgatgttggcccctcgccgacttctctcccctgatgcgggggcgcgcgttgtggcccgtgtgggaagcttgtcgctgcgcctttcgcacttggccgccccttggtggcgtccacacggtgtgccccctgtgtggcgcccctgggtggcctatttggggcatcacggtcgtggcggttcgtagaccggcaagtggggtgcccccacagagggggggtggtttcttgtgctactgttatttaataagttgtggctagttacactctcaagctgaggactggggcgtccaccatagagagacattgccaccacagcttgagaagaaagacccaccctttatccacgcgtaagactctgttagagagagactatttggttgtaggacacaagaagatatgtgtaaacacagcgttggaggtccgctgagaggtctaacatctgggattgttgtctgtgaaaacgattgtgtgcttaaatgtgtgacagaaagagaggggcacacaggagagatatacacgcgttggcacagatatatgtagagagggaacacaaatcccacttgagaggtgtgagaccccacggcaagaactcgtggtggccccgaaacggaggagttggtaacctctgtgaataagacacctcgagaagacactctttggcggtgtgaatgtaatgcggtgggtcacgagagatggtagagaaataaacttccaacttgtgcgccacttcatcttcactcggtgttctttaataactgaaagctcagtgcagttggccttagaatatcccagcactttctttcttggtttggtgaatgctgtgtgtaataagcaatggtagaattgtcttggagacaaaatatagtgatccttgggacaactggtgtttcagtaacattcttggataacgtcacactcgatcaagaataattttttatttttaagaaagcatgaaccccgccataaaaatacatatttttgagtcttaaaaaaaataaaataaaatagaaaaaataaaaag

SEQ ID NO: 561740 - DNA, 237 bp, Homo sapiens
gcagtagcgctggtccaccatattaaatatctcccatgaaaagatgctcagcatcactaaccattaaaaaatgcaaatcaaaaccataatgagatactacttctcacccattaggaaagcttattttcctctttttttttttttttttttttggaggcagggtaccccaagtggggaaaaaggtcagggtgggggggatcctcaaaagtcgcaccgtagggcttgtgcaacgcgtgg

SEQ ID NO: 561741 - DNA, 4654 bp, Homo sapiens
agtaattgctgtaccaaggtcagaatcgccacctgaggcctgaatatcagcgtaagatagtgtccaaagcagtcttaagaagaggtcccattaccccactctttccgccctaatggaggtctccagtttagcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccaccttaagaatggtgaaataaatgttcttggaaattcc

SEQ ID NO: 561742 - DNA, 4770 bp, Homo sapiens
agtaattgctgtaccaaggtcagaatcgccacctgaggcctgaatatcagcgtaagatagtgtccaaagcagtcttaagaagaggtcccattaccccactctttccgccctaatggaggtctccagtttaaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaagcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgc

SEQ ID NO: 561743 - DNA, 409 bp, Homo sapiens
tttatttttaatctgactatggcataacattacaagacggaggcaaaaatatttaacccccaaatatatttccttgccctaccttgaacttgccctgcagagtctcttgtgaggagaatccacatcctataaagaagcccctttcccctttgttttccttcctttctttccagtccaggagatcatcaactaagagccaggcaccccttttaagtcgataagaaacagtttacaacctgctctctctctctctgaagtctgctgaggagcttcccctgcacaataaaacttggcctccacggatcctttatctttaacctggaacattcctttccattggatcccgggtctttcagcttaagctcaaacccaatttgttcaaccaggaaaatgttttaaattttacctt

SEQ ID NO: 561744 - DNA, 3151 bp, Homo sapiens
agcgggctgtctttatccgccatgttagattcaccccacagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagggtctctggggcttgctgtcattccttcatctggccaaaaaatgcttcttcctgaaagccccgagtgaagcattctcctggttctaagtacagttcattagctccccggtttcccttttctcctccttcaagtacacagataactaatctaaaatagggccttcccagtccgaaccgttggtatcaagtacacaggagtgccatagccttgaatctaattacctagtactttgaataaatctggaaagactagtatgcttgcaagatgatacaaatgtataaaataaacatttaaattat

SEQ ID NO: 561745 - DNA, 531 bp, Homo sapiens
  misc_feature (531)..(531): n is a, c, g, or t
tgaaaagggaatttcccttttgttccccaggctgaaaatgggccaattttggctaaaaaaaccctttgcctccgaaattaaaaaaatttttctgtttaaacctcccaagtggtggggataacaggcctcccccccctttcctgggtaatttttttttttttaagggagggagggggttcttcctttgtggggagggttggtttataaccccccgccctgaggggaacccctccgtctggcctccaaaagggggagaattacaagggtggaccacttcccttggtaggggggggtatataaaaagagtacttcctttttaattcgaaatgtgtggttaaaaaaaccctgttgtgcgatatcatataactgggagggcccctgttcgccaaaaataatgtttggcctacccccgttaataggagggaaaggggggatattaatatgttatttgtttgagtgtgaaaattggggaggaggggcgggcagtggaagttgtgatattttggttgtgttatcatggggcggattgan

SEQ ID NO: 561746 - DNA, 4715 bp, Homo sapiens
  misc_feature (2977)..(2979): n is a, c, g, or t
  misc_feature (2984)..(2984): n is a, c, g, or t
agcgggctgtctttatccgccatgttagattcaccccacagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatggggagaagaaaaaaaaaattttttttttttttcccccccttttggggggtttgggaaaaacccgaagggggnnnccccnattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccaccttaagaatggtgaaataaatgttcttggaaattcc

SEQ ID NO: 561747 - DNA, 123 bp, Homo sapiens
  misc_feature (16)..(16): n is a, c, g, or t
gaggatcacgatgtcncgtgggctggcttgagtcccccagatcccagaaggaagatgcagcaccttttcgggggttgtgcctaattttgtttcacaatctgagttcaaattaacggacatcgt

SEQ ID NO: 561748 - DNA, 351 bp, Homo sapiens
  misc_feature (60)..(60): n is a, c, g, or t
attgaacgaagagtttgatcctggctcaggatgaacgctgacagaatgcttacacatgcnagtcaacttgaatttgggtttttaacttagatttgggtggcggacgggtgagtaacgcgtaaagaacttgcctcacagctagggacaacatttagaaatgaatgctaatacctgatattatgattttaaggcatcttagaattatgaaagctataagcactgtgagagagctttgcgtcccattagctagttggagaggttacagctcacctaggccattattggtagccggcctgagagggtgaacggccacaaggggactgagacacggcccttactcctacgggaggc

SEQ ID NO: 561749 - DNA, 4408 bp, Homo sapiens
agcgggctgtctttatccgccatgttagattcaccccacagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggagctctccttgtgtacatcatcatggttccccaggagtggatttaccagttaccataccagaagtttcttcagtccctgatcagatcagaggaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccaccttaagaatggtgaaataaatgttcttggaaattcc

SEQ ID NO: 561750 - DNA, 254 bp, Homo sapiens
  misc_feature (60)..(60): n is a, c, g, or t
attgaacgaagagtttgatcctggctcaggatgaacgctgacagaatgcttacacatgcnagtcaacttgaatttgggtttttaacttagatttgggtggcggacgggtgagtaacgcgtaaagaacttgcctcacagctagggacaacatttagaaatgaatgctaatacctgatattatgattttaaggcatcttagaattatgaaagctataagcactgtgagacagcatatacagggccgagctcgacga

SEQ ID NO: 561751 - DNA, 2830 bp, Homo sapiens
agcgggctgtctttatccgccatgttagattcaccccacagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccaccttaagaatggtgaaataaatgttcttggaaattcc

SEQ ID NO: 561752 - DNA, 87 bp, Homo sapiens
gaatctgaggatcccccaacgatggtcctcagctgcagaacacttcactgcagctgaggaagagaaaagttcagtaactcgctggtt

SEQ ID NO: 561753 - DNA, 124 bp, Homo sapiens
cggaccgggtcgttactacggttcgcgttatgacggttggtacggggtggaacgggacaacaacactgggtaggactggggacggagtaggctggcagtagggtggtgagtggattgcttggcg

SEQ ID NO: 561754 - DNA, 107 bp, Homo sapiens
  misc_feature (15)..(15): n is a, c, g, or t
  misc_feature (49)..(49): n is a, c, g, or t
  misc_feature (98)..(98): n is a, c, g, or t
gccaaagcacatgcnggctccctggttgttcctctcaaacctgtgctgnccaaagattagtaaccagttatacccagtattttgaggttttattatgncttttaata

SEQ ID NO: 561755 - DNA, 1039 bp, Homo sapiens
  misc_feature (586)..(586): n is a, c, g, or t
ttagttcgtggaagcagtaataggttttcttcacccagagcagatggaaggacagcacaattacctattagtgctggaaggaatgatagcgatcatcagatgaaaatcccgagagatagaaagatccgtgccctagactaactgccagcttgagtcgacaaatggtcgttacaccgacgtggaaatgcaacgctggcaaggactcgtagacatacacaaatgatacacacaacatacataccgtgaagttcatcgaggccactacaggagtctcgacaagaaaccgtctgaaaatcctgtgtaactagaaacgaatatgtatcctgcgaacgttcatcacaactcacccctagcctggtgtcacgtgatggaggtaattggatgctgaagtgttagtatgcaggatatgtatgagctctgtttccagaactcaaatctatggaaggatcatgactagcgcttcagcgatgttgaggaggggcggacaagttgatttgcatgtcagcagaaagtggggcaaaggccaaatgaccaggcttgcagggaaaacttacatgctggatgagccaagatgtaccctagctgncagtgtactcctggcactgtctgcttactggcatttgctgcggggctgggaagatcatactagagacatcaggtggcaaaacgctgcgatgtgttataggctccatgattcgtgattcattacatgagcaggaagaattgactctaaccctagcatggtacgagccaaatgtaataaacgatgctggaatggaaaccctctggaatataaaaccagggcttccaggtaatctaaatgagaggagggcagtcatctgggaatggaacacacctataagggggatacccacacattcaggtccacacaaggagaggctcgggacaagcacagacaccacaaaggaggacacacagtaaacgcccaacagtacaaagacgcaagaaaaagccaagggacagagggacgcgaagaccagcgaaactggagaggaacatcaacagaacaagtgtggcc

SEQ ID NO: 561756 - DNA, 121 bp, Homo sapiens
ttcatctcctaccagagtgttgtagtcagctcctttatgtgggagatagaccagaataattctctaacacttgttgaatatcctaaaaacaagggctcccatccccccttcctgtgtatat

SEQ ID NO: 561757 - DNA, 196 bp, Homo sapiens
ccgtgatggctcccaggtgacacacccctcttcctgttacgacacttcctcagtatcacagggtacgccaactctcttcctgtcactgacacatatcctcagcatccacaggtgacaccacctctcttcctgtaccaatgcttcctcattatacacacgtcacacctgggaggacatcacacctgggaggacatca

SEQ ID NO: 561758 - DNA, 872 bp, Homo sapiens
gaggctcagctctttcaaacttcagtaaagtacctatatctagtcctgtcagaaggaacaagagcactaggtaaggaaatgattaagcccatttcctctttgcccttcccaaaatgcttaaacatctgaagggattcttaggcattattgcaatttgcaaactaggaatacccaggtacagtgagataactcgccctttataccacctcataacaagaaatgcaagcagctaaaactcagtccctgactatgggaacctggggctcaaaaaggctttaaccagttaaaacaagccttgctataaagcaccagcccttagtcttcccataggaaagacattcagtctctatgtagcaaaaaggaagagaatggacctgggagttttaactcaggctcaaggtccagctcaacagccagtaggttacctaagcaaggagcttgagtagatggctaaagtacggcaagatttgctctgagcagttacagcagtggattactggtgtcagatggcaacaagttaaccaatgaggaacgagtttaatgtatataacccaataatgcggaagaatggtgtctactaagagaagtccatggccaaaagataatcacctactcaaagatcaggatctgcatgtagaggaatctacgaggcagttaagaaaaactgtactgactgaaccaagaacattcatccagaggaaactgaagaacctgaatatgcgcttgaaccagacatggcaagctatggcacgcaagaaggacccaagaggaaagtcccctagaaaacccagaagccagaaatgcgaggaaacggcataaagttaaccacagaagactacaggacgacaggcacggatcgcaccagacgaaag

SEQ ID NO: 561759 - DNA, 437 bp, Homo sapiens
aagttacaagagaccacatccacccagggattagggttcaagtagcagctgctaacccttgcatcagcccttgtgggactcccaacacaagacaaagctcaggatgctggtgatgctaggaagatgtccctcccctcactgccccacattctcccagtgctctaccagcctcatccatcaaaccagtgaatttcttaatcttgcctcacagtgactgtcagcccaagcggcatccaccatgcatcaagttggagaaaagggtacccaatcagtagagagcgatattggagctttttgttcactcaatccttggatttttttctctccctaagagactctctttttagggggtatgggatacggacaccccacatagtgtctaaagatcctcaacttctttgattttttaaatcatcatcattactatttttaattaa

SEQ ID NO: 561760 - DNA, 783 bp, Homo sapiens
tacccattctaagtcgcgatggcattcctaatgcttatccgaaacgaacaaattctagggctatatacaactacgcaaaggccccaacgtgtggtagggcccctacgggctactacaacccttcggctgacgccagtaaaagctcgttcatactactgaagccccgcgcatcaccgctatagcctctaatctcgcctcttgggtcaagcacttgctaagccttgaggaccatcgcctattgtatatctaggccaagcttcctagtcctgagccgtattagctcacatccctcctgatcaagggatgcagcatctaaactacaaagctcacggccctggcatacgcggcgacacatgtctgagcgaggtaggcgccatagagccaattctccactcattggttgctcggactcggcaagtgcgtgacagcgcaagccaatgcggcagcactttcattggggccctatgcccacgttgatgacaaagagccggttaaaggctattctgagcgcggtaacaacacgccctgaagagacctggacccgaggccgcccaatcacactgggttggagggttccacctccgtataaattctcgcccttgcaagcatgggatgggaccgcatgcacatcagcaggtagtcactaaatccagtcgattgtaagcctccaagggaatacaaaccgcggcaaatttcgatggaccacaatttcacttcaaaaaaccgcttgacgtccccttggggtgtcacaaggataattatacaatgtgaacaaaacgccca

SEQ ID NO: 561761 - DNA, 245 bp, Homo sapiens
ctataacctaggaaacgggatattgcaggaattctcgattacacgggcggcgcagtaaaccgagatacggatttcagcactggtgctcacgatgtcgacggaacttgtacaaggcaggcatgcaccgtattggtgaatacacgtcgaccaggctccagtgttaacgatctgtggaggtcagcacggtgctcaccgtgtcgacggaacttgtccagggaaggcatgcaccgcacgtgtgaatacac

SEQ ID NO: 561762 - DNA, 244 bp, Homo sapiens
taaaaaaaaatgaggtctcattatttggcccaggttggtctcaatttccgggcctcaagtaatcctttcgcctaggcccatagtatgggaataacgggcgtgacccattgcgcccaggtttaactagtttcccatctattttaaggccccctcaagatttcttcggggggcctccatttccaccaagtcacaccttttaactcaccagtgttctctaaagtcctctcctcaagccttgcagttc

SEQ ID NO: 561763 - DNA, 192 bp, Homo sapiens
ccaaggactcaggtaggcgggctgactgaagcgatgcctttggcaatcaagacctgcaccgacccgtgtgccttgacgatgctgaacgctacggtcggggtgtcggggaccggaaaccactcgatcatgtcgttgtttcagaggggctgcccctctggtgacgcaaacacgatggttgtattgccgtcaaag

SEQ ID NO: 561764 - DNA, 402 bp, Homo sapiens
tctctcatttattcttgatcggacttcctgaatgttggattacttcactgtttttaaagaactaccttttggtttcactcatgtaatctgttttattatgtgctgttcatcttttcttttatctttatctcatacctttacttactttagttgtattctgatgttcactttctatcttcctgagttgtatgtttagatattttacagtctttcttgttttctaataatttcttttcttctgagtggccttttatctctgtcgatcagggccatggtaaatggctctatcctcatcatgaacatgcacactggtaatagttacacatgtccttaagagagcgtcaggtctttacaagaacgattttgcctttccgagttatgagatatgtgtgtgcataatct

SEQ ID NO: 561765 - DNA, 143 bp, Homo sapiens
tgtaactgtctctgattgcggctctgcgtgtctctggtgctgtgggtagtctggagtcagggtgctctggtgaagtggtgtgatggcaacctgggaacgatggtccccaggtcgcgatggtaacgtggacaaagggagagcgc

SEQ ID NO: 561766 - DNA, 904 bp, Homo sapiens
agcgggttgcggggcgcgctctcgagaggcggcggcggcccagtggtgtcccgtcggtctcggcgccgggaagaggcggtgtgcgctgcccgacggtggcgggggttggcgacggagcgcgttggtgccaggaccggggtccgaggcgcgctctccgcccacagaaatgagccgtcagactgctacagcattacctaccggtacctcgaagtgtccaccatcccagagggtgcctgcctgactggcacaactgcatccaacaatgacttggcgagtctctagagtgtccagtctgctttgactatgtgttaccgcccattcttcaatgtcagagtggccatctttgtcgtaagcaactggtcgcccaaagctcacattgtttgtccaacttgccggggcccttgtgggcatccattcgccaaccttggctattcgagaacgtggctacttcagtacttttccccctgtaaatattgcgtcttctgggatgtgacattaactctgcaacacaacagaagaagcaagaccatgaagagctctgtgagtcaggccttattccttgtccgtgccctggtgcttcctgtcaaatggcacggcttctctggaatgctgtattgccccaatctgatgcattcagccctaagtccattacaacccctaccagggcagacggcatctacctcccccttgcctaccggcccttaaagtcttccctggctgctgttgacctgcctgcatcactggcagtcccctggacctgggcctatccactccactggtagcccttcgacgcagcccggcaacaaatcgactgggcacaccgacccgcccctcgcactccggaccaccgcctctacgaccaccgccagaccagcccacacaatgcgcaacgcccctgcactcc

SEQ ID NO: 561767 - DNA, 103 bp, Homo sapiens
gcggccgcctactactactactgctcgaattcaagcttctaacgatgtacggggacatgtgtaatcaataaacgatttaattctcttgaatgaaatgaaaaaa

SEQ ID NO: 561768 - DNA, 307 bp, Homo sapiens
agttaataagagtttaagtgatcaagttaatacagatgtgaggtaaatctcacttggaaatcagagattcttaagtttaggggattagattaaaaataattctgtttgaaagtttggcataaaatgtatgtatatgtgcatgtgtgcatagcttttaaaaaaaactggaagggtgtggtttgcactaaagaacgatactttgcttgctcgtgctttcatttctgttgtcacgttgcctgaatttgttggatggggcctctattttcggatccatgatctaaataaaggatgcgaattgtttccacta

SEQ ID NO: 561769 - DNA, 299 bp, Homo sapiens
caccgatgtgatacgcggctcgatctgactacgcggctcgatctcactacgcggctcaggctggtcttgagctcctgacctcaagtgatcctcccgcctcggcctcccaaaatgctgggattacagtcgtgagccacagcacctggccatgtttttaaaagaaggaggaaatactcacgacaattacagtcctcgtttctgcaactggtcacatggctcgtagctggtattgatgactgccttcttctactacccattctgtattcccttagccttcagcaagccgcgtagtcagatcg

SEQ ID NO: 561770 - DNA, 410 bp, Homo sapiens
cagtggcggatacatgtcattataaatttgtccaaacccatagaatgcacgaagcaatagtgaaccctaatgtacactatggacattgggtaatatgttaatgtagtttcatcaatcgtaaaaaatgtaacactttagtgggggatgttgataatgatatacgctatgcatgtgtgggggtaaagggcatatgggatacatctgtatcttctcaatttttgctgtgaatctagaactgctctcaaaaaataaaatcttaaaaaaaaacaacaacaaaaaaacccaaaccaggccaggcactgtggctcgtgcccacaatcctacagttctgggaggccgaggcaggaggattgcttgagaccaggagcttgagatcagcctgggcaacatagggagaccctgtctctaca

SEQ ID NO: 561771 - DNA, 207 bp, Homo sapiens
tatatgtatatatgcggtgagtctatgatggccagctttccgtgctattctagagcgcgtgtgaaagacgtcagccttccatcatgagctcatcgcttacgtcttattctctccagtctacacgcttggtgccctttcctattgcacgtgatttttcccggtttgtccgttttcgtattcgcgcgacgggttctcactctgtcatcc

SEQ ID NO: 561772 - DNA, 173 bp, Homo sapiens
cgatgtggcctgcggatggtaatttaagatcaaaatgaacaagggacaggcagttctgtttgtccttcccatgtcgtgtggaacagccttgacatcctaaagccaggctcacgacaaccaatccggaggatggctcccactcagtgaggcacacccagtgctgggcacatgcg

SEQ ID NO: 561773 - DNA, 346 bp, Homo sapiens
ctgtcctgtcctgtcagctgtgcttcctaaagatcactagagtctgttcatacctctgggccactgtcatccttggcctcgattactgcaatagcctgataccttgcctagagacttatttccttctcagcctttctctgccatgtatcagcgttgacttcagaacacagatcttattacattatgaattttttttctaagcgacaaggtcttggcatgttgctcaggctggacttgaattcctgggcttaagcaggcttactggttcaagctacttaatagcccggaccacaggcatgtgccatcatacccaggtaccttaataaatttaagtgggccttccaat

SEQ ID NO: 561774 - DNA, 318 bp, Homo sapiens
ccccccaattccccgggaaccccccccccccttttttttccccccaaaaaaaacccggggcccattccccccccgggtttttaattttggcccggggggggaaaacattttcccccgggaaacccttttgccctttggcccttttttgggcccccttaaacacaattttttccaaaaaaccgggttgggcccgccccgaatttcccggaattttttccccccccccccccaaatttttttccctttaagttttttttttaacccccccccttttgggggttttttttgccctttaaaaaaaaattttttttttcccca

SEQ ID NO: 561775 - DNA, 416 bp, Homo sapiens
cgctgttatacagccgcatataagctagctaatgacagctgacacctgagtctactgttttcggccagcctcgatgagacccgatttcggtcatcgcgagatattgtctactactaagagatatcaatctgttgtcgttacattcattcgacagtgtcagcttttcttttacacaggagaaattgtccaaacgaccaacattgaggttacttcctcagcttcaaacccgggacagttgttggaaccaacggtgccacttcagctgtcgtcagcattgtggcctcagttgatacacacccaattacaaaccgattctctcggtcctatatgcctcagaagtgtgcagacgggctgtatttagacgggcgcttctacacatacctgtgtccaggttcaggagtatactgtatgtctgt

SEQ ID NO: 561776 - DNA, 855 bp, Homo sapiens
cgcggccgctgggggtgcaacccaagtcgggcttgtctgttgcccccggtgttttaggtttcagcaccttagtatctctggtttaaatcctggcacaccgattgcgctgttcgacccagcgtccacgcttcaagctgcgtcgtttggggtgtgcaagcaggaattttctgccccctggcccagcaggtacagatgggtggccactgctcatactgaagggctccagactgaatgggcccagaaggacctggagaccagagtgggagaaggcaccaggccgacttccccccgtgggtaaaacacacaacccctgcgtggagaaacaccccctgcactggggaacaacaacgtgcgctttgtgtgtgtgcgtgtaaccacatttgtaatatggttttattcccccgagttaatatgcccgggcacttgtttaaatgtcacccccactttgggggaagaaaatgggtttagtgagcactaaatattcccttgtggacactcctacttacttaactgccaccccctgttgacactttggattattgctatagtgtttccgtaaacaccctttgtggactgaatccactctatgtggattttatttttttcaatctttgttaaggtataatttaacactagagtaagttactgtttttaaaatgtatagttccaaattttgaccaaacacatactgtttatttacccccggttaatacatacaaccagtttcttttattttcttctaatcatttgtaccccctttatactcaaccctttttccagcccctggcaggatgattttttctgtttctatagttgcctttttgacagtgtcatataaatggaatcataccaata

SEQ ID NO: 561777 - DNA, 104 bp, Homo sapiens
actctagtaggatcccccaatggcagccgcaagattaggttgaacttcagtgtcctcccctgggcatggcaagctccttctctgagggcaggataatccgacag

SEQ ID NO: 561778 - DNA, 557 bp, Homo sapiens
  misc_feature (70)..(70): n is a, c, g, or t
aataaactagctctattttcaggctaaggatgaaacataaaaaattattcctcatagtcttttagcccanatttgtgtcagccaagtaggccagggaatcctgaaccttgaattggtactaatattcttccagatggataggatatagcggtatctggaagagacatccataaatctctggaataagattacaatagcctaagctgcaaatcaaatttttctagtatgaaggccaactcatagtcaaagttaaccaaatacacaaaaccagcagaaacagaaaactgatacacaaagacccaagatattaaaattattagaatagcctctgaaatagctgtactttttttaaagaaattaaagatgagtttaaaaataattgctgggaacatgaaactgtaaaacatgcatatcagatttttttaaagtagaactttggaaactgagtaatacaataccaaaattaatagtagatagctttaacatgccttcagagaaaattagcaagttgggggagataggccagaaaaagtataccaaatgcaatagagacagga

SEQ ID NO: 561779 - DNA, 147 bp, Homo sapiens
  misc_feature (35)..(35): n is a, c, g, or t
  misc_feature (50)..(50): n is a, c, g, or t
  misc_feature (58)..(58): n is a, c, g, or t
  misc_feature (61)..(61): n is a, c, g, or t
  misc_feature (72)..(72): n is a, c, g, or t
  misc_feature (79)..(79): n is a, c, g, or t
gcagataactacaactcacattgcatgcccatacntattattctgcgctnaactgtantcntaggcacagcnctatacntccttattcgacccgatctgggccagcctagcgaccttctaggttacgaccacatctacgacgttatc

SEQ ID NO: 561780 - DNA, 432 bp, Homo sapiens
  misc_feature (6)..(6): n is a, c, g, or t
  misc_feature (69)..(69): n is a, c, g, or t
  misc_feature (82)..(82): n is a, c, g, or t
  misc_feature (93)..(93): n is a, c, g, or t
  misc_feature (111)..(111): n is a, c, g, or t
  misc_feature (166)..(166): n is a, c, g, or t
  misc_feature (237)..(237): n is a, c, g, or t
  misc_feature (265)..(265): n is a, c, g, or t
  misc_feature (273)..(273): n is a, c, g, or t
  misc_feature (280)..(280): n is a, c, g, or t
  misc_feature (283)..(283): n is a, c, g, or t
  misc_feature (287)..(287): n is a, c, g, or t
  misc_feature (297)..(297): n is a, c, g, or t
  misc_feature (308)..(308): n is a, c, g, or t
  misc_feature (311)..(311): n is a, c, g, or t
  misc_feature (313)..(313): n is a, c, g, or t
  misc_feature (325)..(325): n is a, c, g, or t
  misc_feature (327)..(327): n is a, c, g, or t
  misc_feature (334)..(334): n is a, c, g, or t
  misc_feature (347)..(347): n is a, c, g, or t
  misc_feature (369)..(369): n is a, c, g, or t
  misc_feature (422)..(422): n is a, c, g, or t
cttctnacattttcaatgtctaacactgatatttgtttctgcgccaccttttgcaacagcctttttccnaccacagaagcanaataaattctngcttgttctctggttggntggcttcttttcactttgctggcattttctctgccatgtgcttctgctggctttnagcttgtctggtcaagtcttcaatgtccaccagcatggcatcctgctctgtgtgccgctcatctcgggtgngaagcagctgggccaactcttcattcangctttctntctgggngtngcgntctttggctntctcttgtagntgnanaatagtcatgtntntcaggtnggtgggttttaanattcttttcatcaagcattcanttatatgaggcatgtgtggcagaagatcagcgacgggagacattttcatgttntgtttctcaa

SEQ ID NO: 561781 - DNA, 418 bp, Homo sapiens
  misc_feature (9)..(9): n is a, c, g, or t
  misc_feature (49)..(49): n is a, c, g, or t
  misc_feature (127)..(127): n is a, c, g, or t
  misc_feature (222)..(222): n is a, c, g, or t
  misc_feature (227)..(227): n is a, c, g, or t
  misc_feature (374)..(374): n is a, c, g, or t
  misc_feature (406)..(406): n is a, c, g, or t
cctgttatnaaaacagcctgtccagattccttgccattccagcaaaacnacccaaaggcctagtgtttgcctagatactgttcccagctgatggagagacgatagtgcaagagtcaaaagtcccttnccccggccgggccgcagtggccctcacgccctgtaatccccagcactttgggaggcccaagtgaagtggatcacctgagttcaggagttcaaganccagncctggccaacatggcaaaaccccatctctactaaaaatacaaaaattagctgagcatggtggtgcatgcctgtaatcccagctacttgggaggttgaggcaggagaatcacttgagtctgggaggcagaggttgcagtgagccgagntcatgccactgtactctagcctgggcgacagngcgagactttgt

SEQ ID NO: 561782 - DNA, 421 bp, Homo sapiens
atccactctatagcctttgagaaactgccccaaggatttgcaaggctaagatgctatatctggaggtacctatatgcagaataaacccattgacgacatcacttgtacagactggcaaagtcctcggtgtaacatctgacggagaaattgctcgctgtaagcagctcatctgtgaccccagctacgtacaagatcgggtagaaaaagtgggccaggtgatcagagtaattagcatcctcagacaccccatcaagacacaccaatgatgacaactcctgccagatcattattccacagaaccaagtcactcgaaagtcagatatctacgtctgcatgatctcctttgcgcacactgtagcagcacaagccagtacatagctatagtaagtacacctgtggaacccaaggagcctgcgaaggc

SEQ ID NO: 561783 - DNA, 844 bp, Homo sapiens
atattatactagcatttaccatctcagttctaggaatacaagtatatcgctcaacctcatatcctccctactatgcctagaaggaattacatactagtcgctgttcagttatagctactctcataaccctccaaagccacagttcccgtctgtagccaatatgtgtgccttatttgccagtacttagctcttgggccgccgtgccagaaggacacgggtaggggccataggccaataacataaggtcgtcaaaatccgtcccaagaccatctatttattgggccctaacgaacctaaccgtaacagattccacgcagtataaaccctaccctccaaattgggcctaaacaacttaaacttctgttcccccaaaccaactcttattgatttaacctacaccgagcttgggaacaatgggatcgttttcccaaaaaagaaaccacctttacatttggcaagttccatccatcaaagcgcaatcccaacaggcccttaattgtatctaggacatccaatccccgtcttgcctattgttttcaaaacaccagattgtcaaaaaccagacctcttatattagggctggttaccccaaaacctttatcattcgggaccccctaaaaaaagccccctcttcactaaattacataaccttaccctggaattccttaacccccttcacaattccattgggcaaaatgcccaaacgccaattttattccaggtggacccactttatcaacgaaaagagaattctacgcgttctatacctaatcctcccctaagaaagtctcctgtattcataacatcagcagccaaaggaagtaaccatattcgaataactgcg

SEQ ID NO: 561784 - DNA, 389 bp, Homo sapiens
ttgtgagaccccagagactcgagtctggtcctgaccaaacaatgtactaaaaccagctatgagtccacagagcagagggtgtacagttaggctgctcttcaataaccctgggaacctgtttgcatatcagactccctgtccctcctggagaatgatacagttgctctgaaaggaggtcagagcacctctctcacacatcctgtctgtgccagctgggaaaaggaaggctggctaaatagcagaatggatctaacagcacagcagcttcccttccacacccccagcctctggcatcagtacgctccttacaggaagggccccaaacagagccgaaggtgtggtctgaatccacagcgccactgtggccctcctgcctacattccatttct

SEQ ID NO: 561785 - DNA, 165 bp, Homo sapiens
tctgacaagcctcagtgagatgaacccggtacctcagttggaaatgcagaaatcacccgtcttctgtgtcgctcatgctgggagctgtagactggagctgttcctattcggccatcttggaaccgcccgattgtattcttttggtggtgcagtttgtcgggtacc

SEQ ID NO: 561786 - DNA, 155 bp, Homo sapiens
  misc_feature (100)..(100): n is a, c, g, or t
tcaagcttctaacgatgtacggggacatggaggtctgacgaacattatgcaatcccagaaacagcatagtaactcgttccaatccaatgcctccaccagncatgattctccagtatatttgtaaaaaataaaaaaaaactaaacccaaaaaaaaa

SEQ ID NO: 561787 - DNA, 350 bp, Homo sapiens
  misc_feature (11)..(11): n is a, c, g, or t
  misc_feature (43)..(43): n is a, c, g, or t
  misc_feature (68)..(68): n is a, c, g, or t
gatcgagatanaataatacacacacccaatacaggatgatagntcgtgtgacagacagagatatcatntgtcagattgcttatcgccgtatagagggggatatgatagtctgcgcagcggtatcacacgaacttgcacaatatagtgtgatgtgttgcgctgacaaattatgctgcagcatatttgtactggtctgctgctaggcccgcaggcttctcaataggtttggcatggacaagatctatgacggccaggtggaggtgactggtgcatgaattcattgtggaaagcattgatgttcagccaggtgccttcacctgctatttggatgcaggccttgccaaaaacta

SEQ ID NO: 561788 - DNA, 715 bp, Homo sapiens
gtgccgctctgaaaagctgagtatctatggtgatctcgtagtgcatgagtgaacgaggagctaatcagatatccttgcttcttctctagagctggtcacatctacaactgaatatcatgaacaatcttggcctctagctacctaaaagtgaatcttgcctcatttctgaatgtgtacagcactttcttcgttcaacatgacaaggtgctaataggcaccttctaaagatcccatgtcctcattagtagctcttatactagtggtttcattgggatattgggcctgtgtcaacatcacctataatgatgcaaataaaggttactcaaattctgtgcatgactgtatctgctatacctttatttggttattggttttgtagtaatttagtgacggtggatgttcgggagttgtattattattttactaatatcttgtagtctattttggttttttgctttggttattgttttttttcccttttcttagctatgagctgatcattgctccttctcacctcctgccatgatcctgtcagtttaccttagtttaacaagctgaataattagtaaaatgaatgcttctggtcgggattggcccccaatctgtatttgaaaatttccagggaattgatccttttaatgacactacatttttccgggaactggaactcccttacaccttttctttggcattcccacaaaccatacaaaaacaa

SEQ ID NO: 561789 - DNA, 127 bp, Homo sapiens
catagaggatcccctaggtatgcataagatgactccaccaattaacgatctgctgcctagacccacccccatcttaaagaacagacataaaaagtacaagagaatgtattgatcttgttggtcgtat

SEQ ID NO: 561790 - DNA, 349 bp, Homo sapiens
atcgaagctgtgtgttctgcccaaagatgatccaggcctcagtgcttctctggggctggtgtatagtctgttatcacactgctataaataactacttgaggcctgtcatggtggctcacacctgtaaacccagcactttgagaggctgaggcgggtggatcgtttgacgtcaggagttccagaccagcctggccaacatgggaaaaccccgtctctactaaaaatacaaaaattagccaggcgtggtgatgtgcgcctgtaatcacagctacttaggaggctgaggctgcagtgagctgagatcacacactgcataccagcctgagtgacagagtgagactctgtctcc

SEQ ID NO: 561791 - DNA, 159 bp, Homo sapiens
  misc_feature (101)..(101): n is a, c, g, or t
tagtcaggctcggtccctgcttcgtcgggtgaatagccgctgtgggaattttcatctcttggtcagccgctgtagatctcttcaagggagactcgaaggtncgtgggtgactgggggacttccttgcttctttcgggcgggctcttgggcagagcggga

SEQ ID NO: 561792 - DNA, 111 bp, Homo sapiens
ttcgagttcggtaccctaacttgtttttggaactagaatttaggggcagttggatgaaatttcaaatttagaaggggaataagaattttgtagtgctatataaagaaatga

SEQ ID NO: 561793 - DNA, 113 bp, Homo sapiens
tgcgccggctacgtgcagattttcttcagcctcttccacctctgagacagcaaggccaatccctcatcttcccttggaatcatatctgacacgcctccaaatctgcctaagca

SEQ ID NO: 561794 - DNA, 297 bp, Homo sapiens
tcacacgtcgctgggtttctacaagtctacagacagatactcttaatctagcagtgcagactattgcctcctatgattagtaaaccctataacgccccactcaagacctctataaaagtacagagcagccagaatgacatctctaaagggtagtagtgaatatcactgctgcactgcagactagtaggtggcttgtgaggacagactctgtggctcacctgcacacacggcccatccttcctctgcatcctgtgtgtcccaccatcctgcccgtctcatggctcctgccgcccaaca

SEQ ID NO: 561795 - DNA, 163 bp, Homo sapiens
acgatcgagctcgttacctggaaacgctttgggagaccacacaggaggatcattgagcccagaggtttgagaccagcctgggaacatagtgagacccccgtctctacaaaaaataaattaaaaaaaaaattagcctagctcagtgtggtggcatcgataaaca

SEQ ID NO: 561796 - DNA, 230 bp, Homo sapiens
tactctcaaccattcaacagctcatgggtacaggacattcatctcaatggcccagcaggtggcgcccgacccccatccagttcgcacacatgtcagcacagtcaatcagcagtgtggccacacacagcacatggcacccccagccaggcaacaagcacaagccaagcagacattctggcccaagcaagttttcattcatgcacatctggcaggcaagcaggcaggcactc

SEQ ID NO: 561797 - DNA, 800 bp, Homo sapiens
gattacagaccttggaagcaagaggattgcattcagcctagttcctggttgctggccgaagggactcgatgggacagttgaaggcatacttttgcaagagaagttggcttatagagaactcgtagagaacaacattggactatggatagacagttaactgactcagttcattgaggcaccgagatccgggcatgttcccttatgacgaacctgtaacatgcatggtgggcaagccatggacgttgggcttagaggctattttgcgatcacattgtaagaagaaaccggggtgggtggtggtctccaggtcaatcaacttctgtactgggctctgagccgacatagtcggttttcagactcagcaatgtaaggagggtatttttagtatcgcctccagttaacaaatacagcactggcatggttcgacgcgttctcctgcaggtgaccattgacggcaggaatgacatcgtcgatgctgaggtctggaagctcctgcccagatgtggcagtctctagaattagatttctgggaaggatgcagcctcaggtgccttgcattttctgcttgtactggaggagagaggaatctggtacctggagcgaatcaggagagagcaggatattacaaacaaagaatttcttaattctcatctcctgccaaagaagaaagcaccaagaaacatatacttatttacgcttgagactccatacaattgacagatctcggagtctatgaatacttacctgccagacgtcttcaaggatcttcatgtataaccacatcattgtggttcctcgac

SEQ ID NO: 561798 - DNA, 888 bp, Homo sapiens
gagtgtgctggtaccgaggtttgttgtcggcgtgccagtctctcatgtgccacccgtgtttgtttgctccaccccgggctttcttggggtccccccccggccatggctttttgaacctctgcctgggattcccacttgggtgcggtcgacccgcgctatggcatctcctcgggctgtcggtgtcctcttcgtgcgcccggcttgtgctcgtggtcccgagacagtcagtgcgggcgtcatcccccctgaaacctcctctacgcgcttcgtcttatggcaggtcgtggaacgctccttgggtaaggttccctgctgtggtcgaccgccgctcctccccgcgttgttgagtcccgccgaagttcccgaatgccggtccttctaaatctgcagaggcagtcaacaagcgtccgagcttcccctcatctaggtcaagccagactgctcccgatttacgcgagaggttcacccctcttaacccccacttatacttggtatttagagcggccaccagagcgggggtaaatatcgctcgctttaaagaacatgcggcgataacaaataaccgtgtcatttcctactgtctttcagaaaggcacttatataaggattcaccagtttgtcaggtgcctggaaagcgtcactaggtaacttctgtgatctatgatacaaaagattcccccagcaagtagttgtgaagccacacgcccggttgtgatggagaggtatataaaaacacgtccggcggataccataaacaagagtcgggaagcatctgtggtttcttgggtgcagaagaagaaatcaggaattataccgcgccccacagaactcccgcttggcaagtcccccccccccccccccccaaccagtcccctctgcaacaaaaca

SEQ ID NO: 561799 - DNA, 138 bp, Homo sapiens
atggttaaaaaggccaaaaaaaaaagggttctttttttttccctttttgtctaagaaggggccgtttatttttttttggcccgtttgatgtatgtgtgaaacaaagttgtcccccaataaacagggatttttttttta

SEQ ID NO: 561800 - DNA, 327 bp, Homo sapiens
atccccctcagaccgcgcccgactgtttgtcacatttcagcagcatagaaacagcctttacttccccgagagggtcccatcccctgaatggtccaacacgaaaatgtcctatcctgcttgttccatagtgcctactgacatcgctagattccaatgcccagccaacttctttttgtatttatagtacagacggggtctcaccgtgttagccaggatggtctcaacctccctacctcatgatccacccacctcggcctcccagagtgctttgaccacggtgccttagccaccgcgcccgggcgcggtctgtgacggggtaccgaggct

SEQ ID NO: 561801 - DNA, 120 bp, Homo sapiens
cgaggtatgctgctgtgacactgtggcacagctgaaaccgaggggtactgcgtatcctgcgcttctgcggagttcttccaactctgggtacctgatgctcgaaattctgtcaatccattg

SEQ ID NO: 561802 - DNA, 288 bp, Homo sapiens
  misc_feature (80)..(80): n is a, c, g, or t
  misc_feature (95)..(95): n is a, c, g, or t
tcagctgtaagccgacgcatccccggatcgcgcactcgtactagccacagaatgggtgaagattattgtaatggtgcttnttttaaacttaaaantaggtaaatatactaaacaaatgctaaaactcagttttaggatgaaaccattgttgatatccacatcagtccctgtttagaaaaattaaatgatttagttattacagtacggtggcaatgaaatacattagctcaaatggtaggcttcgaatatgttttgtatttcagcgagtctcttttcaataattaaggg

SEQ ID NO: 561803 - DNA, 873 bp, Homo sapiens
cgcggtggagcctacggtccctcagtgcctgctgctgaggaggccaccgaagctcggggactgcgaggagcctggcgtggccctggaaagactgccccgatcctggacgctggtgcagcgcatccaccagctgcagtgctgagctgcgctgcagtggcttcctgccgactggaggatgtgacgtgggggctgctggagtgggctcacgggttctggtccccctgccctgctcctgtggctgtgggctgtgttctcggcgggcgtgcctggaggagtgagcttgggtccttgtgctggctgcatgagtcagatggggcggggatttcggggcaccggtgtcctcaccttcacgatgaaatggccccacatgcactgtccccactacccgacgactcactcttcgtggcttctctctcctccccaagagcaggggtgggcctgtctcgcgttcccctgcgggagtcatggaatgcgtccttcctacctaccagtcctcccctctggtgtctggggacacttcctggggggcctttcaggtggttggcgccgtgtgcagggcctgagagcctgggggccgcggcctcaggggtccccacatgcctgcagcaggccacgtgccagtaacctgctgcagccggcctgactaccgacttctgcgcggctaccggagcacagttgcacgggtgtgacccaggggcttctgtcgccgcctcgccgggagggtgctggcgtgtggcaatcagagctggtgcgggttttcgcaggcagtccgctgctcgcccgtgcattgtgctccacccttgcaggagctggcgcagatccgcttgtgcactgtgtccctgcttctttcatgtctaccctcagcttgcgtgt

SEQ ID NO: 561804 - DNA, 311 bp, Homo sapiens
acaccttatgaaaaaaacccatcttccgctactctagaggtaggatggtgccatcccaatgatctccctcctgaagctgacccagaggatgagaccctgcgcaagctgtacgagcagcaccacgatggtgcaggacatgctggtgcccattaagtgcctgcagcaggccctgcacaccttccaaaacgatagtccacgtctaccccatctggctgtgtccgttcatcctgcccagacagaccaggacctagtgcaccccaagaggaaatgaggcagagctactcacatcgacataggagcatatggggcgc

SEQ ID NO: 561805 - DNA, 285 bp, Homo sapiens
  misc_feature (249)..(249): n is a, c, g, or t
agcactcaattattatatattacttattaccacttatttattactattaaatgggatctgtcaaaagaaacatgaggctgggcacagtgtctcatgcctgtagtcccagcactttcggaggcagaggcaggcggatcgcttgaggtcaggagtttgagaccagcctggccaacatggtgaaacccatctctactaaaaatacaaaaattagccaggcatggtgatgcacgcctgtggccagctacttgngaggctgaggcacgagaatcgcttaaacctgggaga

SEQ ID NO: 561806 - DNA, 200 bp, Homo sapiens
tcattgatagacaaggagcagagccacgggtgagctagaagtcgtagtacgtaagcctccatattgctggttgccaacattgatggtgttatggctgtggcgaagacaccttcccgggatctatcactcatcttgtgtgagctcggataatctcgctaatagtcattgtgtcgcagtactcttacatctgtgcttcgacg

SEQ ID NO: 561807 - DNA, 603 bp, Homo sapiens
caatttctgatggagacgagtgtgtggtcgtgatggagtgacacatgatgtagatcgggagaagccagcagagagtggagccagggctccatgaggagtgaggaaactggaggtggcaaggtggaccctcaggcatgtgaagccctgggcaggctattggtcttgagaaagggacctggtgacgcagagcagtgtgcagggatgaaggcaggcacgcaggctgcaggcacgcagcatgcagacacgctgagggagagcgcctctgaaactcccaggtggaggtgttgcggagtgtggcagtgggtctcaagctcccggaaggagccaatggctgcagttataaatctgtgagtgatttcataaccaaaactcgtgccttgtaactggagttgtgggtgcagacgaggtcacaggaggagagatgctgagtgagaagagaggactctggactgagactgaggaacaggcacatctgatggcaggtagaggacaatgagttgcaacagggacagaacagggaggtcggggatttcaggagggggaagatcatgaagcctcttgggaacccaggaagattgagtgtcaggggccaggcatgggatg

SEQ ID NO: 561808 - DNA, 295 bp, Homo sapiens
aaaatgcagccggagcctcagtccccagcagagcctgagtctcaccccctcacaggacagagctgtatctgcatagagctggtctcactgtggcgcaggccccggcgggagtgcctgtgctgccaggaagagggggtgctgatttgagggccaccactgcagatctgttaggtctgcttcctgcccaggaaggcgcctggcattgacaggagagaactacacgtctggtaccatttcatgaaagcctacttctagcacttatctttcctggtggtctttctttttcccatgattc

SEQ ID NO: 561809 - DNA, 238 bp, Homo sapiens
gaaatccccccccccccccccttttttgggcccgtttatttttctcccggccaaccccgtgtgggcccaaaatgtaaaagggggggggggaaaccttttttaaatgggttgttttcctttttttaggggccgccttgggtttccgtttttgtccaattttccctgggtttttccggggattgatttatgcctttaagggggggaggcccttttttttttataaagggcctttttccca

SEQ ID NO: 561810 - DNA, 316 bp, Homo sapiens
actctattagatccccgcatttgacgcgtctcctaccgaagactgcctttctcgattttatctttcgcacagcagttccggatggcgtgtgtgtgtcacttttagggagagtcatatattgattattgtatgtattccatattcatgtaaacaaaatttagtttttgtggcttaatagggctctaaaaggggccggggaaccgcgtattataattggttccagaggcctataatgaagctttatacgtgtagctatatctatatataattctgtacatagcctatatttacagtgaaaatgtaagctgtttatttt

SEQ ID NO: 561811 - DNA, 1605 bp, Homo sapiens
  misc_feature (1097)..(1097): n is a, c, g, or t
gggaaatatatgggcgatcaaagtagctcaatgaagctcatgccgcagcatcatcgacgcgacgctacgtgtcctcagcaggctttagtcccgctagctggcaccagagtgtccagcttggctgtggtcttcggaaggtacaagacgaggccagatgcgaggcgtcgatgttcacttgcgagcgtgtgcggcgacgtggaccctcgaggtcgcaagctaccgacagttggctatatctgtcctcgagaagagcgatgccagaatcgtgaacggattagtaccgatgataagtctcctatggacgaggggatctagcttgatgtatagacaggggagccgtgacaggtgatgaccggtttgtgagtcaagccctggcgtagtcaaccgggtgtgtcgtcgggcatctcgtctactcttacgagcgacgagccgactttaaaaggcgtgctagcattgacgattcaaggatttgcgtagggtatctggggcacccatgggccgtagaggacgcaatgctacgattcctcgagggccagggtcttccgttcgccaggataagaccatcccttggaaaaaggccttcgatgggaagcccattccaaatcgcgtgcctcgaggaatttcccgttatcgttacacacccattggggtgcctctgggtcacgcgacattcccccgttgttggaattctctgttcttggagggacctgttgcgctgcaatgccctagcgggtgcgcactgccgcctgggggggcacccaacggttgagtttgtcgttgggtcgcatgggattgggcgcgaggaagcaccgacagcaacaatgtgcccggcccgtccccaatgtgggaccccgaaacggtgtcctcgatatccccttctcttccagtgcaaattgctaagacgatggtgcccttttttgcggaacccgaatttcgattttatgccctctgaaagcgcttgacagtgcgacactacgtacgccaatgtacgccctccagaggtgtgcctattggaaaactggaaaaggccccctatgtaagccccatatagtggccgccaattacccaaaaggtgggtggtcggacgctccctggcnctttgttgactcgcattactggtgtgacgttgcaaccacggcaccctggtggcgctgacggacatgcaagagctggatttggcactttctcatcagcagttacaataatggactacttcccaaccctttcactgccacgcttcctttggaacggtatatgagtcttagcagcgagacgtcgatacgggaacggcaaaggatcgatggctaccacccaagcattagtacgcctgagttgggaccctttggcacgtgggacacgtactactcactgtttcacggcaaacaactttagttttgtatcacccgccacacttggggaacccacttgtagtagccgagtatccccgtagggtggggcgaccccgcacatgtgctcatatgggagttggccgctttgcagcataggttgctagctgagccacactcgcgcccgagagcgatccctgatgtacgcgcgccattggaaacggacccacagtagtggcgtcttgccactccccgacag

SEQ ID NO: 561812 - DNA, 223 bp, Homo sapiens
cggggcattcagagctactccagcctgggcataagagctactccagcctgggcgataagagctactccagtcctgtggcaataagagctccagccgtggcttacacgttttgaatcaactctttgagccatgcataattttgtaacatcacgtactgttcacttggaaaaatggttcattgaattcttccaattgaaatgcatttcattatactaatcacact

SEQ ID NO: 561813 - DNA, 747 bp, Homo sapiens
tccccctgggtccacctctgcctctacccgccggttggggtaaacaaagccaaaggaaaaaaaggaaaaaaaaaaaaaaaacaaaaccagccgtctctcagccgggtgaggtgccccagcgtcagaatgttatcagcagaggggtgaagaagatcttctggctggaccctcttcctcttctggctggagggcagttggcctcctggatctctgggccatgcccaccttcccctggtctggtcccccctgtgcacaatgtctcttacatctgggacgcccatctggtctccctcagctgtcacagtcctctctggggtggcccacgggtctctggaacaataaggccaacaagatgatatcggatgtgtcggtgtggggagaagggaggcccagatctctgtcttcggccatgatttggtagatctggcccagagactctcaggtgggtgctgggccctactcaggattacatctgaaatgtatgggcctcgtaagtacgggtgagggtttgggacacgtcgggaatccctaagggctgaaagagtgtttccaggtagggtctgaccctccgaatgcctttatgggggggaacacaaaccaaacagcagatgttgtgcctggatctgtgtccgtacatggggactggtctgtttaccccggggaatgcccaagaaggcctgtttgccccggggtctgtcactagcaaggcgggcggaggaccggagcccgtattagcgtcccgatcca

SEQ ID NO: 561814 - DNA, 905 bp, Homo sapiens
tggggggtgccctttttaaaaaaaaaaaaattcccccctaaaaaaaaaaaaaattcccccccccaaaaggggaagggggggaacgcagaacccccacactactcccaggaaaacaccgactcgtgctagcgccccgtcgccttcccacccccccgcccccccgcgcaagcaaagaaataaagagaaccctcctgcccgctacgacaaagaagacagggggcgtggggagtcgagcccccccacgcgcgctgcagaggagcgcaaattattacccacccacgaggtagtcctcctcgcaccaacacacaagcagacgcccacacgagcgggcgggcagtccctcccgcgagctcctctagctgcgtggggtgcccgaccgggtagctcctctcagtctgttcctacccagagagcggcgcgcccccccacacaacaaacacagacgtgtctgctcaagagcggttcgctgtgcctacaccacccctcctatagagagatcaatcacccgactgttgtccttatcggcgcgcccccctcgtgagaaagatcctatcctccgccgccagacgcttctgtgttgcagccatagttttagggcggggcaacgctctcccacacacacggtccctctcctctcttttcttcttccctctctcctctcttcttatgccgcccaactatcgtgtcggccccccccccgccacgcctgctgccgcgccgcctgctgcagccacccgcgccgactgagtaggttaagtatcgtcgcacccaccgcaggagcaactacacacccacggctgcggccacccagagcccacgcgctgtcccgccccccccctcccgcccggccaccgccaacacacaggcgccttcctatcaaggaagaacacccaccgccgcagcac

SEQ ID NO: 561815 - DNA, 1560 bp, Homo sapiens
  misc_feature (71)..(71): n is a, c, g, or t
gtccttgtttcctgcagggctggccctggctcgggcagggtggggcatcaccacctcactggccttgctgnaggcacagggctctgcggacctgcagccatctgtgaggcccgcggggatgggaggggaggagggtggcctgttggtttccctcagagggggcaggtggcctggagagagaggggctcaggaactgggagcctcgtgggtggggcagatgctccgcggcctggagtggctctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggccctccctttggcctgagtacttttcccgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgttcccggcgctggctggctggctggctgtaaagcacttgaagccccccgggcgacaacccctgaaaagcagaactggcctccctggccacagcagacttacccagcggtctacgtgtcccgggcacttcccggaggcttcccgtcccttcctcatcgggcaggagatggaaagaggtggagggaagaat

SEQ ID NO: 561816 - DNA, 1292 bp, Homo sapiens
  misc_feature (71)..(71): n is a, c, g, or t
gtccttgtttcctgcagggctggccctggctcgggcagggtggggcatcaccacctcactggccttgctgnaggcacagggctctgcggacctgcagccatctgtgaggcccgcggggatgggaggggaggagggtggcctgttggtttccctcagagggggcaggtggcctggagagagaggggctcaggaactgggagcctcgtgggtggggcagatgctccgcggcctggagtggctctgccggggcattggtgggacccctgctcaggccttctctctggctgccagttgtgtctaaaagactcttggaatctgagaacccggagtcgcagcgccctcgggcctgggccacacgcaggccctggtgggaccacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgttcccggcgctggctggctggctggctgtaaagcacttgaagccccccgggcgacaacccctgaaaagcagaactggcctccctggccacagcagacttacccagcggtctacgtgtcccgggcacttcccggaggcttcccgtcccttcctcatcgggcaggagatggaaagaggtggagggaagaat

SEQ ID NO: 561817 - DNA, 334 bp, Homo sapiens
gtagtaacaagacgaaaaacctcaggacaaagtagaaagtatatctttgtcaaagaacttggatttcatgagtaatgtctctacatattttgaagcagcatttagtgtatttacgagcagtatcaaattaattcatttctttccctgttaataaaaaaggtacattcacagaatcagtgtacttagaataaaaaataaacagaggaaataagaactaactcgagttaataacaacatctttaaggacaagtttggtcatttaaaaactaagtcttgttttgttttgcttgtttttaattactcctttcatacttaatatttcaaatatagctgc

SEQ ID NO: 561818 - DNA, 1241 bp, Homo sapiens
  misc_feature (1)..(1): n is a, c, g, or t
  misc_feature (5)..(5): n is a, c, g, or t
  misc_feature (19)..(19): n is a, c, g, or t
  misc_feature (24)..(24): n is a, c, g, or t
nggangtcagtagcacccntcggncttgagagcacacgcaggccctggatgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggccctccctttggcctgagtacttttcccgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgttcccggcgctggctggctggctggctgtaaagcacttgaagccccccgggcgacaacccctgaaaagcagaactggcctccctggccacagcagacttacccagcggtctacgtgtcccgggcacttcccggaggcttcccgtcccttcctcatcgggcaggagatggaaagaggtggagggaagaat

SEQ ID NO: 561819 - DNA, 293 bp, Homo sapiens
  misc_feature (39)..(39): n is a, c, g, or t
  misc_feature (48)..(49): n is a, c, g, or t
ggccggtaccgctctgttacttcaagcctatgcggctancgttattgnncatctggcggaagtcgtctaccaagtcatcaggaagcgactcacttagtgcgtcatatcccggtgcttgccaccagtcgctgctggttccggatcctttacgcatgccctcaaccaaggcctgaagatccttgggcatcacttcatcgggatcgcttgccggcaacggcatacgaatcttccacaaattcccgccctctatcagggcaaagcattgccccttgggtagggattccatttgggtg

SEQ ID NO: 561820 - DNA, 1231 bp, Homo sapiens
  misc_feature (71)..(71): n is a, c, g, or t
  misc_feature (1096)..(1096): n is a, c, g, or t
gtccttgtttcctgcagggctggccctggctcgggcagggtggggcatcaccacctcactggccttgctgnaggcacagggctctgcggacctgcagccatctgtgaggcccgcggggatgggaggggaggagggtggcctgttggtttccctcagagggggcaggtggcctggagagagaggggctcaggaactgggagcctcgtgggtggggcagatgctccgcggcctggagtggctctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggccctccctttggcctgagtacttttcccgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctccccctcctcctctgtgctgtcgacagcacagaggaggagaacgacaagctgcgccaggagttgcccagcacgccaacgccttccaccagtggatccaagagancaggacatacctcctcgagtgggtcctgtatggtggaagagtcggggaccctcgaatcccagcttgaagctaccaaacgcaagcaccaggaaatccgagccatgagaagtcagctcaagaaagatcgaggacctg

SEQ ID NO: 561821 - DNA, 3544 bp, Homo sapiens
cggacgcggggtaagaaactaaatccagagcttttaacaggtacttagaaataagtattgggtaatcactaagaggacattgactgcaccaaaccaaagctatagaaagaaatgattgactttttaaaatatattcacattaactgtcctaggatacttctcttgaggctttggaaaacttcttccttgaaatttgcatatccactccagttctgtcaccaaagattttaatcttcagatcgcaatttcctctctcccagaaaaaagtactacaacaggctcaagggatatgctttggtggtcaagggattacactatggttttccttctgttcacaatggtatttacaggagaccttgtcatcagaggacgtactgaactatctttatgactttggatttgatcagaggtttaaaaaatagaaaaaaataaacaacactacttgacactgtaaatgatctttaatagagtcatgacctggagactgatggagagaaagaaacttccatggaagagagtgagctaaatcatttagaaccaaacaaaggtcactggtgaaacatagggcagcatgtacacagtgcagatcagggttctgtatggccagagccaacagcagtgaccggtgggagagtcagacaactggccaatgaattcaagtgttgaaaaagccacagtctggattttgttgtgatttctggagtggttgaaacgcccatgcccatggcaaggaaaatgcttggaggctgatctgttgtgatagtgcctttcttgtcgtagtgagtactagattaataatttattcagttacgcttttctgtaccattgcctccagtcttctgaggaggtttgaagggacagtatccacttaggatgaagggacaggatattgctctggaatgctgtgatttgatgatatttgcactagattctaaactctcctttaaactggagcaactgactgagagaaaaaccaaggacagctcaaagttaaaagaaaccaaaagcagtattttctgacagataccatttctttttctccttctttttttcctggaagaaaacttcacactagttggctaccgagctcaactcttaccagttctttctctttattttttgtttccatatggaaccatctgtgtgaattagtcatcagttaggtatagttaacgtaaagagcccctgccattgaaactttgcacaccttctctgctttattgaaggcaagggccagtgggcagtgatagcaggggagggaccctccagaaccacccagccctccaggaggccaataagcatggatatcatgtcaggagctgagctgacatatatttactcagaggacattggggtctgtagctaatcctaaagaatgctccgcaacagaaggaaaccaatgcattgtagaaaacaaagggagatggtgcccgaagtctgcctgtttctcttctcttttctttcccatctcaccaccatgtcctctctaacagaattatatttcatctcatatattacatgttactagaaaagtcatttggttccttggtttctctctttatcagtgggctggaaattcctccaaattaaatataaataccagtagcagctcccctgtgtccagccagtttctcaaatgctgtccacctggtcttactgtccacctaacataacttggaggctttggctggctcaaccacctgttcactttattttgttttcatttccatttgaacttgaagtgaggctatggaaaggtggaaatcatgggcaaggtttggaggctgcaattctagggcatagcttgtcaggagtttatattatctaaaatatatctttctataccccttttcattttaatctgttgccctgattataatttctttatatttgtggttatttttataagaatagagtccatttgctatgtctatttgagtactttttttctattgtccccacatggatgcagtaccaacctgttaatgaaatatctttttattatattattaatatgtaattctactgtagaccaaaaatataaaaacaaatttgttcattttaaagatataaagaactagggagtaaaagattaaaagttgaaggaaaagacagaagagcagtggttaactatgttgagttagaaatctaagagtagccttacctgttttttaaccagtgcttgccaatcataccatagttggaattatgtaatcttggctccttcatacttatgttctataattcttgtttgtctatttgttttctttgatgtaattgaggttgcacatcatgctattcttggcaatgcctgattctattgtattgtacttttgttagtcatttcctttagaaagatggggggaaacgtttatttcttcttttaatttaaaatttgtttaatgcactggaaataaaattggacatatttcactgtttaaaaaatcagaaacaaaacaaagcaaaaccatgagggaaaaaaacagcaaataagcaacaggggaaaacagctatgaaaaaaatatatttgtactgaatacacatacaaactacatcccacatgaaagattaatatcatcaagtaagaaaaatacatagtttaaactacaatgctgaaaatataaaaggaacctggtagttcaatggggatggagaaaacagagcattcctctgagagcagagatcttgtcattattgcaattaatgcccaaacaggttaaatgtggaagaaagtatggaggaaataaccccagccttcctcataccactggatttccacatcaccttttaacttatgcttgagctcccttttgagaaaaaatatttaaaaacaaattggctatgtaacaaatttgtgtgtgtgtgtgtatatatatatgtatatgcttatatatatatatatgtatatgcttgagaaagtggtttttcaagatgtatgtgtacagtacacacatggacacgcttcagtcctctgacttcccatgtgctacctcatgtgtttctcttctcatgaggatttgcaatggatagttgtacaacctggggactgtcagtgactcattggtatcagcatatgctaaagaagctcttgaatccaatcttgaaacctgatctcccttcgtcaacattccccaataccaaactggcccgtttacccatacaaatgcacagtaaagggaagaacagcggtatttttcctagccaactgactctatcatttgtttaatgtttgctggtttttttctggttttgttttgttttagagcaggggtgggagtggctgtaacttcacaatcctaatacagtaaatgttttgcatcttccatgttttatgcaaaaacagacatttaaatcaataaataattgtgccctagactgaaggttaatgtttaggagaggaaaaaaattgttggaattttttctacatttttttgtgaagaatcttttttggaaaggaaggatacatatttttgttgtgtaatattttctatttttgaatgcattttattggtacaagactgtttttttggtgaagacattattt

SEQ ID NO: 561822 - DNA, 131 bp, Homo sapiens
ttataagacgacagaagggctagatctctagatgtttgaggagcacagaaggctatctaggcgaggggacagctgggccaccagataagcatgcgtgtgatgaacgttgagtgtcctgggtttagctgtcc

SEQ ID NO: 561823 - DNA, 421 bp, Homo sapiens
gtttgccgcggccccgtgcggtctgtcacaccctgtgtctaccattatgccctcaggtttggcttaagtttctgtggtaccatgcacgtttgtcagtgaccgtttgttgccggtgtcgagtgtgagaacactgtgacggatgtcaggagcttttagttttaaaaactgtctagatagtgataccattcatagagatcaggactaatacgttcacagtacatgataaatttaggttgattacatttgatatattttcaagacatctatgagtatatatctaagagataaaccacaagatgtacctggaattcgggaagaaagtaaacaagtaaacatttagaattgattagctcacagatagttgaagctatggaagcagaatgagatcttccaggaagaatgcagagaataaaataacaag

SEQ ID NO: 561824 - DNA, 290 bp, Homo sapiens
tgccagtcgattctataggatcccgtttctcctgaatctttgcacagcacatttgcaatattcctggttctctacatcttagatttctgtcacgtattcccgttttattgtataataatcttgtgatattcctcatcttaatttccctggctttggataataagtttgttaactgtaatcctccactctcacatttttaacacaataataatgtgaacctttaagggttgttagggattaattgaggtaatatctataaacttctgaacacagtaagaggagcttgtaag

SEQ ID NO: 561825 - DNA, 110 bp, Homo sapiens
tatacttcctccacgctttatacttctcaacgcttatacttcctcacggcttattacttcccctaggcttattatttcacaccgcgtaactagaaatcgagaccgttctg

SEQ ID NO: 561826 - DNA, 193 bp, Homo sapiens
tgttgctgtagggcgcatcgactcggtccgggctgctcgccctgcactgggctggcctcccagcacagccaggggccgctcaggtaggcggaggggtggtagacggtgaggcgcttctgggtggcactgggctcacttgtggtgagaaggtcgatccagtctatgggcctccacgcgagttgtgtggcctggg

SEQ ID NO: 561827 - DNA, 163 bp, Homo sapiens
taccaagaataaagagttgattgaagatctgatagtttgcatgtgcgtaggtagtgggtctacgtgtcattaggaaaagctgaaccatggaaataaagagaaaataaattgaactcggagctaattcatgccttggaattaaatatacatatatataacaaaa

SEQ ID NO: 561828 - DNA, 335 bp, Homo sapiens
  misc_feature (17)..(17): n is a, c, g, or t
  misc_feature (123)..(123): n is a, c, g, or t
  misc_feature (212)..(212): n is a, c, g, or t
  misc_feature (306)..(306): n is a, c, g, or t
caggttaagggccacgnaagaaggtggcgacgcgctgaccaacgccgtggcacgtggacgacatgcccaacgcgctgtccgccctgagcgacctgcacgcgcacaagcttcgggtggacccgntcaacttcaagctcctaagccactgcctgctggttgaccctgggccgcccacctccccgccgagttcacccctgcggtgcacgcctccnggggacaagtttctggggtttttgttgaggcaccgtgtttgaccttccaaattaccgtttaagcttgggagccttcggttaggccgttttcttncttgcccgtttggggttttccccaacggg

SEQ ID NO: 561829 - DNA, 726 bp, Homo sapiens
  misc_feature (50)..(50): n is a, c, g, or t
  misc_feature (118)..(118): n is a, c, g, or t
  misc_feature (131)..(131): n is a, c, g, or t
  misc_feature (144)..(144): n is a, c, g, or t
  misc_feature (152)..(152): n is a, c, g, or t
  misc_feature (155)..(155): n is a, c, g, or t
  misc_feature (159)..(159): n is a, c, g, or t
  misc_feature (177)..(177): n is a, c, g, or t
  misc_feature (183)..(183): n is a, c, g, or t
  misc_feature (189)..(190): n is a, c, g, or t
  misc_feature (194)..(194): n is a, c, g, or t
  misc_feature (197)..(198): n is a, c, g, or t
  misc_feature (221)..(221): n is a, c, g, or t
  misc_feature (244)..(244): n is a, c, g, or t
  misc_feature (285)..(285): n is a, c, g, or t
  misc_feature (292)..(295): n is a, c, g, or t
  misc_feature (300)..(301): n is a, c, g, or t
  misc_feature (306)..(306): n is a, c, g, or t
  misc_feature (309)..(309): n is a, c, g, or t
  misc_feature (358)..(358): n is a, c, g, or t
  misc_feature (614)..(614): n is a, c, g, or t
  misc_feature (617)..(617): n is a, c, g, or t
  misc_feature (622)..(622): n is a, c, g, or t
  misc_feature (706)..(706): n is a, c, g, or t
tatatggccccgtttcataaaggttactatattctatagagagtgaagangtggcctttctatcccagcttaccctattcttgttattgttcaaattctcctgaagcttgcataactngctgccatcaggnaaatgctattggntagcagangantgcngttctgttaatattaganccagcngggggnncttnggnncttgacattaaaaatctagaaanagaattaaaagaagggaaaaaanaaaaaaaaaaaaaaaaaaaagacttaagtaaaaaaaaaaanaaaaaannnnaaaannaaggnganaacgtcttttcagagatcatagcacatgaagaacccatggacactacanagactatgaacagttagcagaaaaagatctcgtgactaaagtggggatgacagcaaaaaaaaaaaatttacaaaaggaaaaaagttgagaatacaggaatatttacaagatgttaaaaaattattaatcttcagccaaaatgaggccccttcgcattcccaaaacctttgctttcttctcctttcgttcttgctcgcgtttcttccgttgctcttcctttgtctggagatggggttgtttgtaagttttcttgtanaanttaantctgttgacatgttgatttagataattattttctttagattgcccccatggttttagctttccagcagcagaattccccgtganggtctttaatttgtgtgtcc

SEQ ID NO: 561830 - DNA, 456 bp, Homo sapiens
tgaaaggaatggaattgaatggaatgggcatgaatggaatgaaattgtatggaatagaagagaatagaatggaatgcaatggataagaaaggaatggattggaatggaagggaatgtagtgtaatggactggcatggaataaactgcaatgctacggactcaaatggagtaaaaatgtatggaatggaatgccatgaaacggaatcgaatgtcatagaatgtaatggaatgcaaaaaaatggactccaaaatcattgactggaaaggctgggtgtcgaaaggaattgactccaatggaatggaatcgaatggaacggaagtgaatagaatcgaactaaatcgaatggaatggaattgataggaacggaatggaaaggaatggaatgatttggcatggaatagaatcgaatggactcggtcgacgcggccgcgaatttagtagtagtaggcggccgc

SEQ ID NO: 561831 - DNA, 130 bp, Homo sapiens
ggggaaccagagagggaaccagaggggagagacagagcagcaagcagttggattgcttccttgacgacggccagcattgaggcttcctttttccaccaactaccttgagtcttccttctttttgacttgg

SEQ ID NO: 561832 - DNA, 418 bp, Homo sapiens
gctggagtctccccgcacaacgctccctctgccgggtgggcaggggacgcggggtccaggacatgctcgccggcccccatacctccccacacatccgactcctgctcaaaatctggggctgccagcctgggggaagaggtccaggacacgcctcagccctcctcacccttggttctgcaggttggacggcctgagcaaggggcggtgggcccccaccgaagccactgctgctcacagcctgggacgcagccggcccaagaggcccagcggggaccctcccctgaggctagctggctgtgtggcaggtactgtcccaccccgcccagggggcgtgcctgcccccagaggcgctcttccagctgtgggagcaccggcagcagccaccaaagcactgcccgggggccaggtgggagcccaa

SEQ ID NO: 561833 - DNA, 118 bp, Homo sapiens
gctcccttgttcatatcttcccacatttgtagatacttctcaatagggttgtgcctatgtctagattctatcctctgctcacgttctgctttcatctgttcagagtaggatagacatt

SEQ ID NO: 561834 - DNA, 302 bp, Homo sapiens
  misc_feature (210)..(211): n is a, c, g, or t
tcttctccccgacaatatcatgttttaaaaatcccttcacatggtatctaagactccatgatcatctcaattacgcttgcatcttcattttggtgtgcttcggactcgtgcatgcctcaataataatgaattgcttatagtccccaatatattggcacaacagtttcttccattcctgtcctatttaattcaggtctacctctagaaggnncctacccaaattcccaattacctgttttagctaagctcgaatatttgcatcacaaatagaatataaggttaaggttccgttaacatattat

SEQ ID NO: 561835 - DNA, 197 bp, Homo sapiens
taagatattaatggccattttatattcacatggctcccatggttctccctccctcccatggtagcctggcggcccaggggagggatatgtcttccttatatgcttctgggaaaaccagggaacagacccggcgcagagagagtcaagagggggaagatgtaaaaatgggtgtcatggggctgggaacaaatgttctg

SEQ ID NO: 561836 - DNA, 442 bp, Homo sapiens
ggagagaaggagtaggagggagggaagtttcactcgccacacacacgcttttctagttcttcttacagtttatcgcggaccctctgacgttttactgctttaatttcgctgtcctacagatgcatcaagcccacctcacgcgtctgttctgcacatagtcacagtctcggcgtatacatcttgccccatagcttcagatcttctcgctccccattgtacctcgccgtcttcgccctgctgatcccactgctctctgctcgctcagtctcacttatactgctccaccgtctaggctgtgccccatccttcagcctccgcctctgctccgcctcgtccccaggccagctttaaccctttcctgccttttctcctgcctcgcttgacggttgtcctgcagcccctccgtcctctatgtccttaccacgattccttctcgtcccgc

SEQ ID NO: 561837 - DNA, 151 bp, Homo sapiens
agctcggtacctccttctggccacgctgctaaaggaatgtttattactgacacaatgagcagtcttgagaaatatgatgacgggcgagtaatgctgggcgatgcttacccaaggaagacatgaagcatgggcgtgtgatttcttgctccag

SEQ ID NO: 561838 - DNA, 146 bp, Homo sapiens
catagctggagcgctccagtcttcagaagggaattgctgaataggcacagagggcatctgtacaccgttcagacaacagtctgcaaccactaggatgtttacatagatactcaggagcgggagcagtccattcaccctgcaaattc

SEQ ID NO: 561839 - DNA, 944 bp, Homo sapiens
ggagctgtattggcatcataggaggcttcattcatgatttcccctattctcaggctacaccctagaacaaactacgccaaaatccatttcactatcatatcatcgggtaaatctaactttcttcccacaccattttctcggctatccggaatgccccgagttactcggactaccccgatgcatacaccaatgaaacatcctatcatctgtcaggctcattcatttctctaacagcagtaatattactaattccatgatttgagaagcccttcgctttcgaagcgaacaagtcctaatagtagaagaacctccataaacctggcagtgcctatatggatgcccccaacctacaaacattcgaagcaacgtataccataaacatctagaccaacaacaaaggacggagtcgaaccccccaaagctggtttcaagccaaccccatggcctccatgactttttcagacaaaacaacatcacaggcacacacccaaaacacctttttttggggcaccctggctctcgagagaagtttttaacaccactcgttggggggggcggggcccccacagatgtacatgcgacacatcggcgccaaccggggtccccaggagaaccccgggccagcacaacgtggtgtggtctcacccaaaaaaacaagcgcgcggggagacccgagccgtctggacacacccaagagcgcatcagcggccacacgggctcaccaggggagcaacggcatcgaataatcgccgcggcgggggaaaaaccaaacccagcaacgaacgcagacaacaaacacgaagaaagcaatttgcacagccacaccagcgcagtcaccgaactccgacgtaccacccgcaacgcaccaaccgcacacgccatctaaatcataacagccagataccacaccacgacaacacgcactctaccgccagcacagcacc

SEQ ID NO: 561840 - DNA, 1233 bp, Homo sapiens
cattagggttgaacttagaggcactagggcctgggcacatgcaagcttcatgccatgaatatccaccttccgggctaggctctgcaggctgaaggctatgccctccaagtctcctcctactgaaggcactgctgcggtgatgctctgactctgacgggttccgtacgaggaaggggcagacgtacacctctcacaagcaacatgacagttcacgcacctttgaccagggatgcacgaccacgtgggcaagagaacctgtgcagaagtctactgcgcggcgagcgctggtggctctacataacctgccaacgcacgacaactctcacacggaactctacctacccctgcggggcatccctattgaccccaacggcaactaacacgccctcactgaccactcgacgaactggcagccgagactaggcgccccctacacacacgggcccagactcactccccctcacgggccctgacccgacactgaacaacccccagagcccacccctgtctgaccccccaaactagggcccggcccgcacgtggggaaaccggcgcgacgccacctaccggtccaacctcaccggccataccaagccacgccgcgcccgcagccccacacatcaccaaacacggcgcccaccgcccacgcagaacgaaccccgtagacaaccaaaaccctacaccacacactccccacaggcatgaccaccatcaaccacaaagtcccccccggaaacccggcaccccataaccactggcaacccctggcgcaccaacataccccacacctacgacccacaccccacccgactcagcccgccacaccagaaaatccacccagacaaagcccaccgcgacgccacacccaccacccacccaagcaaactcacacaggagccatttcctcccccttacccacatccgatcacccacagcatccccctgccactctgacaccctctccctgtccaacctctctcaccctcaccaccactccactcctcgctccctcacgtgacaaacaacaacaagacggacagaccaccccccaggaacacacacgcacacaccccatcggtccaaccaccacaccatagaaaacgatcgcggatcgaggagacgaacagcagtcactcccaagcaccaatcacccgacactcaccccagacaacagcccgcacacacaaatgatcgaccagcccacgcacacccgacacccccacaccacaccag

SEQ ID NO: 561841 - DNA, 85 bp, Homo sapiens
tatgggtcgcggagggaactttggaggtggtggaggtaattttggccgtggtggaaactttggtggaagaggaggctatcctcct

SEQ ID NO: 561842 - DNA, 430 bp, Homo sapiens
tacttgcctttcttacctaccacgaggcttcttgcctgcaagcgccgccttctcatctgattaggcttgtagtgccgctgcagcagcagctgccttatccacccggagctatgcgatacctggcctggcgaagaatggtgttccggcgcatggtctatgcatatggatttagcttcaacatgattctacaagtttatcagagggttcttctttaggactactgcgatggatctatcttgcgtggagctcgaagggctctttggatctctgggcttatcaagattctgctaagatctgtattaatcatcttgtgcatgggaagattgtagttactcttgagggaagcggctttacgccaagtgccgtacaattcatctaacttccggaaagcactttcagtccaaatgcagaaacgtcccacatgcccacc

SEQ ID NO: 561843 - DNA, 914 bp, Homo sapiens
ctaaactttggcagttcctttgtctacaactgttacagtataacaaggttgtagacaaaggaactgccaaagttaggcccggtgcacacgggacagataagtcattcatataccactttcagtgtttacaatacacagcaattatgcctttaaatgattgtaacgcagcccggcaacaaaagcaacggttacagcaattatctaacaacgaggaattaactcaacatttcgggatgggtctccattgtgcaggccaaacattaaccgggctttacccaaaaaaagcgcacacataaatttacgcaaattattatccagtcaagctctaattattgtcgaacccggctacttacggtaagagatctaatacccttctccacctcttgcggtccaacattttgtagaccaacaaacaccctaattatatcaaccgccgggatcgacactaattccttggccacttaaaggacagcacacagcttgggtggctgggccattagaccaccatcacgagcgcaccgtcgaactcttctttcgtgggccccttaccaaaagttcccctacatgtgggcaagtttacaccaattttggggaccggctacacggcacccgatttggcctgtatcaatcttttaactggcccacgttggggaaaacgctaccagcgacgcagaacacgcgagcactgtgcttagaaacacatcaaacatagcaaccccaactacgaatactcgctataagaagtaaacgccgcctagtagcacctaaagacgcgcgttgtgataaaaacaccccctccgataaaaagagaacgactgttaccaaccatgcctgtgggcgagaaaagagaagttttgcgacatggtgcttcgggctgaactgctatgtgatcgtattacctcacggaactatag

SEQ ID NO: 561844 - DNA, 761 bp, Homo sapiens
  misc_feature (1)..(1): n is a, c, g, or t
  misc_feature (393)..(393): n is a, c, g, or t
  misc_feature (429)..(429): n is a, c, g, or t
  misc_feature (439)..(439): n is a, c, g, or t
  misc_feature (452)..(452): n is a, c, g, or t
ngccccgcccccgccgcgcccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactgggagtatcttcaagtacaaatccctttcagaccccagaaagtctgttcctttttgtagtaacaatgaatctttcaaaggtttcccaaaccactccttatgatccagtgaatattcaagagagctacatttgaagcctgtacaaangcttatccctgtaacacatgtgccataatatacaancttctacttncgtcagtccttancatctacctctctgaactttcccctgaaatttctatttcaccaaggggtaacttgtggttagtatacactggcagcagccatacacagtaagacaaccttaggttagtgagcgcagggcctcgaccaacacaaggaaccaccccggcggcatcttcttgtgtcgcgcgtggcgctcacacacaaccggcggctaaatcgcaacaggggcgcactgacgtgggccaaaaacggtgtgtcccctgtgcccccgactttctttgggtcaccacagggggtggacgaactgacgcccgtgatgccgcgtgtgg

SEQ ID NO: 561845 - DNA, 207 bp, Homo sapiens
  misc_feature (3)..(3): n is a, c, g, or t
  misc_feature (198)..(198): n is a, c, g, or t
  misc_feature (200)..(200): n is a, c, g, or t
ganagaaaacatagcaagacccactctatgctaatttttgtatttttggtagagatgaagtttcaccgtgttggccaggctggtcttgaactcctgacctcgtgatctgcccgccacagcacttcaagtggctgaggtggaaggattacttgaggccaggagttcaagaccagcctgggcaacatggtgagactcttncnccaaaat

SEQ ID NO: 561846 - DNA, 634 bp, Homo sapiens
gggagcaaatccctgagaggagtgcccccgcgacaagcccgccagcccgagcatgcaatgctcacaccaaataagggaagcatgtttctttttcctggtggccctggcgctgcccttccatcagtcccgcctctcccctcccatcagacccatcccgccacggagctttgtgtgagggatctcatcgctgtgatcgctcggagagcattggggagccctcagaacggccgcgggcaccgcatctgcgtcccccacaaggacccgtcggaacggctgaaaaagctgggatcgcgcaccacgggcatcggcgcagtgttcccgccatgctgctcagcccgccacgcagccacgctgccagcacggacgacgacgcacgacaccatgtcgcgggaggacaaacggcagggcaccggaccccccaccaagcgcggccgaacataggaccggactatgtcaagcccaccggcaagacgcatgagacgcatccagcctacccagcctccacagtcccatccctcaccagcacgcccccgaacaaaggcctccagcgccataaagggggacaaggagcgcacgccagggcagaagaccggagataagccggacacacaaaagcacccgtcacgacatcgcg

SEQ ID NO: 561847 - DNA, 202 bp, Homo sapiens
ctgaggtggaaagatcgcttgagtcccatcccagcctgggcaaaataggggatttccatctctacaaaaattaaaaacctagctgtgtgccggccgggcttgatggctcacacctataatcccagcactttggaaggctgaggtggttgcatctcctatgctcaggagttggagaccagccattggcaacacggcctctcag

SEQ ID NO: 561848 - DNA, 188 bp, Homo sapiens
tttctgtcagagaatctgtagttgtatattttaaatacttaagtaccactgaacggttgccaatgtatttgagcacttgatgttactgaagtgacaaatgcttctgaccatctctggctgcagagcagaaactggcagaatccgatcccatcgacccagcagtgtccccaacgcctgaggaccagcac

SEQ ID NO: 561849 - DNA, 143 bp, Homo sapiens
gcaaatgtacgggagcggcggaggatgcagtccattaacgatgcttttgagggactccggtctcacatccccactctgccatacgagaagaggctctccaaagtcgataccctgcgcctggccattggatacatcaacttcct

SEQ ID NO: 561850 - DNA, 173 bp, Homo sapiens
agcaggaacgtgaaccgattgactgaatgacggtagcatatcgcggctaaaagaggtaacccatactacctgtctatcggaccctgtgacctcaaccactgtatgtcaatcatgctggtgatgtccaacaatacacggcttaacgactaggccaccgcgcaaatggttcgcaa

SEQ ID NO: 561851 - DNA, 303 bp, Homo sapiens
  misc_feature (78)..(78): n is a, c, g, or t
  misc_feature (187)..(187): n is a, c, g, or t
  misc_feature (243)..(243): n is a, c, g, or t
cactttgggaggccgaggcgggtggttcacgaggtcaggagataaagaccatcctggctaacacggtgaaaccccgtntctactaaaaatacaaaaaattagctgggtgtggtggcgggcacctgtagtcccagctacttgggaggctgaggcaggagaatggtgtgaacccaggaggcagagcttncagtaagcccagatcgtgccagtgcactccagcctgggcaacagagcgagactctntctcaagaaaagaaggggagatagagcctggttttgaatatttttatatgtatttagtgt

SEQ ID NO: 561852 - DNA, 108 bp, Homo sapiens
gggggggaaaaaaggggggtttggtttttttttcaaaagggcccccaccaaagggggcctttcccttttttaaaaaaaaatttgccttccaaaaccccccccccccca

SEQ ID NO: 561853 - DNA, 266 bp, Homo sapiens
cgcgcgtaatacacacgaggtggacggggagaaaaaaaagacaggggtcgggttgcttcaacaactgcggttgagttttgcttttactatgcaagaaaagatggtgggttgtgctttccacattttgggagagggcggtcagaggaccatcatctaactacttggaccagatggaagaatatgacaaagtggaagagatcagcagcacaaacacaactgcttctgtattcacgaggttgtgagtgggctgcggcagcccgttggtg

SEQ ID NO: 561854 - DNA, 344 bp, Homo sapiens
cgggtatggtataatacgcctcacactcattctcaagccctgacaaaacacatagcctacctcatatccatctgcctacgacaacagcatagccctcgtagtaacagccattctcatccaagacccctgaagcttcaccgcgcgcagtcattctcataatcgcccacggggcttacatccctcattactatttctggctaggcaaactccaaattacgaaacgccactcacaggtcgcatcataaatccttctctcaagggacttcataactctaactcccaactaataagctttttggatgaacttctaagacaagcctccgttaaccccgaggcgctaccaa

SEQ ID NO: 561855 - DNA, 715 bp, Homo sapiens
  misc_feature (93)..(93): n is a, c, g, or t
  misc_feature (472)..(472): n is a, c, g, or t
  misc_feature (575)..(575): n is a, c, g, or t
ggagttttcttcatgactctttacagtacaagttttttgtttttgtttttttaatggtcagatggatagaacaacacaggttttgtttgtttngttttaacttttaaaaaaattataatagataaagggtctcactacgttgtccaggctgaggtgggaggattgcttgagcccaagagttcaagaccagcctaggtaacacagtaagaccccatctctacaaaaagtagaaaaattagcctgtcgccagggtggagtgcagtggcgcgatcagctcactgcaacctccgcttcctgggttcaagccattctcctgcctcagcctcccaagtagcgcggattacaggcatgtgccaccacctccggctatttttttttctatttagtagagatggggtttcaccatgttagtcttgaggtcaggaatttgagaccaggctgggcagcatggtgaaaccccgtctctacaaanaaatacaaaaattagccgggtgtggtgtcacgcacctgtattccaagctactcaggaagctaaggcaggagaatcacttggaacccaagaggtggaggtttgncaggagacgtgagacttgtagcaatatgcactccaaagctggccgacagagtgagactctggtgacgagacaacagagcgaaacagagaaaaaaaaaagaaagaacaacacagccagatcaaacagaaaaacaaaacagg

SEQ ID NO: 561856 - DNA, 793 bp, Homo sapiens
  misc_feature (612)..(612): n is a, c, g, or t
  misc_feature (779)..(779): n is a, c, g, or t
tgttaaattttttttttaaagtgttagtagatatgtaatactccttaaaattttttaaaattaatgtacatataacagtatatataatgataaaaatagtaatgtaactagttttctggttttttttaacatgaaaaacttattggaaggcacaatgatgacaggagaaagatctcaaaacaatatgagttctttgtatacttaaagactctttgatttatccatatagaggtagaagaattagaattttctattgaatttacagaacacaaagataaaagttacataaaattttctcacacatctgtcccaaagctattttcaggagatgagaatgaggggcaaggataaaaggaataattgaacataaagcagttctatgaatggaatgccacttaaaagtatgcctttattatcatttctcaaaataatttttgagccagtcattcctgttacatgctatgttgttcatactatataatcaaattcttttgcctcatttgtatttaaatgtattacgaaaaataaagtgggaaaatatactgaaaatgaaatacatgtagtctttagaaagtgactatgatatttgtataagagaagtttacatgattnttaggtgggaaagcactaactgaagaatatgatttataacaaaaataaaggtaacttattgcagtaatgtatcatgtcattcgtttcctaggagaaaatgaatcacatttaaaatactgaccccttctggttttcttttctcactacttgacaagtaaatccaattntgtgagctcattga

SEQ ID NO: 561857 - DNA, 285 bp, Homo sapiens
tgtaactggatagacggagtaattattacgctatcacagacgggagcctgcatgaaaagtgaaggggactcacccaagttcacgctgctgttactgggcggagatcaatctgtccggggttacctctgcctccggtgctgttggtccgactgtgcttccccaggaagaatctcgagggtgcaggtcataggtctcctgagccaatcgttcgctctcttgcccccctttttttgagacgcacttgctttgctccttgtgggcctcctattgcaacagggtctctca

SEQ ID NO: 561858 - DNA, 399 bp, Homo sapiens
  misc_feature (3)..(3): n is a, c, g, or t
aanatcgcgccgtccgccttgctgcgtcccctttcccggctgctggcccccgccagtatcccgagcggcccttcagtctggccatggctgctttgtagtttgcccagagttggcaataggggaggtgaaagttgggttcaccttgggcaccactgtcttcttgtggatctatctcatcaaacaacacaatgaagatattttagagtacaaaagcagaaatgggctggaataaacttctgaaacactaatgtagtatgctccgtatagtgattgtagctcttcctctcgattcaccatctgctcagctgcaaatctgagagaacacgtcatctgtgcatatatatcacgccagcatttcgtattttgctcatctacataacaagaaatacacatcaacaa

SEQ ID NO: 561859 - DNA, 153 bp, Homo sapiens
catctacattctctttcatcccatcatctcaagacttcttgggtcccttattcctgtcttcgtctgtatccgccgcgtatttgcatgtcatttgggctgttttctaaataatcccccattatgtcctctctgcacttacattgtctctgctct

SEQ ID NO: 561860 - DNA, 997 bp, Homo sapiens
gaccaggagaggactgatacgctgtgtgttgtgtaccaagcatgactgaaagtagcacaactctaataccattatctatatgctgagcccaccccagaaaaagaaacaacgcttgggagaatctgacactgaaccatcagaatatcgaagtcggtggagtcacaccaccaatttagtcataagagaatctggtgaacttgagttcgaccctggagctccaggaaaatggccttggctggtgtgtctgcgcagattcaactctgtggatacaggcaggctgccactcaggcgtaattcccacctagaggagagtatcacatccaccgaagaatcttccgaagaaaatgtcaactttttgggtcagacagaggcgcagtaccacctgatgctgcagcatccaggatgcagctgtgtgagctctccttctgcgggagtatgcataagtcaaagagaaacaagcggggccgggagtatgtggacagagtctgcctgtcctataatgtatggccaattgttgcaaacaaaaatttttcaagaattggtagaaggtgtgttttacatacctaacatgggaattgtgcaccgagatctgaagccaagaaaactattcgacttcatggcccgtgatcagaagtaaaaataggagaccattggtcaggcatgcaccggacatctacagaaggaacacagactggaccaaacagaaagcggggaaagaacacaagcaacatacgtccagagtgaggacatgtcagaacgctaccaccgaacaggtggagcgacagagtactacgcccagacgatatggtacgctcgggggagggcaggcaagagaaagcagcgaggacaaacaatgaagcacccacagtacaacagttaaaactggcagaggacgatcgcacacaacagggcaggccagcacataacagaaatagaagcacaagcaaaccatacagaggcgagaacacagggaagacacacgcaaagacaacagaaa

SEQ ID NO: 561861 - DNA, 304 bp, Homo sapiens
gcccctacggactaagggataacattaggagaaacaccttatgcagatgacgggttgatgggcgcagcaaggcaccatttcacgggtatacctatgtaacaaacctgcatgttctgcacatgtatcgcagaaattaaaaaaaaaaaaaaaggtactaccccatccaaactggggggaccctaccttgtttaaggtcaatgggggcattctgagccaacctacttctaattaacttttcactcatgcactttcatggctgacggggaaaggggtgtgaacagacagtcctgggggagggagctca

SEQ ID NO: 561862 - DNA, 331 bp, Homo sapiens
ccccttccccgggtggctggaataacaggcgcccgttaccatgcacagctattttttttggtagttttaatgggcatggggttccaccatgtgggccaggctggtctaaaactcttgtcctcaagggatccgcccaccttggcctcccaaagggctgagatcacaagcatgagccaccgtgcccggcctaaatgttctccaagcacattacattgtttagaaaaattaataaatacgttgggtgacaggttaacttattacctttaagggcttattaccgtttatcactttccctcccacatttattaaggttataattacccggggaggg

SEQ ID NO: 561863 - DNA, 469 bp, Homo sapiens
tgaatcccagaaaaatataaaccctgactcttgatccacctgcctcggcctcccaaagtgctgggattacagacgttagccaccgtgcccggcccagtggtatctctcttatgaggaaaaaggtcgtctcatatccataccaatttgtcaatttccttcatagttaccactgggttccgagctcagtcggtgacactatattttatccacattgaatcagatttttcaagctaatcatggattgcatctggttgagtctggaacaagccagatcaacagggataaataatgtagcaagtataatctgggaagtacctgaaaaattataggtaatataataaaatggttttctgggctagaagttagtgagaggcatacggagaatctagagttgggctttcatgggtggactaagcttacttaccccgctcttcccgtgcgccctattcggtgtacgtattcttcaata

SEQ ID NO: 561864 - DNA, 177 bp, Homo sapiens
ttcctgtttatacaagcagtcgcactgaggacgtttgcccatagtacttacacagggattgggggaatatttatagtaggcgccgatagtccgttcttcccgagatggtgaatcaggtaggattatgcattttatatctcttcttatcttagacaacgatgtgaacatggagacagt

SEQ ID NO: 561865 - DNA, 1067 bp, Homo sapiens
ggacaaacattcgccatgagcgtctatgctctgtcttttccgcgtgagattgggcttgagtgtaatcctgtgtgttcgaatgatagtcactatctaggtatgagctgcatcgaaagatcatctttgtcatctagtttgttgagctatcccgatgctctcaggcgtacacagtacagctggagagaagtgaagggcagccattagagcgataaagaactaacatccagtgttctgtgactgtagggtacagtccgatctgtaaacatgcctggaacgatagactacctttggaaccagagtctatctgtatcatatagtctaacagtatcatagatcgaccgctgtgggacgtaacagtcttcgatattcaggtacctcctcttattcaaccttccctacacatgggggattctgacgtaaacagtctggtctgctgagtggcttccccagtttgcacgatagttgaaaacaaatattgcagctcttggatcgacagatagagaacatacgcataaaagcatgttccaaagaaagtgatacttgctgaacagaagctatggagtggtctttaggcattaaagactacatgggtccaaaataatatatttgcgattactacatgagggtggttaagggtcatcaagccacgtgccttcagatagtacagatggcacatatccttcgaacctgggtggacgtcaggatggactcctaaaccaatagacgtggcatgcacctaaccaagagtagcacaaaatctacgtaggtgcaacgaatacgcaagattcccaacgctcccacggaacaaaaacacacatccaaagaacccacccggaacagatacggcaacagggccaccaactgaaaaaaggtggcactgaaaaaaagtgtacagaaagcattctcacagggtcacgaacaaataaggccataatagaagtcagggagaataatgccacagaagtgaacaaaggtaccagaacggagagacaagcagagttaaaacagaaggggagagagttaaatcacggaacgaggtaccggagagacgaggggaaatccaacga

SEQ ID NO: 561866 - DNA, 654 bp, Homo sapiens
tgcagtggctcacgcctgtaatcccagcaccttgggaggccaaggagggcggatcatctgaggtcgagagttcgagaccagcctgaccaacatggagaaaccctatctctaccaaaaatacaaaagattagcagggcatggtggtgcatgcctgtaatcccagctactcaggagctgagacaggagaatcacttgaacccgggaggcggaggctgcggtgagccgggatcgcaccactgcactccagcctgggcaacaagagcaaaactccatctcaaaaaaacaataataactttcttcagttcaaaaataacctaatagccatttcaggactaagtccacccaccccaactcaataattctaaaatcacttggcttggacatctctgctcattagcagacagtgcaagtgctggaccatctctccaatgccactctctcaccgaatcaacaataaacactaggactttcccccccgaacacttgtccccttctacaataggacgtatcctataactccaataggaagctatcctatacctcccccgctatcccccctcggcccaatcccctacggacctcccagcgaccctgacactcgcttcctcatgcccccctcccgtccctcccgcctgctgctcccctgcctccgcc

SEQ ID NO: 561867 - DNA, 159 bp, Homo sapiens
taccctgctgtacatagtattgatgtctgcactgccagcgtgctcggacatacttctggtgggcactgtgcggaaacttgaggatgaactcagtgcagctgcatgcacttgaacaggcatggcctgtcctcctcacttcagtgcaatgtccactcgacc

SEQ ID NO: 561868 - DNA, 256 bp, Homo sapiens
  misc_feature (28)..(28): n is a, c, g, or t
  misc_feature (44)..(44): n is a, c, g, or t
  misc_feature (139)..(139): n is a, c, g, or t
  misc_feature (161)..(161): n is a, c, g, or t
  misc_feature (188)..(188): n is a, c, g, or t
  misc_feature (195)..(196): n is a, c, g, or t
  misc_feature (201)..(201): n is a, c, g, or t
  misc_feature (207)..(207): n is a, c, g, or t
  misc_feature (211)..(211): n is a, c, g, or t
  misc_feature (224)..(224): n is a, c, g, or t
  misc_feature (231)..(231): n is a, c, g, or t
  misc_feature (242)..(242): n is a, c, g, or t
catttagtaatctacgaaggaaatatcnaagtgtttttcaagcntgttatattcagtgtgtgccgcaggattgaaataaatgacaatgtaattatgaattcatgttttagagctgtttactcattagtaaaggaccgcnatgttagtaagaaacctatganatgtatgttaagattcttagtattgtncagggannaagcnaatgcntganaatatgtcatgtnctgaaanttaaacttacntcggtttcggttat

SEQ ID NO: 561869 - DNA, 199 bp, Homo sapiens
gcttggctcctaagctcaaggatacacagctattacttcttctcattagaaaacatcatctgcgtacggggcagtagagacacacagaagaggaaaaccagccaccccaatctaccctcagaacagtgtgggtttgggtccattttccaccgtctctcaggactgagacctggtggacccttcctccaggccacagcca

SEQ ID NO: 561870 - DNA, 217 bp, Homo sapiens
gacgacgagcctgggtaacataatgaaagacctgtctctactagaaagtacgagaataagctgcgggtggtggcgcactgatagtcagtcccagctactccagaggctgaggcatgagaatagcttgaacccagggaggcggaggttgcaatgagcctaatgagcctagatcgcgccactgcactctagcctgggcgacagagcgataccctgtctc

SEQ ID NO: 561871 - DNA, 496 bp, Homo sapiens
  misc_feature (25)..(25): n is a, c, g, or t
ttaagggagcaccggagaaaaggangaaaccggaagcgagaggatgcaggagatgatgatgataaggagggcgccattggtgtgaggaacaaggtggctgggggcaaaatgaagaagcggaaaggccgctaatgctttagaaagacttctgctcgcctgctcgccagctgtgagattctgtccagagaccactcggccagctgggagaacgttcctcgggattgcagtgtcattgcaatgggacaacttttacagtgttgacacaggactggccgctcttcagcttgcattcctcacctgtgacacaagtgccgtgtgctcttcatgctgcacctctgccttcccacctgcaagccacggcctggcggatggagagcgctgactgtagttaactgtaaagcttctacagaatggtgtgtacgccaccttatctcagccggcattcagcctgatgtgggtcaataattattatgattaaagatgtatttttattaaa

SEQ ID NO: 561872 - DNA, 1010 bp, Homo sapiens
ggtcccctatatctgtctgtgggtggggacattggggtccggaccgttcagcaccaagacatggcagccccttgagcggatgactatggtcattgaggagtgtgcaagggtgcctgacaagcgatacgttccgtcgacatggtcttcctcagcgaacaggaatgtggtgcagtccgaagccaggttgctgacacggatgtgtctcacaagagcccagaagcaagcggtagacaaaggcacaggaagcaagcagcggcctgctgatgcgtgtggacctccctgcagccccgggggcagtcccatatgataagcagttacctgtgtacgtgaacaccacaaagccatgatcgctggccttgccctgctgagaaacccagagctaggtcctagagatcccacttgtgcatatgtaggctggataaggccatgggcggcaggccagccatcccacctctttgtccacgatcaatattccaaagtccttgcatttgatgctggtgcagatcgaatccctccatgttggcacgttggccatccagtggtcatggctttctcccagagtgacctgaatgcaggtccagattggcaagatggccttgaacctatataggccagcttgggccaggagcgccgcgaagaagcacgggactatgcctaccgacgttcatactggtcggacgttcgccagtacaggatccaagaactgggcaactgacttggtccggcccccaagtcattatgccgggaacgactctgaagcgctaaccaggaggggtaaaatagcctttttggactccctgcaacggcgtgtatcaatatagtccccaacgccttgtgtgtggcccgaagagaccatgggaggagcaactaaaaggccagatagctgggatgggccaccaacggcgcacagtattcccaccacgcaaaaaatatcgcgcggaactatatctgagtagcacgtagtcagagaaccgctatttcgtctaacgacagccctgctagcaaaacgt

SEQ ID NO: 561873 - DNA, 236 bp, Homo sapiens
  misc_feature (58)..(58): n is a, c, g, or t
  misc_feature (78)..(78): n is a, c, g, or t
  misc_feature (84)..(84): n is a, c, g, or t
  misc_feature (158)..(158): n is a, c, g, or t
  misc_feature (210)..(210): n is a, c, g, or t
gggttctatgctctttcccatacccggtctccgcctcatctctctcaatatgaatttntgttcccgtgagaacttctngctctngatcaactccacggatcccgcagacagctccagtggctggtgggggagcttcaaggctgctgaggatcgagagncaaagtgcatataattggccacattcccccagggcactgtctgagagctggngctggaatatacgaatgtgccagtat

SEQ ID NO: 561874 - DNA, 144 bp, Homo sapiens
gccgccgccgagtcgcgcggaggcggaggttgggtgcgtcaagattcaacttcacccgtaacccaccgccagggccgaggaaggctatggctggtgggaggtgtactgggacgttaatactggctttacaagagtgttcggaag

SEQ ID NO: 561875 - DNA, 875 bp, Homo sapiens
  misc_feature (131)..(131): n is a, c, g, or t
  misc_feature (514)..(514): n is a, c, g, or t
gactcgtgggtaacttgcttttgggagtcgcatcggtatggcgtacgggctgcaatgattggcctccgtactcatcctcaacagacgacatggaccaatgttagggagccgatgtgcctccggtatgctangactctgtgtgccgattatctgtcacctggacgtaatggacgggcattctatgttcccaacatcacctttgtgtcaccctgtgtgtagaaagccttcgaaagcagctagtgccatggaccctttctttgacatgcatcatgatggtgtccattgccattacatcagtaggggtaatagccgaagtggctgttagcaggagccaatcagtacacctttcatctcgaggctactgatgaacccaggggctttgcattcatagcacagtcgggagacatggcgatcgcaaggttggcgcttgccatcaagaccagagaaccgtcagattgagtatttggcaccatgggcgtaatcagtattgatattgtgccttggttaatgacangtggaaccggggttcggagggcagagattcatggaagatatgatgccaaaggttcactggttgaggacccagtttcccatcgttggatatagagctcgatggtggagtaggtctgacactgtccataaatgtgcagaggcaggagctaacatgatttgtgttcggcagtgctatcatgaaggagtgaaagaaccctaggattcttgggatcactctaattgcgaaggtggttggttcacgaagcctggttcaggaaacgttctcctggaccggggaaaccagtatggagcccgggggttcccggttccttgaaatcttcccctttactgggaaacgcgaattttgacttacaattcccaag

SEQ ID NO: 561876 - DNA, 152 bp, Homo sapiens
gtaaagataccacagagtgcaggcacggagttggtctgtgaggcttatttgatgtaagaccagcaactaaagtcaaggcagggtcatctgtgataatacagatgtcaccgcaggaatcatgctggcatgtggactcctcataagagtcgacc

SEQ ID NO: 561877 - DNA, 588 bp, Homo sapiens
gcttctgcatctagggagacatcgtctttgaattgttctgtgttgggctgtaccagcccagatgtttgacgtctgggagaaattgagagatcaagctgtgagacatgggagaaatatttaggaaataatttcgcatgtgtgtgataggtgcgggtatgactagggagttatctgtgtacaaagaaataagaagtcgatgaactattcccgcagcaggtgtcttttcagtctgggaaagacatccataaagaagcagtacagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaagtgctgggctgacggtgcagtctgggtgctcgcccactctgtccactatctgggtgcatgatcttgagcaagtccttctggtgttgcttctccattgtaaccaaaggtgttgctgacacacaggggggatctctaagtcaccgg

SEQ ID NO: 561878 - DNA, 323 bp, Homo sapiens
  misc_feature (182)..(183): n is a, c, g, or t
cttggaacccgccgtcgaagccgccatgaaactcggaacctgccatgtcgaaacagcaggctggcacgtcacaagattctaaaagcacaaggcatgccgaggctatggcacacagcccttggggaagccgagtttggtcgatctcaagaccacaaggactacacctaaaccaccccggccgnncgcgaatcgcggctgtgagatgagaacaaaagaggtctcataaaacatgccgccatcgaccagcagtactgaggccataacccacactgggccacgatcaaccccccgacaccccattcgggtacgcggtgtcatcagcg

SEQ ID NO: 561879 - DNA, 181 bp, Homo sapiens
acagacgcctccgataacgtacgtaacgagcgcctccgtaacgagcgacccccgtaactgagccttcctgtaacgatgcgcctccgataacgagcagctcgacccatactcctgcacacatccggattcgaggtgatcatgaacaccgacatcccatttcgactcaggccgcagggcaaaa

SEQ ID NO: 561880 - DNA, 1085 bp, Homo sapiens
ttttctcgctagttgatagtgtttggtctgtctctgtattctgtttgtctcgtctttgtttctgcctgccttcgctggtctgttgtctcgctgggctgttggtctggccgttccggtagtgcgtttgtcgtggctctcgtgctgggctcgctgtgtttctgtcgtctgcttggttgctgatttgtgtgtagattctgcgtgtttgttatctcgtctcttctcgtgctggctgccgttctctggtttcctttgtcgtcttccgtctctcctcggtctcgtcactcttttgctcattttgcttcgttgcctgtgtgtttgtgtgtgtggctttgcctctggtgtcgagtcgtgcatctgttggtgtgtggtttctgcttctgtttgtcacgtgttggtcagttctctttcttgcagtggtcgtcagtgtggtcgtcttgtgcttgcagcggggtgtgttgcgtgcgccggttcgctggtgctgtgccgtcatgcatgtcggttctgctggttcatgctcgctaggccgttccgtcgggctcggcgcgttggtttgcacgcgcatgctttgtgtccttctccctcccggtagtttgacgctgtgctcactctcggcttcagggatgacaagctgtcgtcagtcttcgtccctctattcggggcccctctggtgttccaatgggtctttgattcacgcgcagggtcttgtgttgttgccatcttggtcacagggttgacacgtagttccattgctccgtatgtgggctctgtaggggttgcgatgcgacgggctatggtggttgtgacattggaggttgatcaactgtgggccttcaccattccactgcaggtcctggcgtggttcgtgatggcgttgatgtggtggatgatgcacatgcctgaccaggcatatctacccggaatttctgctgccgccgccgccgctggagtaggactcggcgtgcgcaggagatgccgctgctgccccgtgacgagtgtctaacttcccgggataatcctggtacatgatccccggtgggggccgacgaggaaacagggtgttttgcttcccacgtcctctccacgcc

SEQ ID NO: 561881 - DNA, 646 bp, Homo sapiens
tcggcccggcagtgtaactttgtgcaactgcctgtacccgtcatccagcagctctaccactaggcactgtggcctggactgctccaggatggtgctgcggtacctggtgccagctggacgacagtgagtttagagagagaccctgcagaaagctgcacgctgaccaggagacatctggaccatcgacctggcctacctgatgcaccactattggcgtgaggcaccgcattctgtacccagaccctgggtgtcgcacaagggctacaagaaccagtccttctacaggacgcactattgacacagcaagagacccgggtgaatcagagtgtttgcacaagcaaaggcctagcacaggtagctaggtcggcagcaaatgcacagtgagtgtgaaggacatccaggcgcacctggctcagggccatgtcggccatcgtgctggtgaactacgggggtgctgcactagtgacctgtgctccagcccatgtcaagtactagctgctacaccacacagatggccaccacatgcttctgccgcactcctgactaccagggccacttcatcgtgctgcgtggctacaaaacgggccactggctgcatcttctacaacaacccagcctatgccgaccccggcaatgtgccagcagc

SEQ ID NO: 561882 - DNA, 428 bp, Homo sapiens
actaatacatactaaaaaagttaattaagataatataactttgaaaaactgacttataatgaaatagaaatatttaatagcccagtaaccctggaagaacctgaaaaagttttcaaggctgggcacagtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaagtgacttgatttaagggaaaaaatgactgg

SEQ ID NO: 561883 - DNA, 450 bp, Homo sapiens
  misc_feature (5)..(5): n is a, c, g, or t
tctcntcttatgaataatattccactctccgatcatacaatgacctatcccagttatcaaaccattcctctctttgcacatatcctttaaccacaatgagacatttgaactgttaactttttcaaatatcagcttttgtctttctcattatctttcctgttcaaactgaactccgtaagtgatctcttaaattaaccttatacaagtattcttgatcttctgtcactcttgcctttctggacacttgtcacacaaaaccatacttaagaattaatcctaacatattcctgaacccttctcacacctgatttgctggacatctgtttaaaatcattcaagtatgctatattaattgatagtctttatttcaagtgatagaaaatctaccccattatcttaggctaaaaactgtaaaacactgatgaaagaaataaatctcggatatggatg

SEQ ID NO: 561884 - DNA, 1386 bp, Homo sapiens
gtgctgtgctcatggtgcatgactgcccatgggagcagtgagctggcccagctgtgaggcttggtgttgggctgggaccgagccagctacgactgccctgggagctggcactgtggctgtgagctgtgctgctcactgcacctggaggagatgcaacataccatctctacctgacgaagaaaagagtgctgcctgtggtcaactgccattggcctgtacatgcgccacacttgagggtgcggacacaagagtggagacaagaagtcggggacggaacttcttaccggaaaaaggtgatggggaaccaggcggatcggacgcagccttggcaagagcaagaaggggctgagccagcatcctgtgatgcccgtcctgctggaacctggggagagcccccagagttccacgattcttactgacacctcaacagcacgagagtcgatgccagagaaaggccacagtgactcacagacctggcaagggacggcagtggagggattgaccatcgtacgagagcacccggcaacctatcggcgcgactcacatggaagcagagcacacacccactgagaactcactctcactgccagccctacatgcacccttgagaacaaagtacgcagtgaagcggggaaacccaggcgttgtgttgagaatgcaacaccgcctgcgacagatagcggaggacagttcatcccacgcgagaggcacgcacagatagaagcactgagcagatccctaggacgcacacacaagacagagctaacacaaccgcacaggagagacgccgcagaaccgacgacaagacgcccggagcgaccgtggagcaaagaagcgaggcgaagaccaggcgcagggcactgaggacgcgtgtaacgcatgagaagcgacaacagaaacccagtcacgaggcagagcggatacaaccacaaacagcacaagaaacaccggtgcacacagcagtgcgccacgcgagcagggggcggtggacgcactcggcgaggagaatgcagatcaacgcaaagggtggggggagtacggagcacctgggtaccccgagtggggccacataaggaggaggagaggcgaggaggaagcagaaaggatagcagaagacaactaaatggtacagaccaatacacccacccgtacacacgaacaccacagtaaactcgacgacattcatcttcctcatatttgtgccactagcccaccctataaacacaagagtagaaacaaggaaagaaacagaatcctacacctcgaaagataccctagcaacaacatatataccacacacgaacacaaccagacatgaagcaacatctcataacattctaacgcctccttatacgaacacacgccgacaagacaaactacatataa

SEQ ID NO: 561885 - DNA, 147 bp, Homo sapiens
ccaagcccctacgtctgtgtgaaggcaagaacagctgggctgcgggaacagcatgcgtacgcgtctcatcaactccactgcggaagaagtggccatgcgcaagttgatgcgcacagtgactgtggttgaggacgacgagaatgagga

SEQ ID NO: 561886 - DNA, 190 bp, Homo sapiens
  misc_feature (179)..(179): n is a, c, g, or t
gcgtttttaagtaaaccccgatatcattaccaatccctcatggaaaagctatacatcaaagaaaacatctgtgtgtcaaagagagaagagagaaaaagtggcatcagtgaatgagttgatcaggtttgctcatctactaccgcttgactaagtctgttcatgtaatctacacatttcanaaggaagctgt

SEQ ID NO: 561887 - DNA, 121 bp, Homo sapiens
agtcaactactacaagtttttcacctgctgcgtccaaggcttcctgataagctgtcttgctctcgatctgcttcaccatcttggctgctggtgtctgacgtgcggctgtatggaccgatgg

SEQ ID NO: 561888 - DNA, 211 bp, Homo sapiens
acacggtactcgcttttctcgtcggttcggtctcggacggcgtcggggcacgtggggctcgtacaaccggcctgatggggcttgtgcggtgtgtgatgctcgggtagcctccgcgtctgttggcgccctcaaatgtgcatagtggggattttcttatccgtttgttggttaggtagttaaggatctagggctgttagaagtcctaggaaag

SEQ ID NO: 561889 - DNA, 487 bp, Homo sapiens
  misc_feature (232)..(232): n is a, c, g, or t
  misc_feature (260)..(260): n is a, c, g, or t
  misc_feature (384)..(384): n is a, c, g, or t
agcggctgggcagaggaacccgtggtggacgagggcgggggctgaggagggcggagagctggggcttgggtctgagacaggactgctcctaatgcgtttgactgccgattttggagaagcttcattatctgtgtgatgcctatggttggtgaccacacgatggataatatgcctaccatgctcagtcacagtggtgtaaatatgtttgacacaacctcggagcaacagcgcntccaatcgctcatgcgacgcgattcccnatcgcggtctgactctagacacgcatgataccgactaagcggtggacttgctcttgggctcttctttcaccccgatcatgtaaggataagacgtaagcctttcgattgccgtctaactttggangacacatgggttgtagacctatggatgggagtgtcgatgcgcaccacagggtcactagagcggacggctgtggatatcccgatgggggccaaggagagttagc

SEQ ID NO: 561890 - DNA, 80 bp, Homo sapiens
acggccgtgtattactgtgcgagaaaaggtggttattactacgactttgactactggggccagggaaccctggtcaccgt

SEQ ID NO: 561891 - DNA, 1284 bp, Homo sapiens
tctccgacccggtgtgtgtcgccccctttggggggtgctcttccagagacgtattggatcgccggtggtattctcgctccgccgtggtgtttttaggggtgttctctgtgagactcttgtggcacgagtaatttttggtccttggggcatttgtttttctgacggccactgtccccctgtgtgtggggtgaatgagatgtgtcttccatgaaaagcgggggggacggttgtgtgttgctggcgccgttttttgcgggggacaccgagatttgttcttggggtgtaaatatgaatagccccagggggccattttaggagggtttgatttattagaactgacctttttttcttaagggccacaagaggcttgagggatatatggggaaattaagatatttaggggagagcagagataaaatagtttgacttggccttgggggtgaaccaatggggcacccagtgaaaaggtgggtgggtttctttgcccagggatagtggaggttgaaccccggcccacgccgtgtgaaatatggggggtttgtgagaggtgagagtaatggggttttgtaaaagtgacgaggttttcttggcgccccacactgaaatatttgtgtgagcgcagccccatatatagtgatgggaaatttgtaaaatccggttcgccacacagcccccaagagttgttatggacacccccccagggaatgggttattgggagattttctacataggtgtgtaataagcgctccaaaatgggggaataaaagccactggaatagcttgggagatgggccaccccatttatccctctcggaatatattctcttatagcgccacttttttccatatttaaaagagcttctcttgtttatagaactctatattagaagactctttaggccaaaataccaaagggatatttgcgcggccaaaataagaaggcgctctatttctgacattctttatattgaaagtgagaacacctcgtgataacttgtgtttcttctccccacagcggaattaagtgatttgaaaatgtttacattgcctccgagtaaagtgtttccacacagttccctgagaattcttggccgaaggttttactgtattgttgccaccaactttaagataaatattttgtctccaatagtcaacattttttcactggaataaaaaatttaactgggtccaagaaaacacacctctttgaaaatacccactgtctctgtgtgtttcgagctgttttttagagcgccaataaagatggctgacgcagtttccca

SEQ ID NO: 561892 - DNA, 243 bp, Homo sapiens
  misc_feature (99)..(99): n is a, c, g, or t
  misc_feature (160)..(160): n is a, c, g, or t
  misc_feature (205)..(205): n is a, c, g, or t
  misc_feature (219)..(219): n is a, c, g, or t
ccgctctctctctctctctctctctctctctctctccagcaatccaaaagagtctcaaggatccttcaaataacttcaggctccataatgggagaagtnaagaacaaagacttaaggaacagcttggcgctcaacaagaaccagtgaagaaatccattcnggaatcagaagcttttttgcctcagagcatacctgaagagagatncaagatgaagagcnagcccctaggaatctgcctgataa

SEQ ID NO: 561893 - DNA, 357 bp, Homo sapiens
atagtctcagctgtcactgttgaaacttatgccattagtttattcacttttgtcttgcgatttattattacctttcctgtttttaaaacactcaatgtcactaaaacctttatcatagcaaatttttaggttatttaatttttcaatattgagtaaatggttatttgtttttagaaggcattctatttaagctccactctattttttatatttttcccaagttcacgttgaacaatccttcaaacattttatctcagcaaatagtcgctataggaggtaagatcaacaattattgacgtctcggaaaggtatttaatataccatacatacttgactcatacgttctggggtttgaca

SEQ ID NO: 561894 - DNA, 243 bp, Homo sapiens
acctgtatccaccaccttgggagggattgcgccactgcactcctgcttgggtgacagagcaagactgcatctcaaaaaaaaaaaaaagaattatttaaaactgactctatgggtaggtttaaaaaaagttattaagccaactagtgaccttctttcgatgacatattctcttgatgtacgttttcttgtaatttttggagacggagtcttgctctgtcgccagattgattgccggttaccgag

SEQ ID NO: 561895 - DNA, 498 bp, Homo sapiens
ctcactctccttcaagcctgctctttccctcagtctgcccctactccagcctgcccctaacaggaccccacaggccagacaaaaccgtgggactaattaacacagaattccatctgaagtcattttattatctgaagagttggaactagatcccagaaaaagaaacacagacaaccaaaggaaacactcaaaaatactagtctgggccaggagtggaggctcacgcctgtaatctcagaacttttggagggccgaggcaggtggatcacttgaggtcaggagttcgaagaccagcctgggcaacatggcaaaaccccatctctactagaaatacaaaaattagcctggcatggtggtgggtgcctgtcatcccagctacttgggaggctgaggcaggacaatcgcttgaacccaggagatggaggttgcagtgagccaagatcacaccactgcatttcagcctgagcaacagagcaagactccatctcaaaaaaaaaa

SEQ ID NO: 561896 - DNA, 176 bp, Homo sapiens
  misc_feature (120)..(120): n is a, c, g, or t
ccatcatagtccacccccaggtttatggaggggtcccctactattaggacttttcgcttcgaagcgaggctctcaatcatgaaaattattatattactgctgttagagaaatgaatgagncccgttaacccaagggaattttggaagtacaggatgtttcatgtggtgtatgcatc

SEQ ID NO: 561897 - DNA, 231 bp, Homo sapiens
taccctccgcgaatttgtttagaggagctctccaactgcaggtgactggcaagaacggcaggaataaatagttttttaatgaaaatctcttgctacatggcttaagtgctacatggcagtcaagaaatccttggagatctgccctgagcatccgattatggctaccttaaggcactcggcagaggctgatcagagcgacgagtctgttgagggatctggtcatcttgcttt

SEQ ID NO: 561898 - DNA, 356 bp, Homo sapiens
cccagactgtcgacaggttgcaagaatgtgtgctatgaccacttattcccggtgtcccacatccggctgtgggccctccagctagatcttctgtctccaccctcagcgctgcttgtggccatgcatgttggcctactacagtgcacgaaaccactcgcaagttcaggcgactagagaagagtgaatgatttctatgactttgaggacattccatacatgccatcatacggttcggatagaggggtcgcttgtgtgtgtgcgttcacctagcggcatctttttccgcatcatctttgcagcagtctttatgtatatcttttacttcctttacagtgggttccacctgccctgggtgt

SEQ ID NO: 561899 - DNA, 144 bp, Homo sapiens
tactgaccggataatgtttgcactagtagatccgtctctcattcaagcgggaaactgcgaggggctgagcaggtgctgagaccatgacccatgttttaccagaggggcaagtatttttttttcctctccaaaagggaactttaa

SEQ ID NO: 561900 - DNA, 243 bp, Homo sapiens
  misc_feature (164)..(164): n is a, c, g, or t
  misc_feature (218)..(218): n is a, c, g, or t
gggggtgaatggtaccactgctattgcctaagggtgtagtctgaactgaagccagttgccgaccgtttccccaagaaggttggagacagaagcgttcatcagtcctgaacccctccttatccaacccagcccctctctccagccagttcaaccctgggaaacancagcccaatcactcattcagaagccctctgagcaaaatggtgctccggattctnaaccaatacagcagcactgtttaag

SEQ ID NO: 561901 - DNA, 212 bp, Homo sapiens
  misc_feature (124)..(124): n is a, c, g, or t
ccactgcaactcacagtgtgtggtgttttcacttcgatggtacccacttggtcttcgtccaagatactcttgccgttgagctggtactcgtggtcacttgccacaaagcaaaatgggatcatcntccggaacttctcgttcaccagccgggtctccgacgtctcatcaaattccttctgggggtacacgtcgactgccattggggcagcggg

SEQ ID NO: 561902 - DNA, 453 bp, Homo sapiens
tcaaaaagaatgatacaacttttatttcccatggatttaacagatactttggctacatagttaatgtattttaatgaaattttttccattggtatgaagtccatccagccttatacaatttataagggtgatatgttgggtagtgtatctataatctttaaaaagtttagagttttgggaagtgtacagtatatgaggtaaaatcaagattactttaaaaatggttttctcctcttgcactaaatttttgcagtgaggctcaaatggcaagtatactattaaatgacttttactatcaaaaataggaagttcattgtgaattactatgaaaaacataagccactgtaacttgacacagtggcactttttaccattttcagactttcacctattattataaatctctgggctattacactcagactcatttgtcactgccaaatgtggcacttt

SEQ ID NO: 561903 - DNA, 1194 bp, Homo sapiens
gggctcggcgcgtcggcgcaggtttccgcagactgagggtggcagctccgcggcggcgtccggggtctccagtatgggcttgacgctccggtgctcgcacaatcccccgactcggcatggcaactgggcgtcccatccactgccacggagatccgcggcagagcgccgacaacgcagaggcgcgccgacagagagtgacatggagccccacttgccccatgtgaagatggaatagaaagaaagagaagggacccgacaagtagataaggaacgcaatgacacagggatgacgcagagtcacacgagcccgaaaaaactcctgacgaaaagacatccagagtgaacgacgaaacaggcaaggaagataagagcaagacacgggaacaagaccacgacaaccacgcggtaccacaccaggggggaaacagggaagacaagaagagggcgagcaacgaggataggaaggaccctcacgtgcaggaaaggcagaggcataggcacaagagcaacggaagccgaccggacccaagcgcacgtggggcagacggaaaaagtcgcatggaagtcagagacggatctcgcggcaccataggggtggaatataacaattggatccggtcgcacggcagcgaactggcagtgcagagtgcacacgcaaagacaatgaacaaggcgatgagcgcgaggcgtggccaaacagcgcgcgacgtcatcgacaatgcggaccgacagaaacagtacgcacagggagatgagtagacacggaaggacgaccagaagagggggacctgacacacaaggagcgcgcaataggcgccccgaaggcggagtggataacacgtcaatgcgtaacagccagcagagtcacaagggaacgagacgtacagacccgcggacttaggcgcaagcgaaggagacaggcgcgacggagaggcaggcaagtcaaccagtacccagccgaagggagagacactaaaggagcgacaggaacacaccgaccaagagagggagacaccgaaagagaaagcaccagggcacgaaacagaggacgggacagacaaacgcggccaccaaagaaaacacaccccacgccacaaagaaacaatgagcagctacaacgaaaagacgacagcgaaaccacacaccacacatggcatggacacagacagcaaactagagagcgcccaaatcaca

SEQ ID NO: 561904 - DNA, 934 bp, Homo sapiens
gaacaggtgagactggactcgaccgaactgaaggaagggaccaaaacctcggtgaactctgcaaccctctcccgaatactcctcgctgttgccggcggcttccagcctgtcaaactcagagggtgctgcctggatccagtccccagcaggataaccgacctggggtacaaacgtcggagggctacccaaatgggcaggagcaatgccgcctggagcactattcgtgatcccaaggactacccctttctccacctgctcctcctccctctgactcggaacctgcaaggatttttcttaggcgagcgccttccccattcctggaagatcccccggaatctctccaagcacgaggacagcaacgtccctctaagacgctactgcaccatgtgctagtgcgcgcagtctcagagatggggcatgtgacgtggcgaggaacagggtgtcttgtcacagcgggatgaacaaggctagccgtccccctaactaatcctagactgagacgcacgtcaggcgcacgcccgcaataggcggcgaggtgacaagtttggagtgcgccccctttcagtactgcgcgttctaagacttttggcggagactttcttggcaaaaaaccattccccaaagctacgccttcccctgctgagtaattagccccattagcgcccggagatttcgacaaggcgttgcgacgagcccgcgatgctcgcgcaatgcgtcctcccaaaggcaaattagagtgactcacaggcgacgcggttgatcgagtttaccaggcttagtacagccgagacgtggggatcggggatagcaagtcgaccggttagaacctgggtcggccggccacttcgcgggtcctagaaggtcagtgtagcgcgccgccagtagttgcctttccttcttcccggatttcgcgactatagcgactaggtcccct

SEQ ID NO: 561905 - DNA, 838 bp, Homo sapiens
tttgtttcaattgggcatttaagtttagtagtaaaagacaattgaaacaaaagttctgagaccgttcttcgagccgcgcatgttgcgcatctgcaatggatggtcgtgcggaatagctccagttgctgatcacgaggacataagcagaccgtacagcactgtagcccaataacttgaaggcccgcaattccttccgcgtacaacggactgattcaccgcaagacatgtgggcgtggagccggcagcgacgagctaagtgtgtcgtggtggtcattaagcggagatccggcgcagaggaagactgccacctcctatgtgcggaccaccatcaacaagaatgctcgcgccagctcagcagcatcagacaatgatccgcaagaacaagtatccgcccgacctgcgcatggcagccatccgcaggggcccgcgccatcctgcgcagccagaagcctgtgatggtgaagaggaagcggaacccggccacacaaagagcatactgagccccctgaccacagagcaaaaaagatccggaatgggcttttcctccaaagctacagcaacaaaacaggcgacgcatcagaaaaacgagaggaacagacaacagacggacccaacaacccccgaaagaagaggctgattctggaacaccacggtagcaggaacccgaaacagacaaagagggcaaagacacagagagcgaaaacaaaccacgaaagaccagagcaaaacgagccacaaacaccgaaagacagcgaccaatacaaacgggaaacggcaaaccaggaaacacaaaccaacgcggaaacaacgaaatccgccgaaaaccatgggggccaca

SEQ ID NO: 561906 - DNA, 1125 bp, Homo sapiens
  misc_feature (384)..(384): n is a, c, g, or t
aaacctcaccatgagattatctctccgtgcacagataacatattatgaaaaatggttcttgattcctgtttatgtgctccttgagacctgctgtgtccctaaaccgacagggtgtctttcctcgacactctcaggtgggtagcgaactggctttgtatggcggtgcgtcaacggtagcatgtggcctcatataaagtgcgtcacatgtaggatttggtgtggctaaaagaactggaagtatttacaccaatcagcagtacataagcaatgacatactctgctctgtttactccaaccaagtaaatacaatgaattgactgcgctaatagtgtgactcttgccgaatgtcaaagttgtactgcgataattactattcatgccgtntgacccgggtagtgacgtacattattctgctacacatgtatactgctatctaatagccaattcgagtatgttgcgtgtagtgtggacatttgccacctggattggacgagaattccgggggtaatttttcgcactgtcacagcactgacggtgggccactgaatgtagggagcacctattaaagctcctagcacattgtacatgcctcgtaatccttacaaacctaggcttatacccctcttgatctcgaggaccaccagcaactgcttgctaatggatttgcgtagctatcataactacttgcacatgcgtctttgtaactggttagtctcaggatgcctatgtcactcccattgcgtggcaaatgcgtaagtagttcatagccctgttcgctatgtagtgcaacttaaatgaccattttccgtacagattagcccgtaattaattccttgaattccttaatatcaaaactgctatgtgactaccataaattgcgtgcgtcaactggaaaagtatattttcttaggccactagaggataagataattccactctgattccaaatattcccaatgatcttttgggcccaaaggaagctaaatccatgtttaccttaggtatgggcaaattgctgagaatcacattctcacattttgccacaactttataattgggcacatctatttccagtggttttccaccggggcttccccctgaataaaaatgattttcaattacaac

SEQ ID NO: 561907 - DNA, 753 bp, Homo sapiens
  misc_feature (437)..(437): n is a, c, g, or t
tatttcaagaaagtggaaacatttcatttcaaaagaattcatagaattcatagcacactaagaatgtagagaatgaacttttttttttttggagatgggagttttggctctggtccccaggctgggagtgcagggcggggaggtgggctcactggaaacctcggcctcccagattcaggtgattctcctgcctcacgttcctgagtagctggggattacaggctgtgtgccaccacagcgggctaatttggtatttggggggagacgggttttcaccatgtgggtccggcatgtctcgagctcttgacctcgtgatccgccggcctcggccctccaagagtgcggggataacagggcatgagccatggcgcctggggcaagaatgaactttcttactgtacttgaaccttttgtaccaaaattgacgttgactgacntgacttgttacaaggaaaaacgaaaaaaagactcataattagggcaaattgtgtaaaaatattctcttaaagttagaaacaattccataatggtacaagcacaggttgtttctgttcaagcaattccagaagagggtcctaacaaagcatatgagataaaaatgcaggcaattatgaaagatgggtggatcaagaaaaagaacctaagtgtcatttggcaggacaggattaactaatagaaattcaatttttataaaggatagtgactaataaagtagcagttatgaatatagtatatttaaagattatattacag

SEQ ID NO: 561908 - DNA, 454 bp, Homo sapiens
  misc_feature (170)..(170): n is a, c, g, or t
tgcaaatgacttaagactgaatattgatacgtggaatagaatatataactatctaagaggtattatgaatatagcagatatctcatttcctaactaagatgagtactaaggaatataatcggatcgaggatatgcagaagctagtctccagtacatcctcggtttagatnaatcttttcatgaatccacatgattgtagcactcataagtggatccatgagttttcgccgcatgctaaacaactggagatattagccaatacctagatactatatcatcgaaagcatataggagctcagaactacgtacatgatggtatacttggttcaatgagccatataatagtggcagatcatgatgtggatagggaatgcaccattaatataccaaaagacacatcctctactccttccagccccacgattactagtgcagcaggatatgatggaaaggt

SEQ ID NO: 561909 - DNA, 258 bp, Homo sapiens
tacctaatgctgtcatgtgtttgtgttcttaatggctagttttattactaaatgagtcagacgagttatatagtagaacagttacagtaagctgagtgttaatttattattgaagatgaacaataatattttttacatgaactccgtacagtttagtttttcttcagtctattgcagtttgcagttttgtcctaggccttcatcttcactcgctactcactgatttgcccagaacagcttccacagccatttaggtgt

SEQ ID NO: 561910 - DNA, 110 bp, Homo sapiens
ctgacctactgactacgtgacaactggacttttggcgtacggtatggtctacgggtgtacgcctgacgacatacggggacaatcacgtgaactgacagcgctcctactga

SEQ ID NO: 561911 - DNA, 1028 bp, Homo sapiens
cgccactctttcttctctggcacaaccctcctgccgccactgcacgacgcccacacgctggcacgcgacaccgacagcgaactgccgcacggcctgcaagccgcacaacacgaacgacaacgactgacggcagcacggctccacacgctaacaccgcctagccttgcttgcacccgctggcaacggcccacacggagccacgacacacatggcacactgcccacgcacgcctggcgcgactgcctggctaccaacgcctccgctgcgcgcacctgccatgcttacctgctcctacgcagcctttgctcctcacacttgcgactcctacgaacacttcaatcggccccctcttgcactctgcccgattcaccttctgcacgaccctcaccctttgcctcactaacaccaacaacttgccccatgttctggcttcctcttgccccttggaccctgctgcaccactctcttgtgcacctacttttcctgatgcttacactctctgctgcgcccgcacgttgctaaccacacccactactacactaacactcactcttcctttccgcccggctcctctacgccttgacacgcacacttcaacacctcctacaccacccactactcaccacccctcacacatccacagatcacacaccctctgtgtgctcggccgcagctctagcgcccccacgacaacacaccctcttcacaccaccaaattctcgcagtagcgcacacccgccccccccaccccccccccctgcaccgcgggcccaagcagtggtccctccgcagcgacagacacccgggtccacacaactagacgcgcacgcgcatatccctccgctcatcataacacatacgcgcccgggtcgatacaccacgcaaccgctatcgagaacaaccctcaaccgtcgaccctccagggcacacccccaacgcgcccctatcaccacgcagcgtcctcaacagagcctccccttaaagattgcccacgacccttgcggtccccccctctacgcccacacacc

SEQ ID NO: 561912 - DNA, 134 bp, Homo sapiens
  misc_feature (15)..(15): n is a, c, g, or t
  misc_feature (39)..(39): n is a, c, g, or t
agattgaacagaatntattggctgtctttgaagtgtctntgggtatggcttttggcaggggctgtctgggttcctccgctttgcttgtttttgggctgctgctgcagcctttaaggcccttctgtcgtcttctc

SEQ ID NO: 561913 - DNA, 332 bp, Homo sapiens
ctgaggacccagaataaatcgttgctcgaatctacccgtgaccatggcttctccagaatccaggcaaaaggacgggctcaggtatctccagttcacagaggaaaaagccgagtggctgggaacctaatcataacaaagtcagaagtactccactgtatcaaaagaaagcacttaaccaactaggaacacgagctatgacaaagactacctcagtggtgaactgggtgatcatctgaagatgcaaatccaggtttcgcttcattaattcaccatccagagatcaaataattacaacgaaaaacaactatagataggtagaactatatttaccc

SEQ ID NO: 561914 - DNA, 3443 bp, Homo sapiens
cccaccttagccgtgggggatagaagagagcgggagggggcggttcccgttccaccgcggagccggatgtttgccgagccttgacaggcgtggcagagggagcagtgcccgagcgcggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaagaacatcaaggccttgtacatcgtgcatccaaccatgttcatcaaaactctgctcatcctcttcaagcccctcatcagcttcaagttcgggcagaagatcttctatgtgaattacctgagcgagctgagcgagcacgtgaagctggagcagctggggatccctcgccaagtgctcaaatatgacgacttcctgaaatccacacagaagagccccgcgacagcccccaagcccatgcccccacggccccccctgcccaaccagcagtttggagtctcgctgcagcacctccaggagaagaatccagagcaggagcccattcccattgtactcagggagactgttgcctacttacaggcccacgctctcaccaccgagggcatcttccggaggtcggccaacacccaagtggtccgggaagtgcagcagaagtacaacatggggctgcctgtggatttcgaccagtacaatgagctgcacctgccagcagtcatcctcaagaccttcctccgggagcttcctgagcccctgctcacctttgacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctctgtttccctagcaagtgtggatgaatcaaatgactgccggctgggctggtagcaggggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcgcccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaa

SEQ ID NO: 561915 - DNA, 3152 bp, Homo sapiens
cccaccttagccgtgggggatagaagagagcgggagggggcggttcccgttccaccgcggagccggatgtttgccgagccttgacaggcgtggcagagggagcagtgcccgagcgcggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaagaacatcaaggccttgtacatcgtgcatccaaccatgttcatcaaaactctgctcatcctcttcaagcccctcatcagcttcaagttcgggcagaagatcttctatgtgaattacctgagcgagctgagcgagcacgtgaagctggagcagctggggatccctcgccaagtgctcaaatatgacgacttcctgaaatccacacagaagagccccgcgacagcccccaagcccatgcccccacggccccccctgcccaaccagcagtttggagtctcgctgcagcacctccaggagaagaatccagagcaggagcccattcccattgtactcagggagactgttgcctacttacaggcccacgctctcaccaccgagggcatcttccggaggtcggccaacacccaagtggtccgggaagtgcagcagaagtacaacatggggctgcctgtggatttcgaccagtacaatgagctgcacctgccagcagtcatcctcaagaccttcctccgggagcttcctgagcccctgctcacctttgacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcgcccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaa

SEQ ID NO: 561916 - DNA, 3430 bp, Homo sapiens
cccaccttagccgtgggggatagaagagagcgggagggggcggttcccgttccaccgcggagccggatgtttgccgagccttgacaggcgtggcagagggagcagtgcccgagcgcggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaagaacatcaaggccttgtacatcgtgcatccaaccatgttcatcaaaactctgctcatcctcttcaagcccctcatcagcttcaagttcgggcagaagatcttctatgtgaattacctgagcgagctgagcgagcacgtgaagctggagcagctggggatccctcgccaagtgctcaaatatgacgacttcctgaaatccacacagaagagccccgcgaggagcggaggccatgcaggaggccccctgggaagagaggggcgcggctgcagcacctccaggagaagaatccagagcaggagcccattcccattgtactcagggagactgttgcctacttacaggcccacgctctcaccaccgagggcatcttccggaggtcggccaacacccaagtggtccgggaagtgcagcagaagtacaacatggggctgcctgtggatttcgaccagtacaatgagctgcacctgccagcagtcatcctcaagaccttcctccgggagcttcctgagcccctgctcacctttgacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctctgtttccctagcaagtgtggatgaatcaaatgactgccggctgggctggtagcaggggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcgcccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaa

SEQ ID NO: 561917 - DNA, 136 bp, Homo sapiens
ttcaaacaccgcaatcttcaaaagtgtcaatgtcacaaaagataaggaaagtcacaggaatcgttacaaaccataagagaaataacagagaaataactaaaatgcatttcgaattcctgaacagtaaaaaggacat

SEQ ID NO: 561918 - DNA, 107 bp, Homo sapiens
ggccacttttaaagaaccccttatcaagaattgttggatttgtattggcaattgaccgatcctaccgatgcatttggtcagtttgcagatcggggcagccagtatag

SEQ ID NO: 561919 - DNA, 3020 bp, Homo sapiens
ggctgcaatgagctgagatcacactccagcctgggtgaaggagactctgtctcaaaaaaaaaaagtatgcactgggaccctagcgtggcacctgtcccaccacgcctgctcctgagttgtccattctgtctctgcaagtacaagaagaacatcaaggccttgtacatcgtgcatccaaccatgttcatcaaaactctgctcatcctcttcaagcccctcatcagcttcaagttcgggcagaagatcttctatgtgaattacctgagcgagctgagcgagcacgtgaagctggagcagctggggatccctcgccaagtgctcaaatatgacgacttcctgaaatccacacagaagagccccgcgacagcccccaagcccatgcccccacggccccccctgcccaaccagcagtttggagtctcgctgcagcacctccaggagaagaatccagagcaggagcccattcccattgtactcagggagactgttgcctacttacaggcccacgctctcaccaccgagggcatcttccggaggtcggccaacacccaagtggtccgggaagtgcagcagaagtacaacatggggctgcctgtggattcaggctgtgccgagcttctctcacgctgcccccaccccagggctgcctgtggatttcgaccagtacaatgagctgcacctgccagcagtcatcctcaagaccttcctccgggagcttcctgagcccctgctcacctttgacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctctgtttccctagcaagtgtggatgaatcaaatgactgccggctgggctggtagcaggggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcgcccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaa

SEQ ID NO: 561920 - DNA, 144 bp, Homo sapiens
ggggctccgctcgtcttctctgtcttagggctggtgctggcccttccacggctagggcttccgcgcgtaaagggcctaaacttggatttccccgccccctgggacgggccacaaagaatttggacaaatttttcccgggacaca

SEQ ID NO: 561921 - DNA, 235 bp, Homo sapiens
tgtgccagccgtgatctatgcagtggcgtgtgctgtagtaccagctacttggcaggctgaagtggtaggctgcttgacctaggagtatgagtcaaagctggcaacacagccccggcttatactcttaaaaataaaaacacaagggcataaatagacagcacttggcttgggtgctatgtgtttcgcaatagtatcttaactggctttctaacattcagttccccattagggtttt

SEQ ID NO: 561922 - DNA, 3446 bp, Homo sapiens
  misc_feature (21)..(21): n is a, c, g, or t
  misc_feature (94)..(94): n is a, c, g, or t
  misc_feature (102)..(102): n is a, c, g, or t
  misc_feature (116)..(116): n is a, c, g, or t
gaggaatagggacagggagcntgggagagggaatggtgggggcaggagggcacgcggtggaggtcgcagaaggtgaaaagagcaggtcactganctgccacntgtcttcctctctnccaggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaagaacatcaaggccttgtacatcgtgcatccaaccatgttcatcaaaactctgctcatcctcttcaagcccctcatcagcttcaagttcgggcagaagatcttctatgtgaattacctgagcgagctgagcgagcacgtgaagctggagcagctggggatccctcgccaagtgctcaaatatgacgacttcctgaaatccacacagaagagccccgcgacagcccccaagcccatgcccccacggccccccctgcccaaccagcagtttggagtctcgctgcagcacctccaggagaagaatccagagcaggagcccattcccattgtactcagggagactgttgcctacttacaggcccacgctctcaccaccgagggcatcttccggaggtcggccaacacccaagtggtccgggaagtgcagcagaagtacaacatggggctgcctgtggatttcgaccagtacaatgagctgcacctgccagcagtcatcctcaagaccttcctccgggagcttcctgagcccctgctcacctttgacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctctgtttccctagcaagtgtggatgaatcaaatgactgccggctgggctggtagcaggggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcgcccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaa

SEQ ID NO: 561923 - DNA, 121 bp, Homo sapiens
  misc_feature (34)..(34): n is a, c, g, or t
catcgagctcggtaccagaaggactgacgggagntggcgatatacgttcaaaaagtatctggccaattttggcgctgtcatgaatagggccttggccatgctgctctttctgaaattttag

SEQ ID NO: 561924 - DNA, 3761 bp, Homo sapiens
cccaccttagccgtgggggatagaagagagcgggagggggcggttcccgttccaccgcggagccggatgtttgccgagccttgacaggcgtggcagagggagcagtgcccgagcgcggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaagaacatcaaggccttgtacatcgtgcatccaaccatgttcatcaaaactctgctcatcctcttcaagcccctcatcagcttcaagttcgggcagaagatcttctatgtgaattacctgagcgagctgagcgagcacgtgaagctggagcagctggggatccctcgccaagtgctcaaatatgacgacttcctgaaatccacacagaagagccccgcgacagcccccaagcccatgcccccacggccccccctgcccaaccagcagtttggagtctcgctgcagcacctccaggagaagaatccagagcaggagcccattcccattgtactcagggagactgttgcctacttacaggcccacgctctcaccaccgagggcatcttccggaggtcggccaacacccaagtggtccgggaagtgcagcagaagtacaacatggggctgcctgtggatttcgaccagtacaatgagctgcacctgccagcagtcatcctcaagaccttcctccgggagcttcctgagcccctgctcacctttgacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctctgtttccctagcaagtgtggatgaatcaaatgactgccggctgggctggtagcaggggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcgcccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaaaaaagaaatatgatatgcaatgaaatcaaaaaggtttagaaaaatatagacgagaacatggtacgagtccactgcggccagactgttcacccttcggacactctatgtcgagcgtcctctggcatactcttgtactgttccgccgctttccctgtcacactctggactcccttccccactccacactccccactgcctttcgtcctactactgcctgtctccctcacctccgcgttctataagcccgcccccttttctcgcctcctccgcccgctctgccccgcacgccctcgcgcgcgtccttcgcggcacgctctc

SEQ ID NO: 561925 - DNA, 511 bp, Homo sapiens
atcagggtaataaactttcccaaacatatctgttcctgccactccaaaggcacatttatcttaatagtatataacatatattaaaattatatatttaaaatagattaaaataaatgatttaagtttacaattgtgtggaaaaatgactttttcttaagctaggtccttttgtcaaaacatattgttcattagtagaaatatattgttacgtaagcagtaactaaatcatccttttatattactcagttgcaatgaggtagttctaagcaagctgattgccaaggttgccctaccatacagaaattctgaagtcggggggtgacctcatgaaatcatgcgagaacctaattactgaaccaccacctatagcttggttatcaaagattgtttatggaaaagaatagacaaggaagaaggaatacccacttgaccatgacttggcaaagagtttcaagagagggcataatcaaaagtaaccaatcatgtggaaaagtcaagtaagactaactta

SEQ ID NO: 561926 - DNA, 1723 bp, Homo sapiens
  misc_feature (7)..(7): n is a, c, g, or t
ttagagntcccgacagaggtgggggagagcatgcctgatggggtggcttcaacatctctctccagggggcttaatggcccctgatgccaggaggaagagtcaaacccggctaccagagaaggggctggtggggcagggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcgcccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaa

SEQ ID NO: 561927 - DNA, 238 bp, Homo sapiens
cgccttcatgttttgtacttgcctttcctccaactggaaaactccacatttatctccataggcttactccttcgagttcctttagaatgtctggtcaagatgaggctcaagaaatcactatgatcatgctctacaaaatagtgcccccaccattttcttatccctcctaaccttgctttatttttttcactcccaacattattttattctttttgatcactgcggtaaaagcttggtg

SEQ ID NO: 561928 - DNA, 4234 bp, Homo sapiens
  misc_feature (4188)..(4188): n is a, c, g, or t
cccaccttagccgtgggggatagaagagagcgggagggggcggttcccgttccaccgcggagccggatgtttgccgagccttgacaggcgtggcagagggagcagtgcccgagcgcggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaagaacatcaaggccttgtacatcgtgcatccaaccatgttcatcaaaactctgctcatcctcttcaagcccctcatcagcttcaagttcgggcagaagatcttctatgtgaattacctgagcgagctgagcgagcacgtgaagctggagcagctggggatccctcgccaagtgctcaaatatgacgacttcctgaaatccacacagaagagccccgcgacagcccccaagcccatgcccccacggccccccctgcccaaccagcagtttggagtctcgctgcagcacctccaggagaagaatccagagcaggagcccattcccattgtactcagggagactgttgcctacttacaggcccacgctctcaccaccgagggcatcttccggaggtcggccaacacccaagtggtccgggaagtgcagcagaagtacaacatggggctgcctgtggatttcgaccagtacaatgagctgcacctgccagcagtcatcctcaagaccttcctccgggagcttcctgagcccctgctcacctttgacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctctgtttccctagcaagtgtggatgaatcaaatgactgccggctgggctggtagcaggggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcgcccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaactgctcatctggatgttggggaaatgagttgggtgtggaagttggaaactggatgggaagtgtggtgcggtggaggaagaggaacagatggggcctcaggaagtcccctccccagtccgtctgccgcttcctcatcttgtgcactcgagtggtgatgagggcagcttcctgaccagcttctaggcatggaggtgtccacggccaccttcccgttgtttgtacccccagcattccagcaggccaccatgtgctgcatcctatgaccagggcctctcctgtttcccaactggaaggtaccggaagtttgaagggatcttagatttatctaaggcaagcagggggaagaaaagtggtgtggactgtgatggacaatggtgtgggatctggagtcacacgagagtttgagtcctcgttccctcacgtgccagctctcaccgctaacagtcatcatcactggctcaccacccctgtggctgctgcttcatcagaagacggttcctttgaggatcagaaataatgcagacaccccaggcacgtggctcacacctgtaatcccaccactttgggaggcagagacaggaggattgcttgagcccaggagttcgagaccagcctggacatagttagatctcacatagtaagatcctgtcatagtggtcaggttccaggtgtctgctgcttgcttgctaatggcaatcaggaggctatagcggcccagtgggcctggttttctctccctgctgtncgggtgggggagcagggccagagcgcagatccgaggggtcacgagg

SEQ ID NO: 561929 - DNA, 693 bp, Homo sapiens
  misc_feature (3)..(3): n is a, c, g, or t
gcntaggcatcaaaggtaattcccattcggctaagagacacaaggtcgggcacagtggctcccaaagtgctgggattccaggcgtgagccactgcgcccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaa

SEQ ID NO: 561930 - DNA, 322 bp, Homo sapiens
  misc_feature (319)..(319): n is a, c, g, or t
taatttgagtttgttgtgtagattctggatattagtagtcctttgtcagatgtacagattatgaagattttctcccactctgtgtctgctctgtttactctgctgactgttccttttgccatgcaaaagcgtctttagtttaattaagtcccagctatttatctttgtttttactgcaattgcttttgggtccttagtcatgaaatccttgcctaagccaatgtctagaagggtttttccaatgttatcttctagaatttttatagtttcaggtcttagatttaagtccatgatccatctctagttgatttttattatnata

SEQ ID NO: 561931 - DNA, 748 bp, Homo sapiens
cccaccttagccgtgggggatagaagagagcgggagggggcggttcccgttccaccgcggagccggatgtttgccgagccttgacaggcgtggcagagggagcagtgcccgagcgcggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaagaacatcaaggccttgtactgtgtgaatccagtgttcacattcacacttaatgacttccttggcaccaatcatgtatttcaccgtttgcactttttgtatttcaataaaaatgttgatgcaaaa

SEQ ID NO: 561932 - DNA, 157 bp, Homo sapiens
gagtacggaatgtgaagatgaaagtaggcataacgactcttacatccaggcacatgtcccccgcatcattccttgaagaagcgcagatcatgtaaggaagctgaatgcacgacaatgctggtccagtctcgatgcccagttggtgttctgagtgagc

SEQ ID NO: 561933 - DNA, 1167 bp, Homo sapiens
ggatgccaggaattccaacgaccgtgccccgggaacttgtgaagggcacgaatgtgcccggcgggggtacagggaattataccgaagtgtttcaggcgaatacgggaaataccacgtgtttactctgatccagggtcttaaggggctcctcaatggttaagtgctgtaaccaccatattgacgcgtagcaatttgatcctttgttcatctatagtagataggcctagcgaacttgggtcaaacaccgtgctccccggtacggtttcctcgcgggattccggtaaattaaacaaccgttttccttgggcaaatagcgcattgtgaaactgagttgttagactcgtggtagagggtagcattaccagttagctagttcatgcgagagcccttcgatttcggaatatgactggggggcccattccttgcgcgcgctttggctatcaccacagcatagcaggtgtccgcattgaactctaagctgcaatcagcatctgacgtccaagtactggggagccttcactgcaatgaagaatgtacacgtggacgtcagacagatttgcacggctatcaccagttgcttggaagtagtgattctgcaggaaagaactagtctttgggactcgtgatgccttattaccaccagagacttctccatgtcggtccactagccgaccggctattgggacgacattgagattacgctttatcggtacggtgttatccgctgatcaggctctacaaagtactgaagttatactcgcagaatactacactaccaagttcccgtgcagagtctgctacgtgctaaagctgtttgatcggatacagtgaagctcacaagatcaagcaagtagagtccctagagttatgtgaacgcatctgcagatgccgaggggcggcagcgccacgtaacattggatccaagggcccctcacccaagctgtgatgtccccaggctcagctataacatgtaccgcaccagaaacttgaactcagtaccttgacaaccgatggggacttcgatctggaggacacaatggaacagtagcgcggcgtgtaggaggagctcactgggccggaccaatggacagtcagtcggatcccgacgcacaatcgtgaccccgcgaacctctcaatcttcagcttcttcatcttcaccgagagtac

SEQ ID NO: 561934 - DNA, 342 bp, Homo sapiens
tggtctgggtgtagaagggcacgggaggtgtgaggttgtggcagcacagccgcttgcgccccgccagcgggccgagcctggagcttacggccagggctgaggcctggcatgcctggtaggcctgagagcccacctgtgttccgcagccaggaggtggtggggacaatgtgccccgtgcccgcttgaagctaacagcaacgtccatatgtggaagaagattagcatcacagagcgaagctgcgatggagcagcagggctcccagaagtatctggcgaatcgtctttcggtacccccggggtccgaggtagcctccctttaacaggctgagaagagcacagggc

SEQ ID NO: 561935 - DNA, 1470 bp, Homo sapiens
  misc_feature (344)..(344): n is a, c, g, or t
  misc_feature (368)..(368): n is a, c, g, or t
  misc_feature (416)..(416): n is a, c, g, or t
  misc_feature (912)..(912): n is a, c, g, or t
ggctcatcttgcttatcatcacccgtgtgatgctcgctacgctggagcgcctgacggcctcgccgtacgttcactgattgtacacgcactgagtctgctctcgcttccccttactggagtccgcacataggtttgaggatatcacaagaatccgctaggatccctgaaagtatcctgagatattgcaatcccttctactggcctctcgaagcatatcgaccatccatgatgctagagcaacttgaatatgacataggactatcacactataggctttcctcgtcgtgactctcgtcgtgggacgcgatctcacactttagttgacctcgccttgaagagtgccntctcgctttgaagagtcgcgccantctgcttggcgcgtcatacatagggtatcccttgcgccgagtaggaancgtcctttggagaccgttatgggcagtgctacatgagtatgagagtaccgccctcaagaacgtcagattctcgatagcgccccccattgcaccagaagagcatcgattgacagcgctgatcgctcgcgtctctccattgctaatcttagtacccaccatcactggacgggcaatttagattttcacttagagcacatacgcctgcacgaattcaatgcacgtcaactgaacagaccatcaatggagccattaaccccattcgggcgtcgattgttgccaataacttactttctagttccaaggggccatcgaattaggggcccctctgcttacgatgtaagcgaggtcgcactttcggtcgaattcccggaaatatccctccgccttgcaaaaagcgatgttcaagccgagccgccataggtttcaattctgcttcctacttaatagttcctggctcttcagaggggaagccaccatttgtcactcgaggttcccnatacgagttttaactcggaattatctctggggggctttaaggacatatagacctacgaactatggataaccggagaacacacggccagaggtacattcgaggggtccaggcatctacggagtcaataatcacccttgcgttcgtcccacgggcgggaccttttcggatacaattctttctctaaggatcttcggcgaatctttcacacttacaggggttgccttttgcattggaacggtttccttagggcaatgggccctatgggtcttaagaggccttcagcgcggtaaattctctccacaccaagcattagtgggtaaaacccctaaccttgggtgacagacaaccttccttcattgtggcggaaagggaaacttcagcttacttaccttgccctggagttcgacatattaattccacctttcatcccttgagtaatatcggggggtaggtttctaggccatagtacccattaagggttccaccacagaggccattaataatgtataaccccttcgtgtgaccatttaattttacggcacacagacatccacattg

SEQ ID NO: 561936 - DNA, 318 bp, Homo sapiens
tagaagcttgagaatggcatgtcttctgaaaaacaaagtttattaaaatattagtttgtgacttagataactcattcttaagaaagcaggaatgtggcagcaagggtagaaacaaacatagaagacaatgcttaataaagaagaaaatatttgggcagggcacggtggctcatgcctgtaatctcagcaccttgggaggccaaggcaggcggatcattaggtcaagagatcgagaccatcctagccaacatggtgaaaccccatctctactaaaaatacgaaaattagctgggcatggtgcacacccgcagtcccagc

SEQ ID NO: 561937 - DNA, 357 bp, Homo sapiens
tatttcctgggcatctaaatagaattccaagtctttcaatcgattaggatttgaatggtcaatcaataccaccgtccccattgcacctttacaaacgattgtccacataaagtcaaaacggtcttgaccaggtgtactgtaaagaccaatcttggtaccatcttctaaactgatttcaccgtaatcaattccgacagtggttaaatatttactatgtgcatctaaatctgtatttacagcttcagtgctaacaactggaatatctgatagggatttaattgccgcagttttacctgcccccatcgttccaccaaaaacaattttgtattgttgaagaatcataaaaatgccacataa

SEQ ID NO: 561938 - DNA, 309 bp, Homo sapiens
cgcgagtgtcccggtctagtgcgcaactaggacaaggtttgtgccgcttggtccccgctggcctctcggctggatccagcaattggtcccctcctgggacgcaggctggatcctgcatgtgacctcctgcgcactccaggtcctcagggatcttcttggtgctcctggtattctgggtctccctggcctcaagaggtgaacgtggtctaccaggtgtggctggtgctgtgggtgaacctggtcctctgggcattgccggccctcctggggcccgtggtcctcctggtgctgtgggtcgtcctggagtct

SEQ ID NO: 561939 - DNA, 235 bp, Homo sapiens
gtggtagtctttcacttataattctgagatcacccatgttattagttcattttttttttattgctgagtagtattctattatgtggatataccacaatttgtttatgcattcacctcttaatgcttggtggcatttgggttatttccagttttgggctattaccagtaaagttgctatgaacattgtatggatatacgcttttttttctcttggctaagctttataatgtgatag

SEQ ID NO: 561940 - DNA, 165 bp, Homo sapiens
caaattatccctgtttgcagatgacatgattgtatatttagaaaaccccatcgtctcagcccaaaatctccttaagctgataaggaacttcagcaaagtctcaggatacaaaatgaatctgcatcaatctacacggaccatacacagtgcacaaactgaaatgag

SEQ ID NO: 561941 - DNA, 621 bp, Homo sapiens
ggacgcgctgggtcgacccacgcgatcgcatgattgacgagctcaaccaggccatcgcaaagtgcatggaggaccggggggtggatcgcacattgaactagaccgagcggggcatcaaaggcaatgcgcagcatgggacgctgcatagtcaaagcacatgccagagaccctggaatgactcagggaaggaggaaaccgagccagaggtgcgttgcaagcgaccgtctaccgagcgtggaccctaaggccaagcagagcacagtgacatccgtcgtgtatgaaaaggtagaggttatgcacactcggggacgtgagggggaaggatcgcagcataagatccactgacaggtgaacatgaacaatacataagtggcacggctccaatcaagcgcacgaagtaccaaggaacaacaaccgcgaaaagtcggacaagtacgagaacacgccaaacctccccacgaaatggaagaggcacgggacaacggcgaaacagaaatatcaacacgcaaggaagtgagaatagagtccaatgcaatcgatccgaggaacgcggaacgcaggagaacacgcacacgccacacagaacacgcagaaaccataaaacaacacgaaaaccagaaa

SEQ ID NO: 561942 - DNA, 490 bp, Homo sapiens
gtcattaagtgcaaatacattgacctagtgaaaccaactatctagaacagggtgtccaacacagtagccatcagtcacatgtagctactgagaatgtgaaagggggctaatgcacacagcagatggagacaggaaggcaggggagtaaagattttttctttttttttcttggagatggagtctggcctggtcgcacaggctggagtgcaagggcgcaatttccactcagtgcaacctctgcctcccgggttcaagcgattctcctgcctcagcctcccgagtagcttggatgacaagtgccagccaccaggcccggctaatttttggtatctttagtagagacaggctttcaccatttgggccaggatggtctggatctctggactccatcatccgcccgcctggacttcccaaagtgtggggattacaggcttgagccaccgcatctggcccatatctggcctttaaaaaaaatagctttatcgagata

SEQ ID NO: 561943 - DNA, 887 bp, Homo sapiens
gggaacccgagatctgcgcacggggttcccatatagacacgatatctctcacactcacctttcaaacctaaactcgagcctacatgtaccaccggccatagcattgctctcgccatggctctcagcgatgctgacgatgcaaaagcagataaagcatatgatggctttcattgcacaagaagccaatgagaaagccagcacagcaactcagatgcccacaggcagcaagcaagagttccaacatagcagcaaaggtcggattcgtgccaacccccaacgcactcaaagcatctcatggcacacatacatcgcagcaagcacccgcagcaaacaagacttgacgccaggacagcacacgacaaaatacaaagaatagatacccacatcaagcactgaaaatccaacgcgcacgcacactcacgcagatcgccttcacgacagcaacggcagaatggaccgttaatccaacaagaacccgtcaccaccaactcgacaagccaaaccaaaagcacgaaccacaacgcacaaggccaggaataacacaagaactaaacaacaccacgagaacacccacaagctgaccgccaatggacggagggacacatggaaacataccaacgacaacaaaggtaacaccacagagcccaggacagacccccaaacacagaaaagatacggaaaagcacaaaaccaaacacagcactaaacaccaatacttggctaaacagggcacgcaacagcagaaacaaaaaaggacaacaagccctaactgatacccaaacacattagacacacccacacaaccaacagagagaggcatgaatcccacaaactaagaacacacacgagctcacctaaacactaacactatcaagaacaactaaact

SEQ ID NO: 561944 - DNA, 638 bp, Homo sapiens
  misc_feature (363)..(363): n is a, c, g, or t
  misc_feature (365)..(365): n is a, c, g, or t
  misc_feature (371)..(371): n is a, c, g, or t
  misc_feature (385)..(385): n is a, c, g, or t
  misc_feature (529)..(529): n is a, c, g, or t
  misc_feature (562)..(562): n is a, c, g, or t
  misc_feature (581)..(581): n is a, c, g, or t
  misc_feature (616)..(616): n is a, c, g, or t
  misc_feature (627)..(627): n is a, c, g, or t
tcttatattctactttattggggaaaactcaaaaactaacaattcacatcctcccaccttcttctttccgaagaaggcagtttgcaaaaacaaaagggctggggcgtggggatcatccaccatctccagggtttacacccaggctacccatggctgggcagtcaggcctctaggcctgaggctctcagaggcagtaaaagaaaagttaaaggaaggtgtcacctaacaaaacaaggaaacccgcctaaccctgttccccactacccacaactccctacactgcgcaatctaaataaaaagaggacaaggcatgagtgggagatacacatacacacacacacatacacacacacacacgacagntncctttnagccaaagaactgnaaaatccttccccggaaggaggacaactggcaacaccaatcaaggcttggtggtcttaaggtgatggctggaatcatgtgagactggtaaaaatccagggagaaaatgtttaccttcagctcatcccaagtctctataacccgncccacttccacatagggaactgtgctctggggnagctgcttaggaaagcctnccatgccaagaagacgatggtgagagaggggaggnagcaggaaagnctttgggaggg

SEQ ID NO: 561945 - DNA, 613 bp, Homo sapiens
ggccgtggtatctgcacggctcctggccccggagcatgcgcgagagccgccccggagcgatccggagccccccgccgatccgtagcgcagtgtaagagatttgtcgtaacgcttcatacatgcaatttaaagaatctcttcttctgggcatttatgtttaacggttttagaaaactttcggtatttagcaaagagctattattccctgtattaaagatccaaaagggtattcttgcactttttgactatatttgagccacttgtcatgcctgcattggtggaacaaatgttccaaaagaaatgccaaaacttgacgctgaagcaccacatattgttgttggtacaccccggagagagttttatatgttaaacaaaagatatcttttttcaaaattgatcacaatgtttttttttgattaaacaaaataaatgttttaccccggttttaaggtctcaattattagatttttcaaaactcaacaccatttttacggtgtgttgttttttgtcacaatgcccacttattgttgtaggtgcccaaaaattttgtgagacccattttcattttgttgggagaaattgtcctttaaggtcactttttatttatttttgt

SEQ ID NO: 561946 - DNA, 345 bp, Homo sapiens
cggacttgaggttctctattatcgaccttccatcccgttgtgtgtggtgtgtgtgtaatgagatggagttttcctctcattacccagctggagtgcaatggcacagtcttagctcactgcaacctccgcctcccaggttcaagagattctggtgcctcagccaccaaagtagctggcgtacactactacacccggctaatatttgcatttttagtacagactgagtttcaccatgttttctaggctggtctcacattcctggactccagctatctgcccaccgcggcctcccagagtgctgggattacaggtgtgagctaccgcgccaggcctaagatcgacttt

SEQ ID NO: 561947 - DNA, 663 bp, Homo sapiens
ggatttggctgttggggctggggcctggcggtgcctgggaatgcctgtggcttctcggccccgtgcctggccccactacacctctctttcttcttttgttgtatggggtctgtgacttgcgtgatataacttgaactggcaacatgtgaacattctcaatgcgggaagcattccgctcattaaaggccctaaccaatggggtctggttccatgctcctatagcccctcctggtgacttcccatgtggcagcactaattgctccacgatgccaagtacggtactgtcttgaccccgtgactgatgctgcatgcaaaatgatgggctctaatcttgtgaaccaccatgcctgtgcttccttcaaatgacttgtggaaattgcactgtccaccttcaaatgtccacggtgcaacatgtggaacgacagaagccttccagtggagcactgtgcatctcgcctttgtgtgtaacaaccctgtgtgacctgcactctgttgcccatggctcctgttgttctggacatgcaacatgaataatctttcacactgtgctataagcacagtctttaccttgtgacgaccttaacgcccaaaattgattgaggaacccacttgatgccgctgtttgttccctgtaacattcctcgggctgatcgtgtgacacaa

SEQ ID NO: 561948 - DNA, 350 bp, Homo sapiens
cggatttccccccccccctggggattttttttttgattccctaaggaaaaccgaattttggttttttgaaaaaagggcagggaaaccctttttgggatttcctcttggaccaaaaaaaatttggttttccccccggttggtggggcgccaaaaagggggaacccgggcctttttggtttggggaaaaaaaacccacctttgggaacctgggtttttaaaggaaagcccaaggcttgggtgggattttttgggaattggatccttttcccttaaagggaaaggttggtgggaaaggtttttttaaggtttttatcccctaaaaaacgggaaaaaaaaatttgggaaaagga

SEQ ID NO: 561949 - DNA, 152 bp, Homo sapiens
tcaaggaatagctactgggtttctgcgtgctgaaacaatcttaaggcatttggggggctttggcttccctggagaggcgcattggtgctggatatgacgttttccgcgctccatccgtttgccatgttggtttttggcaacaggctccccgg

SEQ ID NO: 561950 - DNA, 107 bp, Homo sapiens
tcatcatcaagtgtctgtgtcaaggtcccaaacttcccacctacaaggttctccctctcactggctccaagacctcagcatctgagcaggcttcaggaaaagatgag

SEQ ID NO: 561951 - DNA, 251 bp, Homo sapiens
ccacttcagcctctagaagtagctgggactacaggcacgtgccaccatgcctaggctaattatgttgtttatatatagtagaggtgaggtcttactgtgttgaccaggctggtcttgaactcctgggctcaaccagtcctcgcatctcagcttcccacagtgctgagattataggcctgagccaccacacctaggcctgggagtccctttagattaaggtcttcctgtaagtcagaagcagctactactgt

SEQ ID NO: 561952 - DNA, 323 bp, Homo sapiens
tgcaccttactgagggatgaccgtttgacttttggtcatatatacaaatcacttgcattaatgcctggcacatgttaggctctctgcaaataatatgttgatgaatcataatatataagttgattaatgaggaggcagtggtttcaccccttcccttccccttcctaccaccttccaacacactcagattgttgatgtacaaaactaaccatctctatagcgcaagcatactgacagaacaaactatacagctaaggtatcttacaaatagctttgaacacatttaatgtacctagtttaaactgtatctgatttaaaaccac

SEQ ID NO: 561953 - DNA, 134 bp, Homo sapiens
tagtcatcgtgtgcataagattgcgcagggtgcagacatgatgactgagacaaccgtcgagatgaaaatagtaagcgcggtatccaatacgttggataataagccgctggaacacgcgctccacaccgctatgg

SEQ ID NO: 561954 - DNA, 544 bp, Homo sapiens
  misc_feature (266)..(266): n is a, c, g, or t
tggctgctccctcttcaagactatcccacatggagggcacaatttttgaaacctcaacaaaagtggcattaggaatctggcccttgaaggcaggctgtgtgtatctacgaaagaatataaggatatatgtgaaactgggttccggaggtccataaggatcttcttttttctcttctttggggccttctgctttttccctggcttacaacacgaatggtctttctggctgggaagttggcttccggaaatcctcaacaccatcctcngtgaagtgaactagtaggtgaaggggtggttgaaagacgatcttcaggtgactgggcaggtggcaggatggtgccaccccctaggctcaaacccagctgggaactcagttctgactgatcaatggtggtcaactggctatgccccatcaagccagatgtcatgtctgtcattggtacatcaattgtaacaggtgggttggcactatactgagttcctatagaagtggtccaagtctgggctgaaaaactgccatcctgtgaagaggggggcagcaggc

SEQ ID NO: 561955 - DNA, 191 bp, Homo sapiens
ccccccccccggggggcccccccccctttttttttttccccccgggggaaaacaggggaaaacggggggggggggggccttttttggggcccctcccccttttccctttggggggaaaacccctttttaaaaaaccccccccccccccccccccttttttttcggggattttttggggggggggcccccca

SEQ ID NO: 561956 - DNA, 356 bp, Homo sapiens
ctcccgggttcatgccattctcctgcctcagcccgtggagtagctgagtagctgccaccacgcccggctaattttttgcatttttagtagagatggggtttcaccatgttggccaggcagggcctcgaactcttggcctcaaatgatctgcccacctcagcctcctagggtgctgggattacaggtgtgagccactgcgcccagcccagggctattattttagttatttagttatttaggatgatccaaaaagggcttcaaagacatgatgtagagaccatatgtgaagtgccagagctatgtaagtatttggggtagaattgttcagggttgagatggaagtatcattgacattt

SEQ ID NO: 561957 - DNA, 1221 bp, Homo sapiens
  misc_feature (404)..(404): n is a, c, g, or t
gtggacatacttcagaaccgttggagtgcaagccgtatgatgtgtcttccattctaacatccatacagtctctgcttggatgaacccaatcccaatagtccagcacacagccaggctgctcagcatggtaccaggagaacgaaaacgggaagtatgaaacagcgtgtttctgcaataggtagacacaaacgctggcggtgagttcgtgtgaccccgggatacacgttctagaacgagagctggccagtaacgaacaatatatatatgtgagtgtgtgtgtgtgcgacctcgcgctatcgtccgtgtgcatgtcacatgtgtacgttttattaagaaggcgagaagataaactgttgctggctggtttcccatcgttctcttggcccaaggtgtttccgtacccncttgctaccgctcgtgccttgaacagcgatcagaaaagacaaccgcgtctaatcgagagatccaagaagtgttactaggtacgctgaggttcaccgtttgcaaatagaagatgtgagcgtgacactcgctgtcacgtctatttgctccgtatggtcagttctgcatgttccgagttccttgccaaggcaaagttactttacataatctaagtgggctagctttttaatggcattgtatgtaatgaattgaacattgtgttttataacaaaggaagggctggactataattgcttttaagacgtgtagcagttgaatcgcaaggggaattgatattagttttcttgaaaggaagaaaacctgagatttcgctgaaaagctgtgtttttccaatcccccgttggactgggtgtcccctttccaaggcattttggtcgttatcggtgaaccttttttaagggaaaagagtctcgtaaacgtggctcgttccttgggggaaactcactgggggggccgtagcttaggacgcacatcttacggagagaaccaaagaattccccaattggttacgaggcattattttggctcgaaactcgtcgcagggcgccattgggcgacacgcgcgtttaatccatagttcgccttggattcgattgacccttagacgcacatgcatacagggcccaccctactttggaacctcttgaccaaccccggttgcgcttaatgtgttaacctgtggcgcatacggaaaggagacgaacaaagggtctagtaaagggaggcttccgcaggcactacgaacaggggaagtctaca

SEQ ID NO: 561958 - DNA, 472 bp, Homo sapiens
ttcgacgggtctgtccctgacacaaatttcttgcgtgacacacaggttatctgtgaccggcctgcctctcaccactcccccagccatgctgaataattctgcactcctgtatctaccaagttctttctcatctctgtgctgttttttcctcacatggaacagcttctcctttccccttttggggctggcattccctccaagtcttagctgggtatcacttctgggaaggccccttggccccatctaggagcagtacctactctgagttctctcatcccttttttttttttttaaatagacagggggtctcggggtggcacgggctttctggaagggggggcctcaagtaatcggcctgggcctcccaaggggctaggataacggggatgagccaccacacccagcctcatccccttctcttctggccctatcatacggagcggtcacggtcaacttaggtctctcctactag

SEQ ID NO: 561959 - DNA, 236 bp, Homo sapiens
aatagtctacagtattcagatcagtcatatgctgtacaggtgtgtagcctagagagcattaagccatattacatagcctaggtacctagtaggtagtcccatataggtttgtgtaagtatactctatgaggtacccaaagaggttctctgaatgtatcccattgttacgggatgtaaagctatatgtacaccaaatatatatgtacccttgaggctacattataaacttttgtcct

SEQ ID NO: 561960 - DNA, 697 bp, Homo sapiens
caccagtgaggctcaatacttccagcatttttagcagctacacgtggttaccattttggagcatgaatattggtgattcatcagaattctttgtatattatgggtattgattctttatctattatattatttgtaaaaagtttgtcccagtttttcacattactcaattttctttatgatcacagcttacaaaacttgtggttttgtttctataatttgtagttagatataataatcattttttatttctgtattgctattatgatctgcaaatttttacatccctagatcattttcatctcacccatattttctgtttgtttgttttttctggtttcttttttacagcccactctttaccttatctggaatggattttttttttaaacctgatataatataggctcttgactttcccccaattttctcaatatcccagtattagcaaatagtcatattactccttagtttatgatacttgcattatattatattgatgatactttttatttattatattatatttatgatacttacaatatattacattgatacttgtcattatacataataaaccttaatgtatctctatgttatatactaagtggtatttcaaggcaaatctatttccacttgccttttaatagcataatttcaaccaatatactatataattttattaaacagtttgtatact

SEQ ID NO: 561961 - DNA, 140 bp, Homo sapiens
atcactgaaattgaacacagaaaaacaatagaaaaaataaataaatccaatagctggtcttttgaaaagaacaataaaacttgtaatcctccagccagattgacacagataacacagacacgactagaaagatggcagag

SEQ ID NO: 561962 - DNA, 363 bp, Homo sapiens
gcccgagaactaaccgtactagagaccaaagtgaaccctgatttttataagtctttaaaaatggtgttttatcaagggtttttaaattatcctgtgtagaatttagattacctcattgtccattttgactcaggttgtttacaagtgaaaataaaaacccttgaactgtgtttttaaaagacaaaaaaggggtagatgtttggaaagcgtttcactcgcaagcagtcatctggagggacggaagcactgtttgcctttctgaacactctgggttttaaattctcatttcaggcccaaagtcttattcggtcaaaaaaggaaaagttgaggtttaaaaaaattacttgattaaaaaaaaaacat

SEQ ID NO: 561963 - DNA, 404 bp, Homo sapiens
  misc_feature (67)..(67): n is a, c, g, or t
  misc_feature (137)..(137): n is a, c, g, or t
  misc_feature (397)..(398): n is a, c, g, or t
  misc_feature (401)..(401): n is a, c, g, or t
acccccacaatgcaatgaaggttagaaatccccctaacggggaaaactgaaaaatttgcaaatatgnggaaattaaacaatacattccttaaatagttactcaaaaaagtaactacaggctaggtgtggtggctcanacctgtaatccccagcactatgggaggccgaggcaggtgatcacctgaggtcagcgttcgcaactagcctggccaacatggtaaaaacctgtctctaactaaaaatacaaaaattagttggacgtggtggcgtgcacctgtaatcccagctactcaggaggctgagacaggagaactgcttgaacctgggaggcagaagttgcagtgaacagaaatgacaccactgcactccagtgtgggcgacagagaccctgtctctnnttnaaa

SEQ ID NO: 561964 - DNA, 119 bp, Homo sapiens
  misc_feature (14)..(14): n is a, c, g, or t
  misc_feature (21)..(21): n is a, c, g, or t
  misc_feature (54)..(54): n is a, c, g, or t
tatgacatatacantcagctngtacctgaacattcgtgtcagtgaaacagaaangcagctttgaggaagcgagtaaccagctcataaatcacatcgaacagtttttggacacgaatgtt

SEQ ID NO: 561965 - DNA, 343 bp, Homo sapiens
tggtagggaaacagagtctggctatgtcacccaggtgggagtgcaggggtgcgatctcagctcacggcaacctccaattcccaggttcgggcgatcctctggcttgggcctccgtgagggggggggataaagggcatgcgccaccccattcagcgagatttgggtatctcaagggggagacagagtgtccacggtgcgggccaggcgggcctcaaactctggacctggtgatccacccacttgggcctctcagggtgcggggatcaggggtgtgagccatggtgcccagccagtagtaagcattcctaagggtgccagcggtgaatatgacttggtgtaggga

SEQ ID NO: 561966 - DNA, 213 bp, Homo sapiens
tcttcggcctgcgcttcggcaagcgggaggcgtcaccaggtaaccacggcagaagcgcttggcggggctgagggcgcaggtgcggggcatttaacttcagaccccaaaggattcatattatttttggcgggcccgggggggggcaacttagtgctaagggaggttaatttgagcttccaacccgaggcaataaaagaaatgttgcgtaactca

SEQ ID NO: 561967 - DNA, 230 bp, Homo sapiens
gcgactgagcctgaagaattaccaggaggagagtggcggagtagtatgaggagcatgccatgaagcaagagcagcagcgacaactcagcagcagtgcagtccccggtgaccagcaaaccccagtaagactgcaaggctcgctgaccgttacctagcaccagtgcccgaaagcgcgtcgtcttccgtatacacataaacagcgaagtagtcattactctactgcgatgtac

SEQ ID NO: 561968 - DNA, 142 bp, Homo sapiens
ggggggggggggaaaaaaaaaaaggggttcccccctttttttttaccccccccccccccttttttggggggggggggggggggggggggggcccccccttttttttttggggccccccaaaatttttttcccctctttttta

SEQ ID NO: 561969 - DNA, 182 bp, Homo sapiens
cagggagagttatcaaattagtgtaaagagccccaggatgaagagagtggtgcaggaaaaggtctaaattcctggtgtggtggggacctggcacatcccacagcaagtactcagacctcaacggcggcggctgaggtcttgggcaaggcgagtggtgagcagggtaagggctcctcagctcc

SEQ ID NO: 561970 - DNA, 403 bp, Homo sapiens
  misc_feature (9)..(9): n is a, c, g, or t
  misc_feature (20)..(20): n is a, c, g, or t
  misc_feature (22)..(22): n is a, c, g, or t
  misc_feature (35)..(35): n is a, c, g, or t
  misc_feature (38)..(38): n is a, c, g, or t
  misc_feature (51)..(51): n is a, c, g, or t
  misc_feature (61)..(61): n is a, c, g, or t
  misc_feature (64)..(64): n is a, c, g, or t
  misc_feature (90)..(90): n is a, c, g, or t
  misc_feature (92)..(92): n is a, c, g, or t
  misc_feature (106)..(106): n is a, c, g, or t
  misc_feature (111)..(111): n is a, c, g, or t
  misc_feature (122)..(122): n is a, c, g, or t
  misc_feature (157)..(157): n is a, c, g, or t
  misc_feature (162)..(162): n is a, c, g, or t
  misc_feature (167)..(167): n is a, c, g, or t
  misc_feature (175)..(175): n is a, c, g, or t
  misc_feature (178)..(179): n is a, c, g, or t
  misc_feature (182)..(182): n is a, c, g, or t
  misc_feature (203)..(203): n is a, c, g, or t
  misc_feature (205)..(206): n is a, c, g, or t
  misc_feature (216)..(216): n is a, c, g, or t
  misc_feature (226)..(226): n is a, c, g, or t
  misc_feature (231)..(231): n is a, c, g, or t
  misc_feature (233)..(233): n is a, c, g, or t
  misc_feature (245)..(245): n is a, c, g, or t
  misc_feature (249)..(249): n is a, c, g, or t
  misc_feature (260)..(260): n is a, c, g, or t
  misc_feature (275)..(275): n is a, c, g, or t
  misc_feature (292)..(292): n is a, c, g, or t
  misc_feature (397)..(397): n is a, c, g, or t
tgaaaaaanccggcaaaaancncttttattgcaanaanaaaacttgagacncaaaaatggngcngggggaagggggcagcaacgatttcncnccaaatcactacanagganagcaaaggggngaaaaggggctgagggaggaaaagccaggaaactnaaatnagcanagggagcnaannatnaaaaaacaggagatgctgaancnnccatcaccancatcattttnttaananaacattcaaggntttntcatgatggcngggctttcactgggngttaagtctacaaacanccccttcaattgaaactgtcaattaaagttcttaagatttaggaagtggtggaccttggaaatttatgagattacaaaattcctgaaagtccattaaaaaaaccncaggat

SEQ ID NO: 561971 - DNA, 300 bp, Homo sapiens
  misc_feature (28)..(28): n is a, c, g, or t
  misc_feature (282)..(282): n is a, c, g, or t
caattagttgatttctccggctaactcnacaccagaaaatcctccgccaataacgataaaagagagataggccgatttttcatgcggattgtcgcaaacctctgctttttccaattgctccatgatatgaccttgaagcgcaagagcgtcgcctatggtcttgaaaccgaaagcgtgctcgtccactcccgggatgagggcaaggttggcctcgttgccgcaagcaaggacgagataatcgtaattgattgtggcacggctgccattgtaggcctcgtactntatggtgcgcgcatcaaa

SEQ ID NO: 561972 - DNA, 158 bp, Homo sapiens
tacatatacaatcgagctcgtaccggtagactaacccaggtagtggctgtagctgcgagctggggctgtagctgggagtaacttggtgaggtcggggaatagctgggtgatgttggagagtagcttggagaggttgggctgtagttaggtctacctgg

SEQ ID NO: 561973 - DNA, 463 bp, Homo sapiens
gctaactcaagctgagaccaaccacattggccacacaggctatctgaacacggtgactgtctctccaaatggatccctctgtgcttttggaggcaaggatggccaggccctgttatggggtctccacgaaggcaaacccccttacacgctagatggtggggacatcatcaacgccctgtggttcagccctaaccgctactggctgtgtgttgccacaggccccagcatcaaaatttgggatttaaagggaaagatccttgttgatgaactgaagccaaaagttttcagtccacgcagcaaggcagaaccccccccgtgcccccccctggcctggtttgctgatggcccgactctgtttgctggctacccgggcaacctggggcgagtgtggcaggtgacccttggccccccctaaaagtttatggcagagcttttccaataaaaaaaaaactggcttttttta

SEQ ID NO: 561974 - DNA, 185 bp, Homo sapiens
  misc_feature (155)..(155): n is a, c, g, or t
ctagaggatcccctgcggcgcgagataatttaaaagaactgacaccagcgtaatagagtaatagttttttcatgccttgtgtcagtctgttaaggtctgtctgattgtactgtgcagaaatacatgaattcctcccaggtaaaatgcaaacccanaaccttggtaaatgaacggtaaatgttttg

SEQ ID NO: 561975 - DNA, 350 bp, Homo sapiens
tctgacgatcggtgatgaggaggagctgatccccttaagagtacgttagcatttaataaattgattttcccaaggacttaacatggggtgtcaggagacaaacaaaccttgcgtctctgctcatttaagtctatttaagccaggatttcagttgcttgcaggcataaatcatccttactgacccctgtgactttggtaccatctgtgtgcccacagaattccaagtgactccaccaagtcttaccaccaccctctcctgcccaggccacatgagggtgactcctagctggtcagtcgcctcctcacatcatcactctagctatttcttacccaattatccacactgcagc

SEQ ID NO: 561976 - DNA, 249 bp, Homo sapiens
tcgactctagacggactcccccccgtgtgttgcgctcacggacttgcagggacggggacgatgctggggacgctggggttcctctgctttacgcgggaggccaaggtggcacgacggggacgacgtgccacggaaaccgtgccggaccacggccttgtgggtggtgacggctgggacactggacggcctcactctcctggtcatctttggacaccagacgacgaccataaggtccgacgccgtcctgga

SEQ ID NO: 561977 - DNA, 172 bp, Homo sapiens
aagaatgtagaaaaatggaagttcaagttgcaaaagatggaaatctggttgggaagaaaataaaagcttacaacaggttgatgaacatagtaaacactcctcatactgaggcatagggagagctggataagcactacaaggaatttgatacacctcgagcccccaaagcagc

SEQ ID NO: 561978 - DNA, 338 bp, Homo sapiens
ctcagaagttgtgtctctgcctattctcctgtttcatccaccacaatcacctttccaggtctcctcagaacatcagttaatgtgcctctttctcttgctttgaagcagaagccatagctctcaccaaacctccagcatttaaactttgctgtgagtctacgtgaccccaccacgagtgacctcactttccctccatgcctgggagacagacatgcagtgtcactaaacctggatgacacgctaccctcatctttatgacacctttgatatgtgctttgatgcatttctttgtatcccatttgttcatttttagcaataaactcattcttggtacaaaa

SEQ ID NO: 561979 - DNA, 276 bp, Homo sapiens
cccgggaaaaaaaaaggcccccttttttcccccggttccggggctgggtaaaaagggaagctttcttgttttatggcccccccctggccgggggtgggtaagagaaaaaaggattcccaatcccccacttttgggggtttgggtctcccattttactttttgggccccgggaaccgggtttgccaggtccagggtccccccccttttggggtttttgggattggttgggggaaagggtttaccaacccggttttgccttaaagataattaaacttg

SEQ ID NO: 561980 - DNA, 448 bp, Homo sapiens
tatagaaatgcaacgtaatttctgaatgttaacttatatcctgctatttttcgtagaattagttcatcagttcaagtagtctgaggttgagtccttagggttttctatatatattatcatgtcatctgcatacagtgacaattttacctcttccttccaagttgaataccttaaatatctattgtatgtctgattgctgtggctaggacttccaatactatgttgaataacagtggtgagagtgggcatcctgtcttgttccagattttagtgggaaggctttcagcttttctccattgagcattatatttgctgtgggtttgtcataaatggcttttattatgttaaggtatattccatctatacccactttgataagagtttttatcatgaatggattttggactttgtcaaaatgctttttctgcatctattgagatgctcatct

SEQ ID NO: 561981 - DNA, 421 bp, Homo sapiens
  misc_feature (67)..(67): n is a, c, g, or t
  misc_feature (126)..(126): n is a, c, g, or t
  misc_feature (150)..(150): n is a, c, g, or t
  misc_feature (187)..(187): n is a, c, g, or t
  misc_feature (219)..(219): n is a, c, g, or t
  misc_feature (221)..(221): n is a, c, g, or t
  misc_feature (237)..(237): n is a, c, g, or t
  misc_feature (327)..(327): n is a, c, g, or t
  misc_feature (379)..(379): n is a, c, g, or t
caacaagggcccggtgatcaagggaacagcaagcaacgttatgtttcaaacgcggtgtcagaggccntgatccgagaggtggccaacaaagtcaaggtccccctgcaggatttcatggtccggaangacaccccctgtggaaccaccatnggacttattttggtttttcggctggggctgcgggtgntggatttaggcagcccccaactggccatgcantntatccgggagatggcntgcaccacaggagtcttccagaccctcacctttttcaagggttttttgagctgttcctttttttaagccataatttcttagtggattganccttcttggaaagatttttttgccatccctttgcacttgagaggggaagttntcagctgagctgaagctggattattaaagtggattgtcattc

SEQ ID NO: 561982 - DNA, 390 bp, Homo sapiens
ctcgcccaggcggctcgtttgaccaggttcttcggagagaactgtgggaggtcagatcttataccgaagctgtacttcccgtgagtcccgtgtcatagcgttcgggcatcctccttcctgcggggagcagctggtttgaccctggactctcacgagactgcgcctggagaaggacgggttctctgtcaccctggactgtgaacgcacttctccccagaggaactcaaagttacggtgttgggagctgtgcttgacggtgcctggaaaccactgacggacgcgccaggatgaaccatggtttcctctccagggacgtccgcaggacataccggatcccagctgatgtagcacctctcaccattacttcatccctgtcgggctagctcgggg

SEQ ID NO: 561983 - DNA, 1047 bp, Homo sapiens
tccgccagacgcgatctcagcttccccaggttggcgctgctggcagtcagctccaaagtcgtgactttcataaccaacccgaagttttgaacccgtgctgacggagttgttcactggcacaggtttggtgtggctggctgcccttgtactacttctggtgaggtctcatccaggttctggcaccttcaatccccaactgatatctgcggtatcatcactggtatcgccgttattcaccacccagtatcgcaacgatgcggtccttcctttctcatagtcacacggactcgcaggattgggctctgataatgcatcgcactctacaccagtgttagcatccccatgttcccctcttgccattctaatcgtgtatggccttattctggggaataccttgggtatcccccgctgggagagacaactcgcaagaccatcagggagccaagatcccctgtacgctccaccctgccataaggatattgaatacgatacctcaggctggtctgacgcagctggattgtgcgtctcaacgctacggatggaactgtggtccggactaagcagaggcgcgtagtctctcttgaggagtctcccagccgcagaaatagcgactgctgtcactccgtgcagtgctcgggggacgggagtcggacattaatgcccagatggccatcgattttgctcgcgtgcccagtttgaagcagcccgaggaagctgtgctgaaaacagtggcctgaggggacgaacagcgctcggttggcacgtgcgacgcgatcttccaatccatgtgggccaatcttaacttgctctgcccatacttcacaggtttgtaacttagtcagctctaaattcaggctcctgaccacaacagactggagaacttattggagccgattccgggagagccctttaccctggcccgagtttaggcagccagctaacaaaggactacttggcccaagccttaggtacactacatataaggggccaccacctactcacggcgccaacattagcaggcaccccgtgggaccaaactccgcgcag

SEQ ID NO: 561984 - DNA, 91 bp, Homo sapiens
attttttgcaaggccccgtttttttcctttcaactgtcattttgtctggagcttgaaggaaaaaagtgacttaaatccccaaattgtccca

SEQ ID NO: 561985 - DNA, 637 bp, Homo sapiens
  misc_feature (18)..(18): n is a, c, g, or t
  misc_feature (35)..(35): n is a, c, g, or t
  misc_feature (142)..(142): n is a, c, g, or t
ccatctatagacctaccncaggaatgcatccttcncaagggtcttccatgctggaaaaagaattcagcaatatttctcctacttgcacatctttctataggctttctgcaagaagaaaaatatggctctattctgcccgacnccgcaggcagtcagtccgggtatactgatttcatattgttcaaacacacatgttttacaatccatttgtgcaatagtagtcctgaggtgaattacattctgagcttatgaagataacaggattaagagattaaagtaaagataggcataagaaactataagagtgttaattgggaacgtgataaatgtccatgaaatcttcacaatttatgttcagagattgcagtaaagacaggcataagaaattataaaagtattaattttgggaagtgataaatatccatgaaatcttcacaatttatgttcttctgcctcagctctggccgatccctccattcagggtccctgacttcctgcaaaacaatcaatgccctcactttaacagtagatacttggcgaggctgtgcatggtgaggctgtgcatgcacctttcattgcaggtcagccactaacatgataagagcttatgtctatttttccacaaaatcagttcttt

SEQ ID NO: 561986 - DNA, 522 bp, Homo sapiens
tactggcggcaggagtcctgctttgctgccaggccacattctgctgaatatgatatcctgaaatctcatggatatcttggtgtcatttcaaaatatttctgtaagcaatgtcctgaacaggtgatctcttcaggtcaaacttctcttgtagtgaagtctttaccacagtccaaaaagcaggtctctgtaagttaatggtaggtccccagaaattccttaaactgtattatctgatcagattctggtattggtgcagccatatccttctggtaccttaattagtcaccttttctgatgcatgagttccctttctgtcctggaaaagtagtggtccaaccttagcttgaatgtctccaataaggcctgattcttacttaagcacaggctctcgcagccgacatcagtacaaggctggcgatagttgggtaacggttgagccttggcagggagggtcagggtctggacaggagccgcgccgccatatgggatagaacacgtgggatcagtactgtcaagtgacac

SEQ ID NO: 561987 - DNA, 145 bp, Homo sapiens
aggaccctcgagggtcgaacggaagcattgtttcctgagatgctatactatctacatcaatgcaactgcatatatactatacatctctaaaatagaaatcacatatcatatttaatttcacttccagttccaattacagcaagta

SEQ ID NO: 561988 - DNA, 448 bp, Homo sapiens
  misc_feature (305)..(306): n is a, c, g, or t
  misc_feature (330)..(330): n is a, c, g, or t
  misc_feature (437)..(437): n is a, c, g, or t
ctgtgaaatgcaaatgaaaaaccaccgtgaggcatcacgacacacctgtcagaacggctgaagtaaaaacatgtggacaccactaagtgctgtggaggattcagggaaactgatcatcctaggttgccggtgaggacatgagtttgacagtttgtggccaggtgcggtggctcacgcctgtaatcccagaactttgggaggctgaggcgggcagatcacgaagtcaggagatcgagaccatcctggctaacatggtgaaaccccgtctctactaaaaatacaaaaaactagccgggcgtggtggnnggcgcctgtagtcccagctatggngaggctgaggcaggagaatggcatgaacccgggaggcagagcttgcagtgagccgagactgcgccactgcactccagcctgggcaaaagagtgagactccgtctcanaaaaaaaaaaa

SEQ ID NO: 561989 - DNA, 101 bp, Homo sapiens
ccacacagcactaggcaaccagctaattttttttttaagagacaggtcttactgtgtcacccaggctggtctcaaacccctgggctcaagtgattcgccga

SEQ ID NO: 561990 - DNA, 164 bp, Homo sapiens
agggccagagggaggcgaggctgggaagaggctttgaggaaggtgtgacactaaatgtcacacctaggacctcggctttgttctgagggccacaggcagccaccaccgcgacctcccgcacttccctcgaggctttcgtctcagctcatgggcagcccactctg

SEQ ID NO: 561991 - DNA, 325 bp, Homo sapiens
  misc_feature (7)..(7): n is a, c, g, or t
  misc_feature (14)..(16): n is a, c, g, or t
  misc_feature (20)..(20): n is a, c, g, or t
  misc_feature (26)..(26): n is a, c, g, or t
  misc_feature (53)..(53): n is a, c, g, or t
  misc_feature (59)..(59): n is a, c, g, or t
  misc_feature (74)..(74): n is a, c, g, or t
  misc_feature (82)..(82): n is a, c, g, or t
  misc_feature (91)..(91): n is a, c, g, or t
  misc_feature (94)..(94): n is a, c, g, or t
  misc_feature (117)..(117): n is a, c, g, or t
  misc_feature (120)..(121): n is a, c, g, or t
  misc_feature (150)..(151): n is a, c, g, or t
  misc_feature (158)..(158): n is a, c, g, or t
  misc_feature (177)..(177): n is a, c, g, or t
  misc_feature (183)..(183): n is a, c, g, or t
  misc_feature (192)..(192): n is a, c, g, or t
  misc_feature (222)..(222): n is a, c, g, or t
  misc_feature (254)..(254): n is a, c, g, or t
  misc_feature (277)..(277): n is a, c, g, or t
  misc_feature (279)..(279): n is a, c, g, or t
  misc_feature (282)..(283): n is a, c, g, or t
  misc_feature (300)..(300): n is a, c, g, or t
  misc_feature (307)..(307): n is a, c, g, or t
  misc_feature (320)..(320): n is a, c, g, or t
  misc_feature (323)..(323): n is a, c, g, or t
gtgatanggggggnnngaanggtccngggtccggggccagagcccaggggggnctcgtngccatgcctcggaanaatgtggnggaaatcanggncttcctgctcacagcccggcganagnntgccaaatctgtcaagatcaagaaaaatnngggacancgtggagtttaaagttcgntggagnagatacctntacacccggggtcatcactgacaaagaganggcagagaaactgaagcagtccctgccccccnggtttggcagttgaaggtaactnanatnnaccatacacactgattnggactgntattatattaaanctngg

SEQ ID NO: 561992 - DNA, 490 bp, Homo sapiens
  misc_feature (77)..(77): n is a, c, g, or t
  misc_feature (84)..(84): n is a, c, g, or t
  misc_feature (235)..(235): n is a, c, g, or t
  misc_feature (260)..(260): n is a, c, g, or t
  misc_feature (296)..(296): n is a, c, g, or t
  misc_feature (331)..(331): n is a, c, g, or t
  misc_feature (370)..(370): n is a, c, g, or t
  misc_feature (376)..(376): n is a, c, g, or t
  misc_feature (384)..(384): n is a, c, g, or t
  misc_feature (386)..(386): n is a, c, g, or t
  misc_feature (415)..(415): n is a, c, g, or t
  misc_feature (419)..(419): n is a, c, g, or t
  misc_feature (425)..(425): n is a, c, g, or t
  misc_feature (453)..(453): n is a, c, g, or t
  misc_feature (457)..(457): n is a, c, g, or t
  misc_feature (461)..(461): n is a, c, g, or t
gtcaattcagctcttgagaaaaggtgtctttccagcctgaatttttcagattgactagaccaagcagaatctctcancctgatnttagtatttcctagaaagcacttgacattgtgtgaggtctcacctgaaggaacttggtggtgacatttgggagggtggagggaggcagtgtccttcctgacagcacttgcctccatggattttttgtacacagaactcttatctaggatgnggttctgttcatgctgctttctgcnatgtgcgtgtctgttaaaataggctctctacccagntagaacaccttccagacacttgctggacagctatnttccacatacttcccagtttacatttggtcttaatgatnttgaanagatcctntnttcattttactcagccaggttttgtactnatgnacaggngttaaattacttcaagcatttttgtaanaggngtanataattcaataaaaaaggtaaaacatgaa

SEQ ID NO: 561993 - DNA, 178 bp, Homo sapiens
tgagactaccacccactccgttcctgccagaaacgaccctttgtggccgatgggccatgcgggcccctcgcagccaattcagccagtgttgggactggttcagagcccatgggggctggaggggggcagctgggattttggaattttttttataataaaacccttacggacaacccta

SEQ ID NO: 561994 - DNA, 514 bp, Homo sapiens
  misc_feature (77)..(77): n is a, c, g, or t
  misc_feature (84)..(84): n is a, c, g, or t
  misc_feature (259)..(259): n is a, c, g, or t
  misc_feature (284)..(284): n is a, c, g, or t
  misc_feature (320)..(320): n is a, c, g, or t
  misc_feature (355)..(355): n is a, c, g, or t
  misc_feature (394)..(394): n is a, c, g, or t
  misc_feature (400)..(400): n is a, c, g, or t
  misc_feature (408)..(408): n is a, c, g, or t
  misc_feature (410)..(410): n is a, c, g, or t
  misc_feature (439)..(439): n is a, c, g, or t
  misc_feature (443)..(443): n is a, c, g, or t
  misc_feature (449)..(449): n is a, c, g, or t
  misc_feature (477)..(477): n is a, c, g, or t
  misc_feature (481)..(481): n is a, c, g, or t
  misc_feature (485)..(485): n is a, c, g, or t
gtcaattcagctcttgagaaaaggtgtctttccagcctgaatttttcagattgactagaccaagcagaatctctcancctgatnttagtatttcctagaaagcacttgacattgtgtgaggtctcacctgaaggaacttggtggtgacatttgggagggtggagggaggcagtgtccttcctgacagcacttgcctccatttagggggggggggaaatttccccggattttttgtacacagaactcttatctaggatgnggttctgttcatgctgctttctgcnatgtgcgtgtctgttaaaataggctctctacccagntagaacaccttccagacacttgctggacagctatnttccacatacttcccagtttacatttggtcttaatgatnttgaanagatcctntnttcattttactcagccaggttttgtactnatgnacaggngttaaattacttcaagcatttttgtaanaggngtanataattcaataaaaaaggtaaaacatgaa

SEQ ID NO: 561995 - DNA, 196 bp, Homo sapiens
ccccggttacgtggcattttcataagcacgcacagtttatttgcttcaagtaatgtgtaggtgaggcctttttctcctagagctgtcctgtgccccctatgcaccagaggtaggtctcatagtctggctcctctgcttggtttacagggagatccaagttcacaacaatggtgacttgcttcacatcaatccctca

SEQ ID NO: 561996 - DNA, 263 bp, Homo sapiens
cttccatgctcctgttacaggatcgccgcactcagtgtatggaagattaaatcctccaactcggtcacatcctccatcgacaactatcacctcagtatagccagtggacctgcttggcctagtccttggtgacatcatttcattcccaagtatgtggtaccgccttgtttcatgcaacaactgataacacgcaggagaatagatcaaaatcaggcttgttttattgatgcacagaacaacttatgttcaggactcaggtatgg

SEQ ID NO: 561997 - DNA, 516 bp, Homo sapiens
agcggggggaagcgctagtgcgcaggcgcaactgcctggctctgctcgctccggcgctacggcccagctctcgcggacaagtccagacatcgcgcgcctccacccttcgtccgggtccagccccctccccacatatcatcgtgcgtcagtcgacagataaacacatagtaggccggcgcagcgccctacatgtgtctcccgcacgcacggattcgagcaggagatgcgatgggaccggccgggatcccgagtccacgcccggcccagtggcggcggcctgatacatcgacatggggcaagctgacgcagctcattcgtcgcgcaccctaggggccgcggcagtggcaacgctaccactgtgcaggcaccgctttactcgcaataatcggctctgctgggagcccccgcaacccccgacccggccgccggacaacgaaaaccaagagaccccattcggctccgaccgagacaggtgcattcaggacatagcaccatccaaggactcggctatgcgcc

SEQ ID NO: 561998 - DNA, 499 bp, Homo sapiens
  misc_feature (170)..(170): n is a, c, g, or t
  misc_feature (176)..(176): n is a, c, g, or t
  misc_feature (192)..(192): n is a, c, g, or t
  misc_feature (194)..(194): n is a, c, g, or t
  misc_feature (200)..(200): n is a, c, g, or t
  misc_feature (202)..(202): n is a, c, g, or t
  misc_feature (356)..(356): n is a, c, g, or t
  misc_feature (361)..(361): n is a, c, g, or t
  misc_feature (411)..(411): n is a, c, g, or t
gtcgacagcagtccctgccccctctctgtctctctctcccttcccctctgtctctctctcccttcccctctctgtctctctctcccttcccctctctgtctctctctcccttcccctctctgtctctctctgtttctatctgtctctctctgtccatcacccactatctntgtctntgtctgtttctgtttntntttctntntccctctctctgtctcccctctctgtgtctctttgtatctctttctctctctgtctctccctgtctgtttctatctccgtcctcctgtattagtccattttcatggactaatgaggatccttcccgcttctcccagctcctggggactctgggntcccngggcttgtggccatatcactccactctctgcctccgtctccacatggccntctctctgcatccgtgtctcctttttatttatttatttatttattttgagacagaaacggagagacagaaagacatagatacgtagag

SEQ ID NO: 561999 - DNA, 207 bp, Homo sapiens
  misc_feature (137)..(137): n is a, c, g, or t
  misc_feature (175)..(175): n is a, c, g, or t
caacaacctcctcctttcaccttgccttgaaaatgccatgcaatttccaccacaaccccctctttgacatcttgagcagaggaacgtgtcacgtcctttgggggctcctgtgccgagttcctttggtgcttagcagnaagcttgtgggtctcgctacacacccacagatatcacntgtgctgatggttcacagcgcagctcacgtat

SEQ ID NO: 562000 - DNA, 531 bp, Homo sapiens
  misc_feature (202)..(202): n is a, c, g, or t
  misc_feature (208)..(208): n is a, c, g, or t
  misc_feature (224)..(224): n is a, c, g, or t
  misc_feature (226)..(226): n is a, c, g, or t
  misc_feature (232)..(232): n is a, c, g, or t
  misc_feature (234)..(234): n is a, c, g, or t
  misc_feature (388)..(388): n is a, c, g, or t
  misc_feature (393)..(393): n is a, c, g, or t
  misc_feature (443)..(443): n is a, c, g, or t
ttaagatcccttatacaacgtgttgcactctctacgtcatacccactctgtctgttttgtcatatgtctctctgtgtgctgtctcttgttgctctctgtccctctcgtgtctcccctctctgtatatctgtgtatttccatgtctacctatctgtaattatctccgatgtctcatatgtgcatcacctgtattctgtctctntgtctntgtctgtttctgtttntntttctntntccctctctctgtctcccctctctgtgtctctttgtatctctttctctctctgtctctccctgtctgtttctatctccgtcctcctgtattagtccattttcatggactaatgaggatccttcccgcttctcccagctcctggggactctgggntcccngggcttgtggccatatcactccactctctgcctccgtctccacatggccntctctctgcatccgtgtctcctttttatttatttatttatttattttgagacagaaacggagagacagaaagacatagatacgtagag

SEQ ID NO: 562001 - DNA, 225 bp, Homo sapiens
ggagtgtgctgtgtcgatctagaggtcccggtggagcggggctttcccaggtgggccaagagggtcttgatctcctgacctcgtgatccgcccacctggcctccgaaggggcggggatacaggcacatgccaaggtgccgggctgactctgccttttaaaggccgggagaggtaacctctctgagacgggatgtattagggttctccagaaaaactgaaccagta

SEQ ID NO: 562002 - DNA, 215 bp, Homo sapiens
gcctctagctgaactgaagcacgaaactggaactccaggttggagccctgatgctgccacctcctctgctggtcgggctgggaccctttgccccttaggagaggtgttagtcacagatatttacctcagtttatgtcactgtcgaagaaacaaaaaataattgcaaaaaataacactgtcgacttgaagactttgaggccaatataaaaaaaaaa

SEQ ID NO: 562003 - DNA, 110 bp, Homo sapiens
  misc_feature (107)..(107): n is a, c, g, or t
ccaagaggagtacctggtgcacctggtgccggtggctgaaaacctggggggcaggtggatctggggctgttcccccccccccgttttttccaccccacagttcctcntgg

SEQ ID NO: 562004 - DNA, 635 bp, Homo sapiens
  misc_feature (46)..(46): n is a, c, g, or t
aactcggtcttaaccacctggacagaggaggcgggactaatactcntgcgcctcgcttcgtttttcctccggaaccatgtctgacaaacccgatatggctgagatcgagaaattcggtaagtccaaactgaagaagacagagacgcaagagaaaaatccactgccttccaaagaacggggggagcaggaaatgcaagcatgcaaatagaaaagaggcgtgcgccgccaatatgcactgtgcattccacaagcattgccttcttattttaattcttttagctgattaactgtgtaagatgcaaagaggttggatcaagtttaaatgactgtgctgcccttttcacatcaaagaactactgacaacgaaggccgctcctgcctttcccatctgcctatctatctgcctggcaggtaaggaaagaacttgcatgttgatgaaggaagaattgcggtggaagaagttgggcggtacgacagtgaattctacaagaaatccaagctggccccagggggtactggaggctgtatagcagtctattcacagggccattttttcttttggtaaagtgaatttaattatgggaatgcccattttttttattatgcaaataaggggggtcaaaatcttaaaaaaa

SEQ ID NO: 562005 - DNA, 483 bp, Homo sapiens
  misc_feature (462)..(462): n is a, c, g, or t
caacgctctcacacaaaccaaacacaaatcttactgtttgccacagacacaaattcttactgtttgccacagttaagtctacctcacattaaggaattttgttttcaaagtagagaaccagtcatgaagtcaagttaaaggctgtaaaccaaatgtttattataaggtcatataaatggatggaaagcttaaagtttcataaatttaccctactctgtgtactgggataacaaaacacatattttatttgtttttgtcattttattgttttgctcaatatacttctgcactttacctgtgagaaatcaaaagagttttagacagataatctaacatgcagaagaaatctagatatattgccagtcactttcatcttctcctgtaataaaatattatttccttcaaaaaaacaccataagtattttccaagttccactagatccattttcaaaaacttgtctngtgagcagcgttgggggtacc

SEQ ID NO: 562006 - DNA, 293 bp, Homo sapiens
  misc_feature (4)..(4): n is a, c, g, or t
tggntggtgatatagaggatccttttcttgccacgatcgagaggtggtcttcctcttagggactgcaacttcaaattcagctgtggtgctcggaaaggcagatgataccagagtcacgctgacatacagaatgacgaaaaggagagatcaatgttcttattgtgatgagtctcgacttgtcaaattctttcttcaagaggatccacccggggaaacacgaccggagtcggtgggcacagaaaaggggtaccgggagctcggacattcggtaagtccatgtgtccattaggctt

SEQ ID NO: 562007 - DNA, 816 bp, Homo sapiens
tcttaataacatcaaggttaaaaaggttttcccatagggctcctcttaccaatatcagatattatgggacaggaatgggacagcgagattctaaggtggcaatgtcaaagatgggaactcttacagtacattttccacgggtacatggaaaaattcaataaagagctggggacatgggattaataaataaaaaggagagttaaacgtaaaggacttcagaaataccagtgtcaggtgagaacttccacccatcacaaagttggcagcagaaggaagctcggtaaaaggtgacgtgggaagctggtatcatgtgctggccatcaagggtaagccaatctgggctcaaccgtggaaattatcagaaaatctacaatagggcgcttactttctacaaggccaaaagaagttgaagaaaagatgacataacgtggcaacagcaggtggatataacttctgggtggaaacttgggctgtaatgggcctctcatcaggaactggtgagatgttttataacatgcagtctgggcatacatcgaggaagtttgggcaaggatcaagctcacaagggatctggttaaaggtgtcgcagtgggatggattaaaccagttgacagttacaacgggtagtgaaggattactcaaattctgggaactttaaaaccaaaattttaatccattctggtggagcctcagttcatctccaaatatcagtgtgctacatagggacaggggcatccggggactcgccctggatgacttctccattagtgttctggacatagaaactaggaagatggtccgaaaagtttcgggacc

SEQ ID NO: 562008 - DNA, 1020 bp, Homo sapiens
gattcttcgggtggaatgctgcttggtctacggggggtgacacagtcatggccctacttgaaacttctttatggcactagctgagcaacggagaggcccacttcctaccaggatgcaatgttggtgcgcaaccaggtagccctgaggtacgcactccatttgcttggtcaggcatggtcatgaattttctttcccagtgtggattgacattcgtcagccagtgtggagaatattaaccacggttctcagggacagtgctatctcagagactctggatactacgtatgcgatctatgcttatgcagcctagctccttaggtgtgagccatgattgatggcacagtcagcttttgccaatgagaccctcaataaggctcctggcatgaatactatagaccaagggatggcagcactgaagttgggtagcacagaagttgcaagcgatgttgccaaaagttgtaggttctgctgttggtagcgggtccattactagtaacatcgtggcttccaatagttcgcctccagccaccatttgctcctccaaaacagcatcttgggctgatattgctagcaagcctgcaaaacagagactaaactgaagaccaagaatggcattgcagggtcaagtcttccggcaccccgataagcataacatggatattggaacttgggatacaagggtcccgttgcaaaagccgcctcacaggctttggttgcagaatataggtcagccaaccagggtctcctcagctgtaggtcaggaggctaacaatagcccaccaggtgggtccgggatcagagggaacagaaaaagcattgcttcaactcacaccaggctgccaggtttcagtcagcacaggagttcaaccaccccgtggtagcactcgaacgggcagggtcgccaaagggagacagaaagagcggagcagcggtcggaaccccaagacccgtgaaggcgcaatagcaatggagagcgaaaaagggaacgcatcatttagatgagaggaagcacaaagcgaa

SEQ ID NO: 562009 - DNA, 733 bp, Homo sapiens
tggaaaaagtcagggaggccagggggtgggcttgaaaccagcttgggggggttcgatcccttcctttttggtctaaatttaatgtatacgggtcctctcgaatgtgtggtaggggggggggcatccatatagtccaccccaggtttatgggagggttcttctactattaggacttttcgcttcgaagcgaaggcttctcaaatcatgaaatatttattaaaattcactggctgtaagagaatatgatatgacgcctaacagatgataggatgttccatggtgggtggtatgcctcggggtagcccgagtaacgtcggggcatcccgggataggccgagaaacagtgttggtggggacagaaagttagatttcaccgccgatgaatatgatagtcgaacagggatttgggcgtaggttgggcctagggtgtagcctggagattcgggggaaatcagtgaatgaagcctcctatgagggcgcaatacgggccctatggatgggacataggggaagtgagctacaacgtatacgtgtcgtgtagtacgatgcgccaccggaggtcgcacgcgtgagaattctccgccgaaaagccgccgagatggctagtagctcctacctgtggttgcctaaggggcattcctccccagggcaggactcagaaatttggcacgggtaacagcggccaacgtcacaggttcaggcggtggaattgacgttgcggttgactcagtcc

SEQ ID NO: 562010 - DNA, 593 bp, Homo sapiens
  misc_feature (429)..(429): n is a, c, g, or t
  misc_feature (541)..(541): n is a, c, g, or t
aattcgcggccgcgtcgacgctgcgagaagacgaacagaagggagagaaagagagggaagtggaagaaatagtggaacttgccaaagtgtacaataaaaagaaatttcagtcttaaaagcagtcagtacagaattaatctcagcaaacaacacgattaagaagctagataatattaggtaataaggaaaaaggcgtacattgtttctatcaatgagaaaacaaaagggcagaaactctgaaaagaggggaaaaaaatatttgttggaaagttgaagtacaaataggaacctaaatcatggcatgatttttgagcgtagatacgtataagaaaaagaatccgtcaaacttagtactcttctcttgagcatcacgtttcctttctgtagtcacgttctctgcataaacaatatttacaaataatgaggcangctgcaaataaacccactgaccatcagaaatgatagttatagagaggaagtagatcggcgggagatgagagccaactcaatgccaacatgaggcggatctgtacgagtgagnccatacccagagccggcacggatagaccgaccggttagagccagcggggctc

SEQ ID NO: 562011 - DNA, 871 bp, Homo sapiens
ctgtaggtacctaaagtgacttaactgaatgtggatgaggctggggctggtgtgggacttatggcatgcttatcaaggtgtcccccaatgtggccctcaagagccatccccactgctggacagagccatagttgtacccctacttcctaggccatttctggggctatggtggatgaatgctgtcctgtgctgtaaacactatgcaaatggaagttatcggtttgtggtgctgtgccgcgctctgctgggcgactaagtgccactcacgcagcatgttccatgcgcaaggagcacataccatcaagccacactatcatggtatcgttctcaaagtacttggatggtagatggccactgaaacactggacaccatacagatctcttctgatctcttgcccccagtggggcctggtatggtagaatgttggcattcggtagatatccaaagcctgttctcccagaccgtcctcctgcagctggagccttcagagcgtattctcacacgagggaacgtttgacaaggctctgaccctcacagaacgatgaccagggcccagaagccatccagaattatcagtggagaagcaccttatgatcttacctataccactgtaaatcctccatgccaaccacactgacaggctacagggcactaagctcatgaaggataggagaacaaaagctgcacgtctaaataaccacaggaatcccgaagagacccatggatacggaccacgggggcaaacattacaagctgacgccctgagatataactagcaagcaccacctaggggcctgcctggaccgatgggaacacaagagaggcaaacccgaggagtccagaacgggagacaaagaggcacggcaccag

SEQ ID NO: 562012 - DNA, 720 bp, Homo sapiens
gataaatattagtactagcatttgaccatcgtcactatcataggaatatctagtatatcgctcacacctcatatcctccctactatgcctagaaggaataatagtatcgtctgttcattgatagctactctcataaccctcaacaaccactccctcttagccaatatggtgccgtatggcatactagtcttgccgcctgcggaagcaggcggtgggcctagccctagtagatcgtcaaatcgtccgaagcgacgagtatggcgcatagaactaacgatacataacctaaagcctgactccagatgcataaaactaatcgtcccaacaattatattactagcactgtacatggacttttccaaaaaagacataatttgaatcaacacaacacccacagcctaatgattagcatcatccccctagtatttttaaagcaaatcgacaacaacctgatttagctgttccccaaccgtttgtcttccgaacccatctaacaagccccgctgcgtaattactaactaaaccttgatatcctagccctgcgatcaaatgcattggggagtccgacagctcagttatgcagtgaaccagtatgacgaagaagactgctacctctctatactgaatcttcctgaggatgctcctttaattataaaccattcgagccacaagaaagtaatccatattgaatatcttcgtttcgaaagcacacttgattcc

SEQ ID NO: 562013 - DNA, 239 bp, Homo sapiens
tattaaaattatatatatataatgatatataatttattatattttattatctatatagactagcttgtcaaatttctactttaaaaagcaagtgaagataattgcaagtcagctggaagtgctgccaagatatgacctccaggaaggcccaaaagacaagtgatatttgtgtggactgctacagcgcaatgtctaactgatgcaaaatgaagaatcaatttcgaaattaagatgagtaa

SEQ ID NO: 562014 - DNA, 381 bp, Homo sapiens
gctgaacgagggggtcttgactctcactgtagtagcgtgcaaattgagtggtgagagccaaaggccccccagaccagatcctctttcaacaggtcctcccataggcaatctgtcagggtgcggggatcacagcagtcagagaggcagccctgagagtcctgagggaaggaggtgcgtgtaaattttgctgaacttagtaaatggtccctcgagaaagatatgcttggaatagagcatgtccaggtgacaatgagtgtcaatagaagccctcctctaggcttggctccaggtggctcttcggcagggagatggatgcgtgtcctccacaaggaggcggaggcatctcctcttggcatgtacttttctccttcgacctctctt

SEQ ID NO: 562015 - DNA, 443 bp, Homo sapiens
atgcgggttgatgcatgcacacgcatccatgtatagacagaatacttccactgccctaaaaatcccctgtgctggccgggcgcggtggctcacgcctgtaatcccagcactttgggaggtcgaggcagaagaatcgcctgaacccgggaggcagaggttgcagtgagccaagaccacgccactgcactccagcctgggcaacaagagcaaaactttgtctcaaaataagtaaataaataaataataataaaaaaaaaaaggaagaaatacgtgtgccagaattgtttcttccctcatccttagttatacttccatggttctaatgacaactagatacaggccagagctacagaatttatctcctgagccttagaccttattgccacaattggggttctcaagtactttaaccacagcttgtccgaaacagaacaccgtcgaag

SEQ ID NO: 562016 - DNA, 414 bp, Homo sapiens
gggtcactgcaacctctgcctcccaggttcacgccattctcctgcctcagcctcccgagtggctgggactgcaggtgcccgccaccacgcccggctaatgttttgtatttttagtaaagacggggtttccccgtgttggccaggatggtctcgatctcctgaccttgcaatccgcccgcctcagcctcctaaggtgctgggattacaggcgtgagccaccgcgcctggccgagactccatcttaaaaaaaaaaaaaaggaaatttttatcaccctataaagaaattttggggctgggcatggtggcttacgcctgtaatcccagtactttgggaggccaaggcagatggagcgcatgagcctgggagtttgaaatcagcctgggcagcataacagcaccctgtctctgaaaaaa

SEQ ID NO: 562017 - DNA, 359 bp, Homo sapiens
ctttggcaggttgaggcaggaggatagcttgagcccaggagttcaagaccaacctgcgcaacatggtaaaacttccatctctactaaaaatgcaaaaaaataagccgggtgtggtgcctcttgcctgtagtcctagctacttgggaggctgaggtgggagaatcgcttgatcccaggaggtggaggttgcagtgagctgaggttgtgcgctgcactccagcctgggcaacagagccaggccctgtttcaaaaaaacaaaaagtgtggatattagttaataagaatggatctggccgggtgcggtgctcatgcctgaaatcctagcaccttgggaggtccaagcttgaagccaagacttt

SEQ ID NO: 562018 - DNA, 236 bp, Homo sapiens
  misc_feature (141)..(141): n is a, c, g, or t
  misc_feature (192)..(192): n is a, c, g, or t
agaaaatcgtggagattgatcgtcatattggttgtgcaatgagtgggcttacagcagatgctcgttccatgattgaacatgcgcgtactgctgcagtaacgcataatctatactacgatgaagacatcaatgttgagtccntaacgcaatcggtgtgtgatcttgctctaaggttcggtgaaggtgcctctngtgaagaaagactaatgtctcgaccattcgggggttgccttgtt

SEQ ID NO: 562019 - DNA, 808 bp, Homo sapiens
gctcgcaaccggagctgtccccgggacttagtgctgaagtaggcgctgacgaaccaggcgcctggtgcggtggtcagaaaagaccatggcgttcatggtgaagtccatggtgggtggccaactgaagaacctcacagggagcctggggggcggcgaggacaagggggacggagacaagtctgcagccgaagcacagggcatgagccgagaagagtacgaggagtatcagaagcaactggtggaggagaagatggagcgagatgcacagttcacacagaggaaggcagagcgggccacactgcgaagtcacttcagagacaaataccgtctgcccaagaacgaaacagatgaaagccagatccagctggcaggcggagatgtggagctgcctcgggagctagccaagatgatcgaggaggatacggaggaagaggaggataaggcctctgtgctcgggcagctggccagcctccctggcctagacctcagctcactcaaggacaaagcccagactacactaggggacctcaagcaatcagctgagaagtgccatatcatgtgaccacttccccctggattcctcctctaggattggccagagggctggtccacatgaggggctaagagagtgagtgtctcaacttccggatacctccagtccattttggactctgctttccctgccccagctaggcctgagcccgtctcgtccatgtgcagctctagctctggtctctctctctctctctctctctctctctctctctctctctctctttttgtggcgaagtccctttttccctcttcg

SEQ ID NO: 562020 - DNA, 111 bp, Homo sapiens
acgatgaactgtcacacagtaagcactcaatgaaatatatatttaatagcaatatacaagcactgttgttcagccctcagtatatgccataatctaggctaataaatttgc

SEQ ID NO: 562021 - DNA, 724 bp, Homo sapiens
aggtttgtatctactgttccattcccaactaactatgttgtacatgctgcctgcatttccagtcggtccaacaagagacattgcgtgcaaccatttccagcaatccggcaatcaattgcaccagcattctcaagcgtccatactagtagcatccagtgttaccattccggtattctggcatacatatgcaaccagcagttcctagagtccttacaggtgcttatgcgttgctacctattccttagctatccaggcttaactatatgctacctagctattcacagctgtcctaactagtagctatccttgtgttacctattctcgggctatttaggcatactatatgctacctaagctagttcactagtagttcctaactaggtgctatgtcgctgcacacatgtcactagctatcacgtgctatacatatgcgacctagcattctctagcgtctctaactagtagcgtgtagtgctacctatgtcctagctatcacggctatactatatgctacctagcattcacagcagtccatatatagagctatccggcatacatcccggtgtccagtggctacatgtgcacctggacgttccagtgtggtgagctttcaggcacggagcaaggccaaagggataaaatagatgaaggtgacgcagtactcccccttatgagtgcctacaggccttataggccagacagatatcgggagtatattactata

SEQ ID NO: 562022 - DNA, 470 bp, Homo sapiens
tccgttgactgcgcggtttgtcgccgctggtggtgctcggtgctgaccctggtgtttgccggcgaagtattgaatacccagcagattctggggattctgctgattccgttcggcatggtgtgcctgctgtggcagggcggcggcggtgaccggttgccctggtcgatgctaccggtggtggtattgattggtctgtgcatcggctgctaggacctttctgtacgggcaggcgctgcggcgctggtcgcatccgctggatcacctggtgtggctgacgctgatcagcggcctggccgtttccgttgctggcgctggtgcgcaagcgtgcgtacttcaagcctgttctggcgcaccccagtggcggttgggcttaagggtggggctgtgcgtgttgtagagctacgctttggtactttgggccatgcagttgggctcgattgccgaaaccgccgcgctgcgcgaagtcagtg

SEQ ID NO: 562023 - DNA, 679 bp, Homo sapiens
gcacgtctgcctttgagggtgctgcccccgtcctcctccgggcccccctgccctgccctgacgtcactcacccgcggtctggcagcgcagacatcctcatgctgaaggagcaaaccgactcctcacccaggaggtgaccgagaagagtgagcgcatcacgcacgctggagcaggacgaagtcgggcagctcattaaagcagcgtgtcaatgagtgcccgcctgcactgagccagcaggacggggagacctcctggattccacacttcatcatagtcccttgtggaccgcagtgaggaccaccagggccagcctggcactcagcccttcgaggagtgggcgccccaatcagaaccacaccactctcctggcttggagaccacggcggcaggcgacagagcaacagtcccagcgagtggagcggccttcccttgcacgacccttgcccagaatagggctaccaccaagggctagacccaccgagacttggtccccctgaaacaccgcgcgctatcaatcccgattataggactcactagagttgcctcgaccatgggacttggagagctctcatttgaagtcactggcaatagatccagtaactaacttacttgcactattgtacaagatgagacaagatgtgggtacacgcatacaatgagttgaggcagtccacctccg

SEQ ID NO: 562024 - DNA, 158 bp, Homo sapiens
taggtctccgggagttaaaataatccagagtgcaggccacgacgatacctgagcaacctgagcttctattcataaatgaaggtgaaaaatagtgttttacatggaaaacagcagtatctgctcacattctacattcattctatggttataaacacagt

SEQ ID NO: 562025 - DNA, 767 bp, Homo sapiens
cgagcaggagaggcatgtgggaggtgataaaatcttacaatcaaaataccattataaagaagaggtgaaatcatctgtgataaagttcaagttaaactcagcagggaagtgttttcatccttacaatacatgcattactgattataaggacttcacatggggaagaagcactccaggaaacaaaaggtggtgcagccaatagaaaatgggtgaagaatgttatttcctttgaattctacacgtttacagcatatgacatagcagaagacgtcaaagccatgttactgaattcgaaaggaggtcggctaccttctataaacgaatggggacagacagacccagaggcagaggatggaggctggtgcctggtcagtcctattttggacgctgttgttgtaggtggagagcagagagaggagaaaaccagcaccgtccatattaataacctgtgcaatctcctcggagtacaactgggggactgtgtgatggtcgggtgccacattagacaccgacatccaggaggcctcaatgccaggatggacacgcaacagtctgatcacctcaacctgcactagtgccactgaaggtctccccaagttcccgatcacatggtccctcctgtgcacgagtacctgctctctcaacgtctagatgcaaccactattcccttaagccctcacaggctggttgattccaccatcgggcttgacacaacactggcccccttaaacccgccaaaaccttgataggcactgcggccccctgga

SEQ ID NO: 562026 - DNA, 676 bp, Homo sapiens
tattattaactgataaacttttcttattctatgatgaaataatacttccaggtattgctcagttctttccgtaattcacacatctaaaaattcaacatctgaaagtaatgtaaattagttatgtctgaaattttaggtcaaaacgaaagggaggcaagataaataagatttcccccccccccccttttagcaatctcccagttacttctttagctttttgattggaagtggatgaatttaggagaattaggtggtaaccattccctggcataaattggctttggtgatacctcctggtaaaaccctggcttgtgaaaaacaaaagtgttggactctacgagaatctggcggagaactccgggttacatttggccctcacagcagcgcagtggttaggtaaacatctttccccttgctgggcgtagacccccacacttgggcttccaacgcaacgaggggttaccctacagggtaaatttctcttcccccacgaacatgtcacagcacgctctcttggaaccccactgtgtggcgacactcctgacgtttattcaaggcgtccggggtcaacacccggggtgttttccccatgggacgtttggtgctattctcaacaacgcgttgcgatctggccttttgggtgacccctcaatgtactctccccaccccgtctccc

SEQ ID NO: 562027 - DNA, 137 bp, Homo sapiens
cgggagcttccctgctcccactgcttcctggagtggccacattgcccttctcagaggagcactttcctcaggtccttctcattccagaatagtcaatagctcaccacttactataaaatcagctggaagccttaaaa

SEQ ID NO: 562028 - DNA, 380 bp, Homo sapiens
tcctctcgtcgaaaacgcaagttacgtcatcccccaacgcaccccgaaccccgcgtctaccggaaaccgacacgtcaacgttctttttattttttgttagatcccctcccccacatcccgctctgtcgccatcggggcaggtcgggtacgtgcgtgcgttcccagggtagtaccccaaattcccgttccgtaaacgggatacgcatacctcctcgtcttacttcatccaaatattcactagtcacccccactcccaattcccctcgcacgcccggcgcgcggggggcgcgagcgcgctgtgttcccgtcgcctccgttttccttcgacacaccgtatttcccttactatctcttctccctcattcttctctcccaccttt

SEQ ID NO: 562029 - DNA, 408 bp, Homo sapiens
agaacactgattactatcactaatgacaagggacgtatgagcaaggaagacatagaacgtatggtccaggacgcagagaagtacaaagctgaagatgagaagcagagggacacggctgtccatccaagaattcgattgcattcctatgccttcaacatgccacagcacactgtagaagcatgcagaacacttcaaggcacagcattaacgcatgcaggcacaacacagcaagatgctggacaagtgtaatgcaataatcaactggcttgcatcagactcagcacagctgagaaggaagcatctgaacatcaacagaaagcagctggagcaaagttagccaaccccatcatcaccaagctgtaccagagtgcaggatgcatgccaggaggcctgccgggggtaggaggt

SEQ ID NO: 562030 - DNA, 254 bp, Homo sapiens
tcaatagaagaggcaaagctgaattgtaaaagttgcgaaatgatggcgggcgcggtggctcacgcctgtaatcccggcactttgggaggcgaagcgggcagatcacgaggtgaggagatcgagaccatcctggctaacacagtgaaactgcgtctctactaaaatacaaaaaattagccgggcgtggtggcgggctcctgtagtcccagctactcgggaggctgaggcgggagaatggccggaacccaggaggt

SEQ ID NO: 562031 - DNA, 752 bp, Homo sapiens
  misc_feature (339)..(339): n is a, c, g, or t
  misc_feature (357)..(357): n is a, c, g, or t
  misc_feature (393)..(393): n is a, c, g, or t
  misc_feature (408)..(408): n is a, c, g, or t
  misc_feature (437)..(437): n is a, c, g, or t
  misc_feature (440)..(440): n is a, c, g, or t
  misc_feature (464)..(464): n is a, c, g, or t
  misc_feature (466)..(466): n is a, c, g, or t
  misc_feature (479)..(479): n is a, c, g, or t
  misc_feature (505)..(505): n is a, c, g, or t
  misc_feature (517)..(518): n is a, c, g, or t
  misc_feature (525)..(525): n is a, c, g, or t
  misc_feature (527)..(527): n is a, c, g, or t
  misc_feature (529)..(529): n is a, c, g, or t
  misc_feature (548)..(548): n is a, c, g, or t
  misc_feature (551)..(551): n is a, c, g, or t
  misc_feature (559)..(560): n is a, c, g, or t
  misc_feature (566)..(566): n is a, c, g, or t
  misc_feature (568)..(568): n is a, c, g, or t
  misc_feature (731)..(731): n is a, c, g, or t
cccaggattcaacacgggccttgagaaatgtggctcttgtacctcctggtgccggccctgttctgcagggcaggaggctccattcccatccctcagaagttaatttggggaggtgacttcccctctgttccccaagccttaccccaacaactttgaaacaaccactgtgaatacagtccccacgggaatacagggtgaagctcgtcttccagcagtttgacctggagccttctgaaggctgcttctatgattatgtcaagatctctgctgataagaaaagcctggggaggttctgtgggcaactgggttctccactgggcaaccccccggaaaaaaggnatttaatgtcccaagggnacaaagaatgctgcctgaccctccacacagacatcnccaacagaggagaantgggaccaacaatgttcaacaagggcgtnccngccaacataccaagccgtggaccntnaagaaagggcctnccggagcaaaataagggaagaagaanccccacccccannccaaccncntnttcacacacctacgctggnagnctacttcnnttccgncngtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcancctgccacctcaagttcctgg

SEQ ID NO: 562032 - DNA, 1032 bp, Homo sapiens
ctatgcagctatatagcctaattgccacgttcccccaagtgcccttgtgtggtattggggatccaagcccccgtctatacgaactcgggactcgaggcgtgggcaacccctctctggggcctccgctcgtggcctccgcgccatccgtcatatgccttagtatcaacacccaagtagcttcccttccgcctctgagtggaacgccgcagtctctattcgaaccgggtcatgtcaatgtacagtgcctacctatggtatttttccgtggcccccgaagccctattgcctcgttccgccagttccccactggcgctgtcaagggcctcctgtctgcctcctgtctttgtgggacctgtttcagtctcctaacgttgaatgccgaatgagccaagacgagtcgaccaatgaagggcatcacgctgaagggtcccgcaggggatagaggcttgccagccccttctctcgcttcccctccctagcaccagggaccaagttggagggaagcactgcagaacctgtcacaggcacagtggtctcctcaagcctgcctgtccttgcagtagtcccctatggcattggtagcttacacctgactgactggtagcccctctccccgactcccacttccagaagcctaggagggaggcgatacctggaagactccggtcacctccttgcttgactacagggcctaaatagatgctggtcctccgcaacctcactctcagactccctgccaccgtgttccacagggttcatgcgcgtcttgcctcacttcccctcactgtcacatgcatgacgttggacttagcagggtctaaggccacactgtgtgacctcgtctgacttctcttcctcgcaccaaggcagctttccttaccttgacacagccccagaccccacaaagccttctggacctggaaagctctggggaaggactgacagaccccaggaccagtcatggggctcagggcagccaccccgggccgctgaccgactgacctctcctattaaggcccagcccaaagccca

SEQ ID NO: 562033 - DNA, 209 bp, Homo sapiens
ccgtggacagagcttaagcgttctcggatcctctcttggactttagctctccatctctgctgaggggatatgaaggtatttgcatttctcctgttaatgaagggattaagttcataagattccatgctttcatgtgattcataacacaaagttattaccgtaaggcgccaggatggcagagataactctaggttcgtcccgaagcataa

SEQ ID NO: 562034 - DNA, 811 bp, Homo sapiens
gggacgcccccttgtggtgggagacaaaacagttagagttgtgtggggcgcgagattaatcgcaatgagtgatagggatgtgtgggcctggcggccgtcttatatagttggtgcttttctttgtggtttagttgtgggtgcgggtttgtttgttttgtttttttcttggtgctggagtcctccacgcgaggtttttaaaagctcggtgaccggctcgtgattgagggacacacaccccgctcgcggttgtgggaggcgagagggacgtctccccgcccacagggttgcaacaaacttgtggctcgagaggagcttttgtgtggtggcacgagactcgggtgttggtgttttttgtttataagaaagggtgctcttttccgtcccaatttgtgagaagagagcactctgggtttatcagccggcgtagatttccctcttgcgactcctttctgtagaggcgaccccccacgttttttgtcttttttagaggagagaaggtgcgcccggacttcttctttccccaggtcccacccgcggggggtgtagtagcactcttgtttgtcgggtgattgagcttggacgccgcagttgttttagtgtctgtgtcctattaacgatttttatcttgtcggttctattttgaagatgatgggggcctcttgttggctcccccgtcccccccgttgtgttgcgccccccgcctgaggatgattgatgaggggcttttgtttttccccgggggggggggggggcaccccggggtttcctgtaaccgatgggaccccgtttgataaaaggccccccctcttta

SEQ ID NO: 562035 - DNA, 214 bp, Homo sapiens
agccagagttccccaaagatctttgcgcatcacctaagtaaacataacctcaccaaatgaaccaaataaggcatgaagaaccaatcctggagaaacagagatatatgacttttcagaaagagaactcaaatagctgttttcagaaaactcaaattcaagataatacagagaaggaattcagaattctatcagataaatttaacaaagatctttg

SEQ ID NO: 562036 - DNA, 1844 bp, Homo sapiens
ggcaggccattgcaggccagcccagctgccaggggcttcatgcttgcagtggggccaggctggcagcgttgcaggcacacacctgccagcatacagtttcttttctccttttgcacacagcatcagcagcattcaatcaccacactcactctcaacacacacatcatcagctccacatcagtgttcactcaacgcatcatttgcgtctcagccgattcacagtatttatcacacagtcacatctttcacatcagcgtgtcacagcattctctacagcagccacaccacatcatgcacaaggcaccttccagcacagcagctcagcgcatgcagtgcacatggcacacacagcattacacacagggtttgtcttccacacacaccaagtgaactggggcagagtttaggaagcaatgcacaagcctttcgtaatcccattgtgcacgttccacacacacacaatggtccatctctcacacacatgcaacacaacatttgcaagccagcacaaaagggccactacacaatgcaagcctgcgccccggccacaatattccaagtcaaccacagattcaggcacaagggtggccaaagtaggcttatttctgcaaggaatttccacacacgagtgcaaaggtgtggcaacctttcacaccactcaggcctgttcacacaaggttcgctccaaggtttatcacatcacaagcttctggatccaggtgggttgcaatcctccacagacaatgcccattcttctaggcgacggctggcacgacattcctttattatacgagcacacgacggcacggaatttcaccacaaaccgccaggacgacgggggttttgcacttttacaaacagcacggcaacccgtagttggagacaacacttccacctacattggaaccaggacagacggtgggggcatggacaactctctggctgcgcttcaagtcatctcagcacacacgcagccctacacagctgctccacacccggcccattcgttgacctctgaaaagaacgcgagcccacgcaacccggcacagaaccagcctggcgcgacacaccagcaccttctcacacctcctggggcgcaaccgtctgacgcccaagacgcaatctggccacaacacacaacacgtccccggccaaccgaccacacgcaccctcacggacaaagcgtctatgcggacacgactcggcgcacacaacacacgctggtgcacacgacacacacacgacacaagcgtcacgcggaggcaacaggcgccgacacaggcaccaacaccgcacaactaaccgagcgacaaggacaacagcagtcgacgccacctcaccgcacgaagacgtcgcacacaacacataccatcgcagaacacccgcacaacacacgacactccagatcaacaacagcgctggaaccaagcggaggcgcacaggccggacacgacacacacaagccccaccgacatgcgaacacaacacgacgcagctacagggcccacaatcgtgtcaccacagccacgcacacaccaccacctgtcccgccaaaacgcacgtagatacggcacgcacagcatcgtgcacaacaaccgacacgaccaaagccacaaacacgccgacacagcacactgggcacgccccaaccatacaacaaatatctagaaaaagtaggaagacactagcgcccacagacgcacacacacaccgacagcgcacaaactatcaacgcggacaggccacagccgaacgaggagacagagacgcacaacgacacgaggcgcaagcgacgccacagcagtcagcagcgacggagcagagcggcaccgcaacgccaccgc

SEQ ID NO: 562037 - DNA, 113 bp, Homo sapiens
gccttacagacctgccactgtgtgatgaactgggtataatctcacaaatcgatgggactgcaaggattgtcaactgaaatgaacatgattatactctgatgggagaagagcgc

SEQ ID NO: 562038 - DNA, 349 bp, Homo sapiens
  misc_feature (10)..(10): n is a, c, g, or t
  misc_feature (29)..(29): n is a, c, g, or t
  misc_feature (284)..(284): n is a, c, g, or t
tttccccccnagtcaaatgcaattctaancatctcaaccctcctaagaaatccaagacatttttttcaggtcactttaagccggggcaacccctcgctgagggagctggccgggtcacgctcctttctcggggcttcggcttgtccagctgtgaagtgggggatcgggggattttccagggatcctggggtgtcccgggggagggcgcggtcccctctccgtcttggcggggtctggacgccgtcgccttctcctgggccgccggacccaggagaggagaggtncgcggcgctcagcccgggtctgcggcttccgggagggtggcggcaacgagcctgtgctgtggcac

SEQ ID NO: 562039 - DNA, 475 bp, Homo sapiens
cgatgcaatactacttgtcgtgaagtgatttacaacagtctacccgtatgcgtgctatcgtgtcacgtctgtcgtttatccatggttcttacttggaaaacccttgcggaacagaggggaacaccgggacaagagaaatgcagacaagataactgaaaggcaaaccaagatacatggtacatataaaactgtatcaaagcataggaaaacagttgacccccaaaagaaggcattcacataaaacactcagagtgaattatgtaactgatagacaattgtcttctaatgtgaaaaaccagtccaaaaaacagaggcatcatggcattaaaccttatctgaatataatagaatttctcatgccattagtcactttaaagaccttgtgaaacatggctccctagtcaggcatatgaagagtgaagagtcaaggggatgagcccaagacagatctcataatattaggagttgaaagcag

SEQ ID NO: 562040 - DNA, 850 bp, Homo sapiens
cgcgtttgaatggcctgagtgggactctggccagaagccgaggtgactctctaggctgcgggcgctggtcgtcagcgccgaggctgggctgaggcgccgcggtaccatgatggcgccggtaagtgactgccgagccggtgcgagccccgcgcccgcatgctgccctgccctggcagtggctactccacgccgggcttggctgcgccctgggcccacctgcatgtgccccgctggctggcctcggctcggccgtggctcgctggcagcgctgccgggtcccggggcgggggctggcaaggcccggtggcggagcccctctgccggcccctgcggggagagtcgggcagcggggcgctggggggctccagggggaactggggccgggagaggcgtggaccgaacctgttgtcacttaacttatcttcgggtgggagtcgacagctgaacctggggaaggggaaggacagaaccgagtgtggggcgaagcattttttgagggacagggttttccgcagagcgccttaggcccgggcccaaggcatttccttattttccggaacggggtcctcgggattccgtgaccgggatgaagcttttgtttcgcagggacaaaaaacttgacattaagtgcataaggaattggtcgattggcaattttaaaaaccttactggtaatttcttgacaaagttggtctgtacaggtattctagggcttttacataggcctcttaaagattgcttagatattggagataacaaaagagttgcgaagtacctgtgggttataaagtccttgaaaacggagatacctatgtaggacatggcgttttaaaaacattggtaggagaat

SEQ ID NO: 562041 - DNA, 230 bp, Homo sapiens
aggaaaaggaagacttttgaccttttttctggggaaatatgcagtccctccctccttttggaaggtgaaggaaaatgggtttttaaatgccttgtccatcctgtttgggtgcaatgttttgctcccagaaaaaaatcagatcatcatgtggggattaccattgttcctggaggactcctacccttagttgaatttccttattaaagttaaatttttttataagaccctga

SEQ ID NO: 562042 - DNA, 176 bp, Homo sapiens
gctctttacaccatcgaaacgcattgcttcgtacccggccatttcccagtattttgattagctgagcatactcctgaccatcctctttgaataccagtgctcttttatcagattcattgtcattcttacccctgcgatctgatctggacctcctattccttttggcccttatcgaa

SEQ ID NO: 562043 - DNA, 305 bp, Homo sapiens
gaaatgtataccatgtgactgccagggatttttgagaatgaataaaacttgactttgtttaaaataagttaattagccatattccttatctgccagggttttttgtgtgtgtattttgtttttattttcgatattccagttaggcttaatttttttatacttatgatcatcatgaaatgaataagagggcttaagaattttgtccctttgccttcggaaaagaatgagcagcaaaaggtttactaataactctccccttggggatttaatgtctggtgcttgccgctgagtttccagaatttaag

SEQ ID NO: 562044 - DNA, 256 bp, Homo sapiens
  misc_feature (116)..(116): n is a, c, g, or t
gcctagcgtgggttgaatctaaatagttaacaagcttgcgcatatccaggggcaacatctttccagtgagtgaggtgataaattcccatgtctttgtgcaatgaagcatgactaanaatggatgtctcgactttttggaagattacccctttctgagttgcttgtgtaagaggcagtgccaagaaagatgtactgcatgattgcctggctgggattctatgacttaaactcatgtttgtggactggacattacggt

SEQ ID NO: 562045 - DNA, 182 bp, Homo sapiens
tcaggaattcgaggctacagtgagctatgattgtgcctcttcattccagcctgggcaacagagcaagaccccatctctagaaactgtgtgttagtgtgtgtctgtatgcatgtgtgtgtatatatatatctgtgtgtgtatgtgtatatatatatatacatatcccagagtgtggtgtcttg

SEQ ID NO: 562046 - DNA, 116 bp, Homo sapiens
gatctttgtagcgaggggtgatactgagggggagtagagacagctgacacaggtgaacgcgctctataaaaatacaaattggtgcggtgtggacatgctgtgatccaggtattggg

SEQ ID NO: 562047 - DNA, 250 bp, Homo sapiens
  misc_feature (128)..(128): n is a, c, g, or t
cgcagataaggcttgtttatttaatggctgatctatgtaatcgcagaggccagtatgtacagacaaagtgggaggtttatttctgtggtctcttcctcctttggctaaggtcttgagtgatctcctcncttcttgtgccgtggaggctgctcttcacgtgcgctgtgcgttgcttccttggtccttagcacctgcggtgcctcagcctgggtcagccagggagcttcttgcggggcctatatctggcggg

SEQ ID NO: 562048 - DNA, 690 bp, Homo sapiens
cggggtctgcaaatctacgcatttgaagatttaggtaagtccagaagggattaagtgcgagtccgaaaagacctcaaataaaaggtctataagaacgggaataaattgaacaatttctcgcataaggagaaaggggtactgacacacaggagagtgttcgtcacaggaaaagagcagtgtgacaattttggacaaaataagccgcgcatcaacagatggagtcatgcatatacagtgaagtcacatcaacttaaagcaagatcgaactaggagttctctagccgtagtagtgtttgtatgtgtacacacataatggtaggagaatgcagagtatagccagcgaaattcagtcaataaagatgtagtgtcggtgaaagcatgtgccatcaatgtatgctgaacagtagacacagaagtagtgtatacagagatactgtaggcagtataaggcatgtaggagagtaagatatagaatcaataaacttgtaataggcagtacgtaaatatataggtagtggttgttttcaatatgactatggtcagaccaggttatggattagcctgcagagaaataaaagtatgtgttaaagagtggaacatagacacgcagtgaaatcgaagcagtctctctctctctctctctctctctctctctctctctctctctctctctctctctctctctctctc

SEQ ID NO: 562049 - DNA, 283 bp, Homo sapiens
aattgcagctactcgggagactgaagcaggagaatcacttgaacctgggaggcagaggttgcagtgagctgagatcatgccactgcactccagcctgggcgacagagcaagactccaaaaaaataaaaataaaaataaaaataaataaataaataaatttctccttctcaaatgggtatcagtcatattaaacttgtgctcaccctaatgatctcactttaatttgatcacctgtgtaaaaaccctattcccaaataaagtcgcattctgaggaactgcaaaa

SEQ ID NO: 562050 - DNA, 436 bp, Homo sapiens
  misc_feature (386)..(387): n is a, c, g, or t
  misc_feature (425)..(425): n is a, c, g, or t
aacgggagatgcggctgaatcgatatcttgattgtcgtcaatagcgctgcagaacatacggaggtgtggatgttccgccaatatactgatttcctttcctttggataaatgcccagtagtgggattgctggatcatatggtagtttgatttgtagtttttttgttttatttattttttaatttttgagaagaagtctcactctgtcgcccaggctggagtgcagtggcacgatctcagctcattgcaacctccacctcctgggttcaagagtttctcatgcctcagcctcccaagtagctgggattacaggtgcctgccaccatgcccagctaatttttgtatttttagtagagataggatttcaccatattgaccaggctgatcnntcagctctgacctcgtggtcagggctccaaagcgctgngactacagttg

SEQ ID NO: 562051 - DNA, 265 bp, Homo sapiens
actagtgattgtctagaaaaacattctacattagaaataccagggcgaggcgcagtggctcatacctgtaatcccagcactttgggaggccaaggtgggtggatcacctgaggtcgggagtttaagaccagcctgaccaacatggagaaaccccgtctctactaaaaatacaaaattagccgcgcgtggtgtcgcatgcctgtaatcccagctactggggaggctgaggtgggagaatcgcttgaacccaggaggtggaggttgc

SEQ ID NO: 562052 - DNA, 114 bp, Homo sapiens
gatcctggctggtacatggctcaacccgtttcttcggagcttgtcacagtgatttgtcttgcgcatgtcagtcttgcagcccgcgacgatgatgggtaccttcttgcagaaatg

SEQ ID NO: 562053 - DNA, 594 bp, Homo sapiens
  misc_feature (169)..(169): n is a, c, g, or t
  misc_feature (172)..(173): n is a, c, g, or t
  misc_feature (191)..(191): n is a, c, g, or t
cagagttggtgtcacagacataggttttgcaaatcagtctttcttttctttctttttttaacaaataaggtaagaatgggttagttttagaataagattcagtgtgattacatgaaaatataattttccttataggtatttctccctgaaagtcaaattccattaaaanttnnctgggaatcacagaaganaaacctatttgaaaaaaaaaagaaagaaaagaaaagcaaaaaacaaaaaacccaactagctattcgcttattgcaatataataggtggatacaagaatcggatttaagatatgtttgtttataataaattaagcagacagcatctaaagttactgtgaaaaaaccagacaagtctaacaatacctaccaatggacaaagtaattcatatataaccaaggaagtgactgactaaattttaattgcaaagcagaatgttgtcaaatgctctctattaggttgggtgcggtggctcatgcctgtaatcccagcactttgagaggctgaggcgggtggattgcttgaggccaggaatttgagaccagcctggccaacatggcaaaaccccatctctactaaaatgat

SEQ ID NO: 562054 - DNA, 927 bp, Homo sapiens
gaaagatagctaagcatgcctgtgttaattcggtcctgtaactcgagcaccttgcggctctgagagtggacagacgtgtgctcagcctgtgtactggtggcaaagctggattcattttcctccctgtgctgatcttctggtggcccacagctggtgatatggatggcactgacaccctgtgtctcgtgctgcttgtatattagaagaggcagaacagtgataaagacaaggatactaaatgggcaatggactgctcctgccctccactggtgctcactgtgcagccctgaccctactattcttgcaccctgtgagccacctgagactgaaccaaaacccaggaagcggctgccaccaaccagccctctgcatgattgcaagatgtgccctttgatgcatgttgacatgcacatggatgatcatagctgtgctctgtgggtgaatgtggtgatgtgaaatgatgggacaaacataatggtgatggtgatctgatgttgatgcctctgcaccctgcccttcccatgaccacctgtgccacatgactgtagtcattgtcatgatgtgctgctgtgaagatggacaccatgagctacctggctgtcggctgaaactgtgttaggacactttgcctcctcatgacttgtgccccttagatgtgctgtgcaagtgctaggggtgcaaggcatgatggcttgctaattgttcaaggaacacctgatctcatagaaaagcttgtgcggcttccttggttccccctttagacctggcccctcctatcttacccatcctgacccctttctgggcgcccctcatgaatcctgatcaggcctgtggttgtgaattgtatgtgtcctggtaaagcattgtatgcattatggtacaagtcatgtgccaattgcagctttgtcttgtcactgtggccttgtg

SEQ ID NO: 562055 - DNA, 535 bp, Homo sapiens
cgctatatcttgttgctatgagtacaacttttttttttggtattaaaagtaaagacagggtcttgcgatgtcgcccaagctggtcttgacctccgggcctcaagcagtcctcccccttcagcctcccaagctgctgggattccaagcatgaaccaccattcccggcctataattctggggtgtctaaactattaccaatgaatacaactttaggtttcttctccctttagttatctcgtctcttctctctagatttaaacttaagcaagcagaagcctctgggattctgtactgactagaataattcacggcttccttcttatggcgagtccctgtccatcataatcctcccgtggatcatgctgaataaacagctggtgacttgagatggggagaaattctacagagtttccttgcctgagcctttcaagggctaagactcaaaaggttcaacggcctaaagcaataaacaccaaaagaggttacattgcgaattggcttatcgcttatctagcagtggacactaatgaaccaa

SEQ ID NO: 562056 - DNA, 1241 bp, Homo sapiens
ggcctacgccatacggtcgatcgctccacggtgatagctagagcagagaggccctagatagagactacagacactctactgtacatatgcggagacagatttggcacttgcgtctagtgcggctttatattcgcacttcattgatggatgttaatccattgcgtggactttctataaggacgggagttggcagacttcctctgaggagaatgtccttagtaatcgctaatctagtttgatggacgtcgctaaacatctagggggtgactaacaatgggaatctatgtagagtcgttcgtgagaatattagagatgagcaaaaattcaggcagcgaatcatgtcaattggataggatggattgctcgtcatcttgaggctcgtgaatacacgacgataggagacattcattcagtgttcacctagtctgagaatgagtacaacggggtctccatcagacgccctctgtaacgcaagcagttgggagtctaggtgacttgaatcgtatgagtgatgaggagaatggtaattcgagaaattaagagtgttgtatttaaacaaggtggagagagatagagaagcaataaaagagataagagagtgggaaggtggggatattgaatggtagcggagtaagcggcgagcaaaaaacgatgagcgtctaaatgatagagatcttgggcgccctagccatggggcacatgatagcccgtggcttcgcctttcgcccgaagtgccttttgctatggggtgacagacagcgtaggtggtacataggtcgagcagcgggagcgaacttctcccaataattacaggggagcgcgacagtgattcaaatcctttggctcgggaatatacgactcgctccgaggggagtgtaaataggcacgtgtgtcaatcattggctggtgacaatggcgggggcgaagaacaaacaaggccaagggaagggaaaacgaccttcaccataggcacaccgagagagcaaagaagcgcgcccaaacatcggccaaccaaaggtggataggggcactgggccttggggcgtggggggtctaattccaaggcaaatttccttccgctatttactacaatacaaagggtaggtttccaaaagttctatacctagggtttgccaacacaaaggaaaccaagggtacctgagaattgaatcatcacaactaaattgggggcttagagacatttaacccccctttttccgaaccgtaggatccaaagccga

SEQ ID NO: 562057 - DNA, 162 bp, Homo sapiens
cggtgggtgtggggagcaggaggaagtctaggctggagatagacatcagcactgggaggatcactgaagctataggcttaagttctactagatcaacggctttgagactattgtgtctataacccacaggcaaaagtacattgtatatcgacaattctgtgt

SEQ ID NO: 562058 - DNA, 151 bp, Homo sapiens
cagtgcgccaaattcaaacagtgcccagagtcctgacagtgcccatagtccaaacagagtctagagttcaaacagtgcccagagttctaacagtgcccagagtccaaacagtgctcatagtccaaacagtgcccagagttcaaacagtgcc

SEQ ID NO: 562059 - DNA, 118 bp, Homo sapiens
gatgaggaagagaacgagaaacagaataaacagaactcgactagtgattctagtgaaggaaaaacaaaaagtgtacggcatgcgtatgtccacgaaccatatctttactacgaaatac

SEQ ID NO: 562060 - DNA, 546 bp, Homo sapiens
  misc_feature (380)..(380): n is a, c, g, or t
  misc_feature (424)..(424): n is a, c, g, or t
cttgcacatgtccaccacagcagacctcggagtactgctaagtgtacctgtgtcaaatccgcacaggactcaatatagccatttattcttgatgtatgcaattgcacattgtaattatattaacagagcacactaataatttgtatagattatatatattagatcttgggtatggtttttaccttctcccatggggaacttcttccttcctgatgtggaaatttgcaattatagaagggtggggggggacctttgaacaacaacgagcgcggctaagaacagagtgagagagggccatcctggttttatcatgtgcgcgcgcaaatgtatatagttgattggaatgaggttttatgaatattcatgtttttgaaggcctntaatttctgtctgcatattagcttttaatgtgtgattttaaganagaatactttgacacctcgtctcaatctaacatactactctccaccagacatttctacttatattcacttacattaccaggtctggaagtattttattcactatgtatatttatacctattt

SEQ ID NO: 562061 - DNA, 728 bp, Homo sapiens
  misc_feature (7)..(7): n is a, c, g, or t
  misc_feature (21)..(21): n is a, c, g, or t
  misc_feature (34)..(34): n is a, c, g, or t
  misc_feature (71)..(71): n is a, c, g, or t
  misc_feature (77)..(77): n is a, c, g, or t
  misc_feature (92)..(92): n is a, c, g, or t
  misc_feature (125)..(125): n is a, c, g, or t
  misc_feature (241)..(241): n is a, c, g, or t
  misc_feature (261)..(261): n is a, c, g, or t
  misc_feature (335)..(335): n is a, c, g, or t
  misc_feature (347)..(347): n is a, c, g, or t
  misc_feature (447)..(447): n is a, c, g, or t
  misc_feature (452)..(452): n is a, c, g, or t
  misc_feature (524)..(524): n is a, c, g, or t
  misc_feature (547)..(547): n is a, c, g, or t
  misc_feature (612)..(612): n is a, c, g, or t
  misc_feature (680)..(680): n is a, c, g, or t
  misc_feature (726)..(726): n is a, c, g, or t
gatgacnatatagccgtctanaatatggactatnaattctgcaggtgtctcttctcgccctggcggggaangccaanactaaggggctgcanagcggggtggacattggcgtcaagtactcgganaagcaggagcggaatttcgacgatgccaccatgaaggctggccagtgcgtcatcgggctgcagatgggcaccaacaaatgcgccaaccagtcgggcatgactgcctacggcacganacggcatctctatgaccccnagaaccatatcctgccccccatggaccactcgaccatcagcctccagatgggcacgaacaagtgcgccagccangtgggcatgacngctcccgggacccggcggcacatctatgataccaagctgggaactgacaagtgtgacaactcctccatgtccctgcagataggctacacgcagggcgccnaccanaacggccaagtcttccgcctgggccggcatatatatgacccaattatgcccccaaggcacaattggccgatngggctccctccggcaccggcgantgcccggacccggggaagtcctgaattccccttactaccaggaagaagcccgctatgagctccancagctctctcccaatctctccgaattcttgatcccttatctaaagattcttgatccctattctaaacngtatatattagcgccctctaaagatccacttctcttttaaaaaaancg

SEQ ID NO: 562062 - DNA, 848 bp, Homo sapiens
  misc_feature (6)..(6): n is a, c, g, or t
  misc_feature (88)..(88): n is a, c, g, or t
  misc_feature (106)..(106): n is a, c, g, or t
  misc_feature (137)..(137): n is a, c, g, or t
  misc_feature (233)..(233): n is a, c, g, or t
  misc_feature (396)..(396): n is a, c, g, or t
  misc_feature (440)..(440): n is a, c, g, or t
  misc_feature (451)..(451): n is a, c, g, or t
  misc_feature (453)..(453): n is a, c, g, or t
  misc_feature (582)..(582): n is a, c, g, or t
  misc_feature (600)..(600): n is a, c, g, or t
  misc_feature (656)..(656): n is a, c, g, or t
  misc_feature (677)..(677): n is a, c, g, or t
  misc_feature (682)..(682): n is a, c, g, or t
  misc_feature (687)..(687): n is a, c, g, or t
  misc_feature (689)..(689): n is a, c, g, or t
  misc_feature (705)..(705): n is a, c, g, or t
  misc_feature (757)..(757): n is a, c, g, or t
  misc_feature (847)..(847): n is a, c, g, or t
ttgctncagggccattgacaagcagcccaaacaagcggcccaccaaggccctagggtcgtcaacaagtgcagcagcaataaaggcgtnctcgtatatatgaaccancagcagcagagccaggccaggctcgcttgcncgcagtgaatcagcttctcgaagagcgcgtacctggggttgaactccagcgtgggcggcaggagcggtgcgcgcccctcctgggtcttggccagcngcggcatgcgcaggaagtggcgggcagcccccatctccagcacggtgaccatggcagggtgggtgtccagtgggagggtcaccttcacgttggtgaaacgcgaccccagcacaattctcacccaggccatgagcccctccgtctccttctctgaaaggcactnggcggctggggacctgcccccaaacttctcctccttgtagtganccacgactatntncgtttccacagagaacagcttcttcttgtcaaactcacgaaggtgcagcagggtgagcccatcaaactgctcaaagcagaagagaacctctgtgtctctctcctccatggcctcaaagtagggtgagtnccctgccaggggacggtngggggcgcacaggtagtagaagtagcgggtgccggcccgcatgcggctggcgtatnctgagaagctggttagctgcncggangcacngnaggactcgtagcgcanagctttgctatgttctccttgaactctgctcggtggcggtgacaatgccctnccgcatgaacaggccgtgatcttcaaaaaactttgcatacttcttagcatctcttttactctggtcaatgaagaatttgatcagcctctnc

SEQ ID NO: 562063 - DNA, 930 bp, Homo sapiens
gatggtcagtggttttggcaaatccccggtgtgagaggtggtagggagtgctcccggcggcgacggggccgatgttcaccagccgccggggcagtagtcgaaggcccggcgcggatgtcctgggtgccgcgttgcggggcagtgaacgcgcgccgggcgtggatgggccgtgcgccgggtgccagtacgctgtaccggtgctccgtccccgcgttgtacgcgccttcaggtcgaccccagcatttgggctgctcatcgctgctgggcggaggaggctgccgcctaagacgggcataaagagaatggcgtgcactttctgcagctagagctgattagtgggcgctggatgtgcctcctttggttgctctcccatgcacacaggagacagcggggccaccattgatacttggcaagtgtttgttgacatcctttgcttgcatggtcaagtgactgcccgcatgttgtcagctccgtgcgctttccaggcacattcaagcaagcagtggtgaaaccagtgggcatgagaaggtgccggtgttccaagggatgcagggggctcgacaaagggaagggaagcaggccccagcaggaagaagaaacatgttggaggccggaaaccccagtacgagggggctagaactcaggcttagaagacttctgcgtgcggggcggacagaccttttgcctccgatccactgccgacacagttgtgtgcttccagcacggataattaccctgcttgccagtggggggaccagattgtaacgtccggggtctgaggggccccctggagaaggttctggcgttccagccccgaaggcggcgtgagagcacctgtttggcgcgtgcccttgttcggggcgggctttggccttgttgggccagcactgtgcacgtgcgggcacaagtcccttttggctaccgcggggg

SEQ ID NO: 562064 - DNA, 322 bp, Homo sapiens
cacgaggtggacctgcactcagaggcttgaaatgacttacagcagcatgaatacaggttacttggacatgatccttaaagaaaaggccacttcaagtatggccaagaggatctcagaattcaaccatataggtgttcatcgcccaaaacagtccctgcaatcatccatcaccagcacggggacttaatgagcatgaccactttataatcagcacctttccaagcaaaatcacgttttctgcatggttgtttcatcacagcccaacacttccttatccagcctgagtctaatcagcctaatggctgccactgaacgacctggg

SEQ ID NO: 562065 - DNA, 1391 bp, Homo sapiens
agatcggcgtaggaatccagcgagttacaatccagtctcccggaggcatgagtagagaacgtgagagaatgtaacctctcctggtctctgggagtcatactagagcgaggcgtgggttgcatgccctgcctgtaccctcttgaccatccactaagcgagcaccactagggatcgaggagaattctgagtcacaggcaggaatacagaggaggcagatgggtacctatccacagtgcgcatactcgagatttcacgcccctactcgatcacactgatggagaacctatgcgggcgtatatcctaggcgcatgttcacctaaggaccagtttgaagcttacactggaaagtgacgctcacttgcactcagaagaagtagtgccatcttacttccgctcatatgaagactatctactcaaccgacgcaattggctctgtccctgctacttgcatgcgggtccccaataaataacgcgacctcatgaacagaagaatgtcatcaaacgcggcgcatcgatgttatacaaaccatcacaggagtacatcccgtgaaagaccagacacagtgtcgagccataggcattgccgcagaaactcgctcccttgacagcatcctcgtcgagattcaaagatcccagacgattgaagccgtcgcaagctctgagcgctaaatggagggatataatgccccaccgtaaagatcatcattgaggacaagtatcgaggctcctgctatgggaaccacgcggtactacgcgagacgcgactgcctaaagacggttcgtataggctccagaggccttatgccacttggagcgttgtcagggactcagatgccagctaagaaggctcatcaactgactacgtgcacagaatggaactaaggggagaagatcccagatctgatcaggggacccttgacttcgcagagcgaactgattggtcctggatgaattacatcctggctaaaaaggccaactggggagatggccgttggaacgcccatgaataatccgtgcaggcgaagggtactagggtgaagccatgacaaaggggggtaagggggcccatggtgagtttggcatcaccggggctaaaacctggaggctcccacgaacagaaaatggcccggcaccggggagaaacggacacacacgcaggtgactgtcggaggacactttacaccccgagcgaaaaaaaaaacagggtggaaatggtgatcaaaggggcccgacaccgaaaagggggaaaactgtgtacagaaaatcgagcccatgaaagatcacggggaaacgagaaactaccggagaggaaaagaaaagcgacagacaggcaaacaccgagaaacaaatagacagcgaacgtagaggaggacgaacaaaggtgggtcggt

SEQ ID NO: 562066 - DNA, 91 bp, Homo sapiens
  misc_feature (31)..(31): n is a, c, g, or t
  misc_feature (87)..(87): n is a, c, g, or t
ggggaggtgggtagagcccgaggccccccantagccgaccctggcttcgcgttgtctccccaggggagaataatcgagggctgccgnctac

SEQ ID NO: 562067 - DNA, 344 bp, Homo sapiens
taacaaaatgggatcgcagggcaaacacaggcatggttcccccgaaagattgagttgtcaggcgcgtccgacttgaccactgcattggacctggtgccttcgacacatttctccatgggacaccctgtccatgagcgtcagtcccaatcggtcctcgagggcaataatcgtgcgttccaaatacgtggcatctgcctggtgcattttcggaggcaatgcaatccattggtcatgttcaatacgcaggcttccagttgccgaaatattcggcacgcatgggttcaaggacctggcacataaagtcgacaaattcactcgccagtggcagggcacccactcgggac

SEQ ID NO: 562068 - DNA, 264 bp, Homo sapiens
tccggaccttgtttactgaagcttacccataaacatttaagatctttatatttcacctttttgtttgtttggagacaaggtctcgctgtggaatgcagtagtatgatcacagctcactgcagcctttacttcctgggcttaagtgatcttcttgcctcggcctcccgagtagctgggactacaagcatgaaccatcatgcccggctaatttttaaaattcgtttgtacagacggggttctcatgttggccaggctggtctcgaa

SEQ ID NO: 562069 - DNA, 171 bp, Homo sapiens
taaaataaaaacactgaataacaggtatggcgagggacgtggagcagctagaattttcttttcttttcttttctttttttttcgctgacagtagtctcactctgtttgcccaggctggtagagtcctccccaggtgcttcaggagtcctgtggtaccgacgctcgagattc

SEQ ID NO: 562070 - DNA, 132 bp, Homo sapiens
catagcttgaggaaggcctagggctagtactgggccaggagctggggcctgggccagagctggatgccatggttaggcaagggcctggggccaaagcttaggcctggcttatagatattccccaaagggaac

SEQ ID NO: 562071 - DNA, 145 bp, Homo sapiens
atcacagtctcagcctactcactcagcactatagttgtagcaggaatttcttactcatccgcttcacccgcctagcagaaaataagcccactaatccaaactctaacactatgcttagtgcgctatcactactctgtataggggg

SEQ ID NO: 562072 - DNA, 423 bp, Homo sapiens
cggggcccccatatggtgcttcgcggcttggacaccctctttctcttagaagaggtttccggcggttccctgagggcccccgtttcttttatttggggggtgtttttccccttttatcatcccccgtctgggggagaacacgttgggggcccaccagtttcgggggggagccttcggggtttagggggaaataaaaaaggggcccccccccccccaaatttggttccaggtgggccgggccaaattttcgttgggacccatggaaatccggccttttttggcccccattttaatggaaggggggggatggtttggttttttggggggggccccccaagcccaaccctcttgttcgggggggagaccaaattttttttttttttttggggggggggccatttaaagggttttttttaggctcca

SEQ ID NO: 562073 - DNA, 116 bp, Homo sapiens
gagctcgctacccactttccgagtaggtgttggtctttccttaaaaggagcagaggtctcattttttgtggcttctacttaggcctactatgggtgttaaattttttactctctct

SEQ ID NO: 562074 - DNA, 579 bp, Homo sapiens
  misc_feature (566)..(566): n is a, c, g, or t
  misc_feature (569)..(570): n is a, c, g, or t
  misc_feature (572)..(572): n is a, c, g, or t
  misc_feature (575)..(576): n is a, c, g, or t
ccgctccactctgacctcacccctgagtccaggctgaacgcacgctcctccgtggcccccgcttccaccccgtgcatgtggggggcttctgctccgctccctcctgttccggggtccagcgggcggctccccagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatccgggagcttccagactcccagaagcctcggcacccctgtctcctcctgggtggctccccactctggaatttccctaccaataaaagcaaatctgaaagctcanaannanaanngaa

SEQ ID NO: 562075 - DNA, 551 bp, Homo sapiens
gaaaatctacacacctgcaaagtcccttttgccacatcatcggaagaaacaaaaacaagctgtggtgaagaagaaacgttttctaaagcctcttttatccccaggatggttgagaagtcagaggcctgcaatgctaggaagagagggtctaaagtgtccttttcaccgtgatgtaagtaggctctccagcagtcccagaagactttcacaagaagagtttcaacaacagaaaataagcctaagtgattgtgtgaatatcacagagcaacagagaaaatgtagatcactccagttctagcacaaggtcggggaggaaaaagaatcagagagtttggaatttctaaatgctcgtgtttgagaaatggggagcatcacaaactaacagcagaggtggacattttttacagggtaaaggattcccatggaacaccactcgtcaaatgcaaataaaaattgtacaaagaaggtaacttctttctctgtccccacatctctccatctgaaacttcattcttccattaaaacagaattgtgctttgtgaaaacaaaaa

SEQ ID NO: 562076 - DNA, 2509 bp, Homo sapiens
  misc_feature (1060)..(1060): n is a, c, g, or t
  misc_feature (2496)..(2496): n is a, c, g, or t
  misc_feature (2499)..(2500): n is a, c, g, or t
  misc_feature (2502)..(2502): n is a, c, g, or t
  misc_feature (2505)..(2506): n is a, c, g, or t
atcacagcagcccgggcttaactcaaacaatgcacttccctaaaagctccacagcttcaggtcgtagtgaagaatcaagaacttcgcacagcagcacaacacacacaatatcttctcctcctagcaccacatcagcgcttgttgaagaacgtaccagctactacagcagcccgggctcaattgcaacaacacactttcctgagagctccacaacctcaggccgtagtgaggaatcaacagcatcccacagcagcccagataccaatggaatcacacccttacctgcccattttactacctcaggccgcattgcagaatctaccaccttctatatctctccaggctcaatggaaacaacattagccagcactaccacaacaccaggcctcagtgcaaaatctaccatcctttacagtagctccagatcaccagaccaaacactctcacctgccagcatgacaagctccagcatcagtggagaacccaccagcttgtatagccaagcagagtcaacacacacaacagcgttccctgccagcaccaccacctcaggcctcagtcaggaatcaacaactttccacagtaagccaggctcaactgagacaacactgtcccctggcagcatcacaacttcatcttttgctcaagaatttaccacccctcatagccaaccaggctcagctctgtcaacagtgtcacctgccagcaccacagtgccaggccttagtgaggaatctaccaccttctacagcagcccaggctcaactgaaaccacagcgttttctcacagcaacacaatgtccattcatagtcaacaatctacacccttccctgacagcccaggcttcactcacacagtgttacctgccaccctcacaaccacagacattggtcaggaatcaacagccttccacagcagctcagacgcaactggaacaacacccttacctgcccgctccacagcctcagaccttgttggagaacctacaactttctacatcagcccatcccctacttacacaacactctttcctgcgagttccagcacatcaggcctcantgaggaatctaccaccttccacaccagtccaagcttcacttctacaattgtgtctactgaaagcctggaaaccttagcaccagggttgtgccaggaaggacaaatttggaatggaaaacaatgcgtctgtccccaaggctacgttggttaccagtgcttgtcccctctggaatccttccctgtagaaaccccggaaaaactcaacgccactttaggtatgacagtgaaagtgacttacagaaatttcacagaaaagatgaatgacgcatcctcccaggaataccagaacttcagtaccctcttcaagaatcggatggatgtcgttttgaagggcgacaatcttcctcagtatagaggggtgaacattcggagattgctcaacggtagcatcgtggtcaagaacgatgtcatcctggaggcagactacactttagagtatgaggaactgtttgaaaacctggcagagattgtaaaggccaagattatgaatgaaactagaacaactcttcttgatcctgattcctgcagaaaggccatactgtgctatagtgaagaggacactttcgtggattcatcggtgactccgggctttgacttccaggagcaatgcacccagaaggctgccgaaggatatacccagttctactatgtggatgtcttggatgggaagctggcctgtgtgaacaagtgcaccaaaggaacgaagtcgcaaatgaactgtaacctgggcacatgtcagctgcaacgcagtggcccccgctgcctgtgcccaaatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaacggcacagggaacagtatgatgtgcctcaagagtggcgaaaggaaggcacccctggcatcttccagaagacggccatctgggaagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatccgggagcttccagactcccagaagcctcggcacccctgtctcctcctgggtggctccccactctggaatttccctaccaataaaagcaaatctgaaagctcanaannanaanngaa

SEQ ID NO: 562077 - DNA, 447 bp, Homo sapiens
  misc_feature (447)..(447): n is a, c, g, or t
gcaacaagagcgaaactccatcgcaaaaaaaaaaaaaaaaaaaaaaaaaaaaaaatgtggtgggcggccggggccagtcgaagaaagcgttcaaaaaccaattcggttggggcagccgcggggccccagaagaggaaacaggaggacacgtgggtcccactaactgtgttacccctagagagaaagaatctcgcgggccatcgaggcaacaagaggcgagcgcgatggggatatatctcaataacacacaaaatatagaaaagaacgagccgcgcggcgggaaccaccaccaagagccggcttctcgtgaaaacaatctcaccgagaacagtgaagatttccagaggagggactcaaataacggcggacactcaatatacaacaggaggagcactaacaagagcggagtccgcaaagtataaaattaacgcccccaccgccgaggan

SEQ ID NO: 562078 - DNA, 2106 bp, Homo sapiens
  misc_feature (657)..(657): n is a, c, g, or t
  misc_feature (2093)..(2093): n is a, c, g, or t
  misc_feature (2096)..(2097): n is a, c, g, or t
  misc_feature (2099)..(2099): n is a, c, g, or t
  misc_feature (2102)..(2103): n is a, c, g, or t
cgatctagaagatcccgctgattccagaaagaatacactctcacctgccagcatgacaagctccagcatcagtggagaacccaccagcttgtatagccaagcagagtcaacacacacaacagcgttccctgccagcaccaccacctcaggcctcagtcaggaatcaacaactttccacagtaagccaggctcaactgagacaacactgtcccctggcagcatcacaacttcatcttttgctcaagaatttaccacccctcatagccaaccaggctcagctctgtcaacagtgtcacctgccagcaccacagtgccaggccttagtgaggaatctaccaccttctacagcagcccaggctcaactgaaaccacagcgttttctcacagcaacacaatgtccattcatagtcaacaatctacacccttccctgacagcccaggcttcactcacacagtgttacctgccaccctcacaaccacagacattggtcaggaatcaacagccttccacagcagctcagacgcaactggaacaacacccttacctgcccgctccacagcctcagaccttgttggagaacctacaactttctacatcagcccatcccctacttacacaacactctttcctgcgagttccagcacatcaggcctcantgaggaatctaccaccttccacaccagtccaagcttcacttctacaattgtgtctactgaaagcctggaaaccttagcaccagggttgtgccaggaaggacaaatttggaatggaaaacaatgcgtctgtccccaaggctacgttggttaccagtgcttgtcccctctggaatccttccctgtagaaaccccggaaaaactcaacgccactttaggtatgacagtgaaagtgacttacagaaatttcacagaaaagatgaatgacgcatcctcccaggaataccagaacttcagtaccctcttcaagaatcggatggatgtcgttttgaagggcgacaatcttcctcagtatagaggggtgaacattcggagattgctcaacggtagcatcgtggtcaagaacgatgtcatcctggaggcagactacactttagagtatgaggaactgtttgaaaacctggcagagattgtaaaggccaagattatgaatgaaactagaacaactcttcttgatcctgattcctgcagaaaggccatactgtgctatagtgaagaggacactttcgtggattcatcggtgactccgggctttgacttccaggagcaatgcacccagaaggctgccgaaggatatacccagttctactatgtggatgtcttggatgggaagctggcctgtgtgaacaagtgcaccaaaggaacgaagtcgcaaatgaactgtaacctgggcacatgtcagctgcaacgcagtggcccccgctgcctgtgcccaaatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaacggcacagggaacagtatgatgtgcctcaagagtggcgaaaggaaggcacccctggcatcttccagaagacggccatctgggaagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatccgggagcttccagactcccagaagcctcggcacccctgtctcctcctgggtggctccccactctggaatttccctaccaataaaagcaaatctgaaagctcanaannanaanngaa

SEQ ID NO: 562079 - DNA, 1010 bp, Homo sapiens
aataaacatgctagctttgattccagcttctaaccaaaaaaataaaccctcgtgccacaggaagctgccatcaggtatttcctcacgcaaaccagcgcatccataatccttgctaatagctatcctcttcaagcaatatactctccggacaatgaaccatatgtcaatagtagctcaatcaatactcatcattaataatcaatatatggctatagcgaataagactaggaatagccccacttttcacgttcttgagtgccagaggttacccaaatggtcgacccctcgtgacaatcgcgcgccttgcattcattctcacatgacgagaaaaactagcccccaatctcaatctatataaccaagatcatctcccatctacataatactgtaagccccttcgtcctcactctcctctaaatcttatccgaatctatagacagggcagtcctgaggtggaattagaatcaatagaccagcatactgcaaaatctttaggcatactcctcaaataatccctacatatggatgaagtacatacgcaagtactaccgtacaaccataacagtaaccattcttactttagctattatatattatcctaaagtactaccgattccgtacttactcaaacttgaacgtccagcaacatgacctaatactatcgttcgagacatagaagacaatgctaacattgactatagacgttaattccatccagcctcctctcgctaaggagggcctgcccccgatggacggttgttgccagatgggcattatcgaaggaattcacgaaaaaacaatagacttatatcccacattataagcaggattagccttctttaagctctattttaacttaagctaagtgtatgccactcatacatatgcccatatttaaaaggtaaaataatggagggttggtataaaaacaacgcatttttccacaaattggcgtaagtaactaccaatgttcgcaaagataattttaaagaaacacaaaaagagcaaag

SEQ ID NO: 562080 - DNA, 2151 bp, Homo sapiens
  misc_feature (3)..(3): n is a, c, g, or t
  misc_feature (702)..(702): n is a, c, g, or t
  misc_feature (2138)..(2138): n is a, c, g, or t
  misc_feature (2141)..(2142): n is a, c, g, or t
  misc_feature (2144)..(2144): n is a, c, g, or t
  misc_feature (2147)..(2148): n is a, c, g, or t
ggnacccttcctctcacaatgtaagaaaacctggaccctgctggcacactaatcttggacttctcagactccagaacaaacactctcacctgccagcatgacaagctccagcatcagtggagaacccaccagcttgtatagccaagcagagtcaacacacacaacagcgttccctgccagcaccaccacctcaggcctcagtcaggaatcaacaactttccacagtaagccaggctcaactgagacaacactgtcccctggcagcatcacaacttcatcttttgctcaagaatttaccacccctcatagccaaccaggctcagctctgtcaacagtgtcacctgccagcaccacagtgccaggccttagtgaggaatctaccaccttctacagcagcccaggctcaactgaaaccacagcgttttctcacagcaacacaatgtccattcatagtcaacaatctacacccttccctgacagcccaggcttcactcacacagtgttacctgccaccctcacaaccacagacattggtcaggaatcaacagccttccacagcagctcagacgcaactggaacaacacccttacctgcccgctccacagcctcagaccttgttggagaacctacaactttctacatcagcccatcccctacttacacaacactctttcctgcgagttccagcacatcaggcctcantgaggaatctaccaccttccacaccagtccaagcttcacttctacaattgtgtctactgaaagcctggaaaccttagcaccagggttgtgccaggaaggacaaatttggaatggaaaacaatgcgtctgtccccaaggctacgttggttaccagtgcttgtcccctctggaatccttccctgtagaaaccccggaaaaactcaacgccactttaggtatgacagtgaaagtgacttacagaaatttcacagaaaagatgaatgacgcatcctcccaggaataccagaacttcagtaccctcttcaagaatcggatggatgtcgttttgaagggcgacaatcttcctcagtatagaggggtgaacattcggagattgctcaacggtagcatcgtggtcaagaacgatgtcatcctggaggcagactacactttagagtatgaggaactgtttgaaaacctggcagagattgtaaaggccaagattatgaatgaaactagaacaactcttcttgatcctgattcctgcagaaaggccatactgtgctatagtgaagaggacactttcgtggattcatcggtgactccgggctttgacttccaggagcaatgcacccagaaggctgccgaaggatatacccagttctactatgtggatgtcttggatgggaagctggcctgtgtgaacaagtgcaccaaaggaacgaagtcgcaaatgaactgtaacctgggcacatgtcagctgcaacgcagtggcccccgctgcctgtgcccaaatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaacggcacagggaacagtatgatgtgcctcaagagtggcgaaaggaaggcacccctggcatcttccagaagacggccatctgggaagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatccgggagcttccagactcccagaagcctcggcacccctgtctcctcctgggtggctccccactctggaatttccctaccaataaaagcaaatctgaaagctcanaannanaanngaa

SEQ ID NO: 562081 - DNA, 737 bp, Homo sapiens
tgtagctgcgccggcgcccagctctcgagaggactgtgtggagggcagaggctgaaacgatggccgcctgccgagttcctccacatgacccctgtggcgaggagcgctctgctggggactgcgccagtcggtgccttccaggcctggactctcagctccgatgctgcttttggccagagttcccaaaggcgggtgtggttgtctttggtgggaaggttcatgcgcaccgcgatagtaataggggagcaagcactcgctgagcccagtgcagggcctggaccgtgctccatagcaatgcactgatcttgggctattggtttgggaggaaagagggagcacaaggactggacacggggccatgggaagagaggtcacggatgggagaaggacgagtccgcatccgatcggaggagtttgtcactcagtgcctgagtgggaggcactgtgaggcacggtatgaggccagtcagcagcatgcgggcacaggccagagaagccagaggggtttgctggtgggtgggcccccagcctttgtccatgggaacgtgcaggtctggggagcttgccgatctcggggtgtgacgggtaaccgggctggcttgtgtcccagctctccttctcaggctcactggacccctgaccggatatgatctgccatttatccaaggcttttgaccagagcctcttgggcttccttgccaccatgtgccctagctatagggcttcggtaccctcca

SEQ ID NO: 562082 - DNA, 2434 bp, Homo sapiens
  misc_feature (1060)..(1060): n is a, c, g, or t
  misc_feature (2421)..(2421): n is a, c, g, or t
  misc_feature (2424)..(2425): n is a, c, g, or t
  misc_feature (2427)..(2427): n is a, c, g, or t
  misc_feature (2430)..(2431): n is a, c, g, or t
atcacagcagcccgggcttaactcaaacaatgcacttccctaaaagctccacagcttcaggtcgtagtgaagaatcaagaacttcgcacagcagcacaacacacacaatatcttctcctcctagcaccacatcagcgcttgttgaagaacgtaccagctactacagcagcccgggctcaattgcaacaacacactttcctgagagctccacaacctcaggccgtagtgaggaatcaacagcatcccacagcagcccagataccaatggaatcacacccttacctgcccattttactacctcaggccgcattgcagaatctaccaccttctatatctctccaggctcaatggaaacaacattagccagcactaccacaacaccaggcctcagtgcaaaatctaccatcctttacagtagctccagatcaccagaccaaacactctcacctgccagcatgacaagctccagcatcagtggagaacccaccagcttgtatagccaagcagagtcaacacacacaacagcgttccctgccagcaccaccacctcaggcctcagtcaggaatcaacaactttccacagtaagccaggctcaactgagacaacactgtcccctggcagcatcacaacttcatcttttgctcaagaatttaccacccctcatagccaaccaggctcagctctgtcaacagtgtcacctgccagcaccacagtgccaggccttagtgaggaatctaccaccttctacagcagcccaggctcaactgaaaccacagcgttttctcacagcaacacaatgtccattcatagtcaacaatctacacccttccctgacagcccaggcttcactcacacagtgttacctgccaccctcacaaccacagacattggtcaggaatcaacagccttccacagcagctcagacgcaactggaacaacacccttacctgcccgctccacagcctcagaccttgttggagaacctacaactttctacatcagcccatcccctacttacacaacactctttcctgcgagttccagcacatcaggcctcantgaggaatctaccaccttccacaccagtccaagcttcacttctacaattgtgtctactgaaagcctggaaaccttagcaccagggttgtgccaggaaggacaaatttggaatggaaaacaatgcgtctgtccccaaggctacgttggttaccagtgcttgtcccctctggaatccttccctgtagaaaccccggaaaaactcaacgccactttaggtatgacagtgaaagtgacttacagaaatttcacagaaaagatgaatgacgcatcctcccaggaataccagaacttcagtaccctcttcaagaatcggatggatgtcgttttgaagggcgacaatcttcctcagtatagaggggtgaacattcggagattgctcaacggtagcatcgtggtcaagaacgatgtcatcctggaggcagactacactttagagtatgaggaactgtttgaaaacctggcagagattgtaaaggccaagattatgaatgaaactagaacaactcttcttgatcctgattcctgcagaaaggccatactgtgctatagtgaagaggacactttcgtggattcatcggtgactccgggctttgacttccaggagcaatgcacccagaaggctgccgaaggatatacccagttctactatgtggatgtcttggatgggaagctggcctgtgtgaacaagtgcaccaaaggaacgaagtcgcaaatgaactgtaacctgggcacatgtcagctgcaacgcagtggcccccgctgcctgtgcccaaatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaacggcacagagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatccgggagcttccagactcccagaagcctcggcacccctgtctcctcctgggtggctccccactctggaatttccctaccaataaaagcaaatctgaaagctcanaannanaanngaa

SEQ ID NO: 562083 - DNA, 172 bp, Homo sapiens
  misc_feature (54)..(54): n is a, c, g, or t
  misc_feature (78)..(78): n is a, c, g, or t
  misc_feature (95)..(95): n is a, c, g, or t
  misc_feature (107)..(107): n is a, c, g, or t
ggctccccctgccccccggcccccgggttctcgggtcggggggtttgggggggncttggaggtgacctgcttctttgnttcatcagcggctgttnccccagggctgngggggcctccttgctctggggggggtcttcgtccatccttggtgggggggggtgccccgcccctt

SEQ ID NO: 562084 - DNA, 794 bp, Homo sapiens
  misc_feature (781)..(781): n is a, c, g, or t
  misc_feature (784)..(785): n is a, c, g, or t
  misc_feature (787)..(787): n is a, c, g, or t
  misc_feature (790)..(791): n is a, c, g, or t
aattgataaacaatagaagtttatttggctcacagttctggaggctgggaagtccaagatcaaggggctgcatctggtgaggactttcttgctgcatcacagcatggcaacatggcagtcttggccaccacagagcacagcaccacatggggaagctgagatggagcgtctgggtctcacttttcccagccgcagcccagtgatgcagggtcggaggggtggtcggcagtgggaaagggcgtagggcagatgccgggctgactcttccttttgccagaggaaatcccctctgccccctagtcctccccctaccaaggctcccatcactcatcacggcctctccctacagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatccgggagcttccagactcccagaagcctcggcacccctgtctcctcctgggtggctccccactctggaatttccctaccaataaaagcaaatctgaaagctcanaannanaanngaa

SEQ ID NO: 562085 - DNA, 1291 bp, Homo sapiens
acggttgtttaagacactcttgtggggcactacacagctagtttgctctcacaaatgatctggcccttttcattcaagttgttggtggggcactctctacagtatcgggtggtcactcctggcagcgacgtcgccgtttttggacaaaaatttttgtacgaaaatgatagggcataatttattgcttggccttacattgctctgttcgcccaaaaccataccgtgctggaaatttgtaggttttcttggctgtaatccggcattgtatgccttgtgggctcccaaacggatccctagtggctttagacacacaatgtgtgcaagcaaacgttgggtttctggtcattgtaaaggggatgtgatctcacctcccgaatccctattggcctggtaaaaatggcacacaacttaaagtagactagaagtctggttgacggaggaacttatctcagaatggtgcaattgttgtccataagtctaaaaagaatggtggcattatgaaggagtgcaagtctagccctatcagagtggcccactcctagcggcatccaggggccagcacagaggaccattgcaccactcgagcacaggatgaactgggttcgaaatcccggctccacacttagcttgaccatgtgacttgtagcaagttattaacctaacctcagccctgctatgagatttccttcactcgaacatgtagcgatcaatacatttggactctacacgcaaggaatgggtaactgtcaagaattaagataatacatatcaagagcatttgtgacagtgccgtcacgtatcctcctccaggtaggctcgttatgaccttcttcaccgttccagttaattacgttcgcatttcgagcatcttgttcatgctccagttctaagaaagtcacacgatccactgagcagcacagccaacaccttctctcccagacatcgtgagctgtgatcaatgatcatcagctatgattaaatagcctagtcttatgttatgacattgtgctaagtgcgacactaacacacacacagaggtccttctagaaattgccagctctataagtggacgagtaactgctataatccagtagactagacgcacactgcacttaggcaaacagtggacaatgtacatatggcgtgaacatttccgaatattctgacaagtataatgtactattatataagacaatgtcgggccgggcgtcgctggctcctaagccgtgttaaacccagcactgttggtaggccgaggtgggatggatcacctggaggttgagatcttcga

SEQ ID NO: 562086 - DNA, 355 bp, Homo sapiens
cttgcgagggggaaccccgtgcgggatttttcctccgacactccggtatctccttcagactcacaaacctctctggggtcctcccttgtctccctcaggtctttgccctcagcccacagtatctctttcagctactctgaatacttttctagattccagctggagtcagttcccaggcacccacgaaacaccaacaatactacacccatatcactgactacatagtatacaaccccaggcctaaaaggactcttactgtctctctacatatactctccaaccaactccagatatcagctggagtcaaattcccacacccaggagtaacctagaaactcacagaacttactggcac

SEQ ID NO: 562087 - DNA, 140 bp, Homo sapiens
ccatggatgagacggcttcagttacttcctcttgaccacactgcctcgtgacactgtgctgctgctgtcactgctgccgtgcactgtcaccggctcagtccctgggcccctctaccctcaggcataccccgcccagcttc

SEQ ID NO: 562088 - DNA, 1109 bp, Homo sapiens
gaaattatgttaagtgaaatatcaatgaaaataaagtttactataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaagaaaaagaagaaaaagagagagagagagagagagagagagaggggcggggcgggtggtggtatatgtgttgttatggggcggagggtggcgtatttgatctacagagctggagttattattattattagtggtgtagagacgggtgcgagtagtatgtagggtaggcagtttgagtgggagggagggaggggggacgaaagagaacacaaacggaagggggggggggggggggggggaggaagggagggagagagggaaggacagaagagaacagaggaggaggaaggaggggagagaggagaggtagtaacaaaaaataaaaaaaaggaaaaagaaaatagatcaaaaagaaaagaagatcaaaaaaagatacaaaaaagaaaagaaagaggaagaaaggaagaaggacaaaaaaaagaaacgacaaagacgaaaaaaaagaaaaaaaaaaaaaagaagagaagagaggagaagatgaaaaaaaaaggacgacacacaaagaagagaaataagaaggagaaaagagaatactaggaaggaaaagagaaaagcgcatggcagaagagcagaacggagagaaaaacaaggacagaacagaagagaagaaagggaaaagaaacagaagaggagaggaagagaagaagacagagaggcagaaagagaacaaggagaggagggaacggaagaagggagagcggaaagcgaagaaaagaaaagaaagagaaaaagggggaaggaggagaagaaacgaagagcgaaggaggagaaagaaaagaggaaaaagaagagaggaaaggaagaaaaaaaaaagaaaaaaaaagaagagagaagaaaacaggagaaggagagaagaaaaaagtaaaaaagagagagagaaaagaagaagaagagaggcaaagagcgcaaacggtaacgtagataaagacaaac

SEQ ID NO: 562089 - DNA, 367 bp, Homo sapiens
  misc_feature (44)..(44): n is a, c, g, or t
tgactctagaggacccgatgtatcgcccaacacacatacacatntattcttgtactattacatgtcttttaaaaatatttatctggtcgagtgtggttgctcatgctgtaatcccagcactttgaggggcaggcagatcacttgaggttatgagttcgagaccagcctggccaacatggtgaaaccccatctctactaaaaatacaaaaattagccggatgtagtgatgcatgtctgtggtcccagctactcgggaggctgaggtgggagagtcccttgaacctgggaagcagaggttgcaagtgagccaagattgcatcactgcactccagcctgggtgacagagtgagaccctgtctccaaaaaa

SEQ ID NO: 562090 - DNA, 958 bp, Homo sapiens
  misc_feature (1)..(2): n is a, c, g, or t
  misc_feature (113)..(113): n is a, c, g, or t
nntatataagatagccacacacgacgatcgtctgaatgattgtgcaggttccagcgccgcagtgtctcgcagactggccatatgcttgccaaccatctgtgaggtggacggcnacgcatttccaatggggggcctataacacttgcgtgtgggagaacttggaagacgcttattcaattggtccgaggaacattctccttgttgggcgacgactcctcctctcatatggccgcccgggtaccggccattgggcggtggacccaggtcctgttgcacccacgggtttggggaccccctcggtcgcgccacataggggcccccctctttttccgttaacctgtgaaatgttgttgatacagccctgttttgaaagctttggcgcagatcccccaaggtggtctaattatgtcccacggcgcaagggagtgcgttccatggttctccccccccagaacgtgttgttgctcctaatggaagatgtgcgagtattgaaaacgcgcccgttagcgtgttccgacgcccgaaactctgttcccccagaaagtttacagggcaataaggggtcgtgtgtcgggcattgtctgcaaaaagaagatctcccgctctgcaggcccgtggcgccttggtggacgcccccccgcgaggtccacccacccactctgggagggccatggcgcaagtgcagcttcaccacagttcacaggggtttccacactcaaccctcggccaccataagcgggacacacgcgtgctgtgtagaaaaaaatggcatagtatgcacctcccgcgcatacccacaggcgcctccctaccatggcccccacactcacgggagagagtatggccacagaaaatattgttcataacccgagcgaccgcacgaggggtcccgagacgcaccaacatatcgcccttgtttcccccccgggggcccagacgggtctgcgcccacaaaaca

SEQ ID NO: 562091 - DNA, 149 bp, Homo sapiens
cagaatgtggctctgagtgcagaggacaagcttcttatgcgacaccagctgcggaacacaagatcctgaatgaaggtcttcccaaccaggtcctgaagcccttcctggaggattccaagtcccaaatctgctgccctattgtgggcaca

SEQ ID NO: 562092 - DNA, 214 bp, Homo sapiens
acttcttcgagttactaggagatagtgcgagacaatatctccttcgggtgagcggaaatgttctggatcttgatcttctgacgaataataggcgaaagtctgcttcgagatcggcctcctggtcactggtggagtcctggatctggtagcttctgcgagtcactggtggagttctagaacgtgagcggcggcgtgtagttggtgttctagacct

SEQ ID NO: 562093 - DNA, 1960 bp, Homo sapiens
  misc_feature (35)..(35): n is a, c, g, or t
  misc_feature (1601)..(1601): n is a, c, g, or t
  misc_feature (1606)..(1606): n is a, c, g, or t
  misc_feature (1609)..(1609): n is a, c, g, or t
  misc_feature (1615)..(1615): n is a, c, g, or t
gatgggaagagcagtacctacatcaatgctgctcntatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggacccaaattaaaacattttgctgaatatgtatagtttttcacaatttcatagggaaataatggnttggngancatacntgagaaatgtgcacattaaaagggcttgctgacaacttgcacaatgttgaacatagcctttaagcatcatttaaattttaaagggatggaggtttttagcctgtgggccaacactggtcaagagaacaagatggcaacatatatgctttcagggtcaaatttgagcaaactgtgaactgtgagggtgagatgtgaacacatcaatgccagattcctgtgttgcgcattgtcatggggattttaagtgaacctttctaaatgtgggcttggtcacatgctccacgtagctgtgaacttacaatcatcagcttgcaggttgtattgactaaagcatttcagtggcct

SEQ ID NO: 562094 - DNA, 851 bp, Homo sapiens
  misc_feature (35)..(35): n is a, c, g, or t
gatgggaagagcagtacctacatcaatgctgctcntatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactata

SEQ ID NO: 562095 - DNA, 858 bp, Homo sapiens
  misc_feature (35)..(35): n is a, c, g, or t
gatgggaagagcagtacctacatcaatgctgctcntatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtggggccgacatttttgggaggaaggaatacaacattcatttcataatagtatccttacaataagatcacaggatggcgcaacgttgggatcctcttg

SEQ ID NO: 562096 - DNA, 211 bp, Homo sapiens
  misc_feature (8)..(8): n is a, c, g, or t
  misc_feature (13)..(14): n is a, c, g, or t
  misc_feature (17)..(17): n is a, c, g, or t
gccagggnggtcnnganttcctgtccccaagtgatcccatctggcctgtctctacctaaaaataaaaaaatttagccaagaatggtggggatgccctgtaatcccagttacttgggagacgagggaggggaatggccggccctaaggggaagaggtggaggtaagcggagaatggggcgctgcactccgccggtgaagagcaagactgact

SEQ ID NO: 562097 - DNA, 154 bp, Homo sapiens
ataccagcagcaagactagggtcatatggttacacatagtgacttataccaagcatttgaaaaagaacaccaatctttctcaaaatcttctaacaaaaaaaataaggggacaatacttcactaattgcattttatcgagtgccacaattgaccc

SEQ ID NO: 562098 - DNA, 234 bp, Homo sapiens
cgtatacggtcgggtgcgtgagccagacacaccactgcgctccaccttgcgacagagtgagactctgtctcaaaaaaaaaaaaattttttggcgggctttgggggcccacacttggggccctggcttctggggctgtttaaacacaagattaccttgaccccagggggctcctttgagcggggaaacggcccattgatgtccagctgggttgccaggtcaagattttttctaaa

SEQ ID NO: 562099 - DNA, 162 bp, Homo sapiens
gatagctggtccagagatacaacaggatgaataccatcccccagacccgatccatatcagtcacggatccttgcagagtcggaatctaaactggtatagcatccttgtggaagttgattacattctaagtgacctaccagaaagcatgggacacatctgggg

SEQ ID NO: 562100 - DNA, 1295 bp, Homo sapiens
  misc_feature (35)..(35): n is a, c, g, or t
gatgggaagagcagtacctacatcaatgctgctcntatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatgaaatgttgatgctttaatatagtaataaaaactaattcagtcctttttattaagatacacaacttcataaacaaaatacttttacctctcaaatgtaaaagtctcccaccccccacattaaaatctttctgcacaagtgtaacaggtacaacagctgctggctcaatagatggacaggtttcttcatggatgcactttaaagagtctcacccaactaagatgattccaggtactccaaagctacatcatagcagaaacggtattgctgtcaggggagaaga

SEQ ID NO: 562101 - DNA, 723 bp, Homo sapiens
gttttcgggcttgtaccgctggcggtgcggcctggtgtcggcttgcaaggttctttctgtgttgttctctgccctgccagggccgtaagctggtgcgtgcgggtagcggggctctccgaggagccgacgcggggaccatggtccacctcactactctcctctgcaaggcctaccgtgggggccgtttaaccatccgccttgccctgggtggctgcaccaatcggccgttctaccgcattgtggtgctcacaaccaagtgtcccaggatggccgttcgtagagcagctgggctcctatgatccattgcccaacagtcatggagaaaaattcgttgccctcaaacctagacaggatccgtcatctggatggctgggggccaacatctctaagcctatggaaaagctttcgtgggtctatgctggatttttccctctgcatcctatgattgattcaaaattgctgagagatgcgaaaggaaaacgggcacgtgaaagtccttgtaagttctcagaaaaacagatgcagaagctacagatacagaggctacagagaccataaatgaggttgacttttagtgagccatagcagtgggaacaaggtcaaggtctttctgaaacacttgcagcgatctaattgtgtagatttggggtcactaaatggggttatcctgacaaataaaaaaaacaagaaaacaaactttggcggcgttaacgccctagaaat

SEQ ID NO: 562102 - DNA, 1072 bp, Homo sapiens
ctaaccaagcgtccgtggcaggaatttgttgtgcgtggtttccttgtataggcgtaatcgaattattaactggggcgtattgggagtaactgctagtagtatatcatggagacttatcatactagaatatgtttcatttaacccatacaagccgcttcgagagtaagtaagcacgcagacgttgcaccaatcaggacgtaatgatttccgggtagcccatggaggcgattgatagagagacaattaacgtcgttggagtcgaggttggagggtggagacttctccatgaggcttggatcatctcgctactctgcatagaatttgatactgtcgatgcttgcatcttagaggtaataacgaagtccaagagtagagtctagacatttggaagattgagggtgggtacttagggcaggttggattggtcgtgtatagcttttaaattaaggattaatggggataaactagtctagtagaccggctaaagggaggatcgtatacccagtagagccatcgcagttctagaagtacaactagtcccaggtggtcacgcactcatttccaataggagggcaatttgcatgtgcacattaggtaattccaccaggggaggtatgcgatggtaatcccccggttattccgttggacattcggcgatggtactggcctcttggatgagcccttatccattttggtgtttcccattcgaagtgggacgggaagtgcgtaatttccataatgcgacttctttgatagtccacaatgcaatccacaggcctttgagagtacgccccgaggggaactgcttcgagtcctatcgcgtcgttggaaaaagacttcctagccaagaagttgccccattggttagagggggagtcttttctagccaccaagcggaaggcgtccaaaacattcaaccgatggagtacgtatcgagagatggtcccctaaaagattagtaaccagaagggcacagccatgggacatacgcaggttgcgcttaatttgagctgttacaaggcctcttcataaagtttaatcaccctttagcgtccaattgttaggaccccga

SEQ ID NO: 562103 - DNA, 320 bp, Homo sapiens
aacgcaggaggcctgactcttctgatgagagaagaacaggcactgctgagacgcactgatttctgacagctctgaagacagcagtgctgctgggcgcctgaacgccgtttacaaaggtattaggtgctcaccctggccgccgctcctctaaagacgctccaccgcaatgagatgactctgtgtctcctccagaattttctgggctaactcttgtggatccagttttgggttgctttcttcttgggatttcacggtactgtccgtttctgtgctagactggtctgattctcctgtatctgagcttgctagttttcccacct

SEQ ID NO: 562104 - DNA, 295 bp, Homo sapiens
tttttccttttaaaaaaaaaggggtttttttgggcgggggggggggtttcccccctttttcccccccctttttggggggggggggggggggttcccctgggtttttttttttaacccccccggggcccccggggggaccccccttttttttttaaacccaaaaatttttgggggggggggggggggcccggttttcccccttttctcccaggggggggggggggaattccccccccctgggggggggggttttcccccccccccccccccccttccccccaaaggttttttttta

SEQ ID NO: 562105 - DNA, 623 bp, Homo sapiens
gttgtatctgtgtcgtgcccggcatggctttgggcaattgaatgcacttaccacttcagtgatgactatcctccctccagtggagaagctgaaaacggtgctgacagaaggtgaaagacttccacatcaacttcctgtgataatacgcgtgagacgcctgagccccagcgggagacatgtaccttgtgctcttcctacccaatgcccgtcaggctgaactcgcctcccccgtgactctgcctcgtggcctaggaaagaggccgctggtcaacttcgtcatcattttgcccctggagacgtcttctttgtgcctggattgttgagagcggctctcttaatgagcaaaaagcattctatatgcaaccgaggagtaagaggggacctgctcagcaggtgtgaccaggttctctgaatctgtcattgtgtgtgcttctggaaagttcatttggggtttacaacaactaggatgtgtcgggtgagatgttgcagatcacgcgcagacatgagcccgctgtccgccgcaaaatgtgtgacttaccccggtgcacaaagccgcgcacatctaaacccacccaccataataaagtcgaatattccccaaacaaacgtgaagcacccgtact

SEQ ID NO: 562106 - DNA, 382 bp, Homo sapiens
cagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaataattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaaaaaataaagcgagatgttgccctc

SEQ ID NO: 562107 - DNA, 880 bp, Homo sapiens
  misc_feature (2)..(2): n is a, c, g, or t
  misc_feature (104)..(104): n is a, c, g, or t
  misc_feature (173)..(174): n is a, c, g, or t
  misc_feature (225)..(225): n is a, c, g, or t
  misc_feature (254)..(254): n is a, c, g, or t
  misc_feature (268)..(270): n is a, c, g, or t
  misc_feature (279)..(279): n is a, c, g, or t
  misc_feature (294)..(296): n is a, c, g, or t
  misc_feature (298)..(298): n is a, c, g, or t
  misc_feature (315)..(315): n is a, c, g, or t
  misc_feature (320)..(320): n is a, c, g, or t
  misc_feature (325)..(325): n is a, c, g, or t
  misc_feature (328)..(328): n is a, c, g, or t
  misc_feature (330)..(331): n is a, c, g, or t
  misc_feature (339)..(341): n is a, c, g, or t
  misc_feature (343)..(343): n is a, c, g, or t
  misc_feature (349)..(349): n is a, c, g, or t
  misc_feature (630)..(630): n is a, c, g, or t
  misc_feature (654)..(654): n is a, c, g, or t
  misc_feature (676)..(676): n is a, c, g, or t
  misc_feature (682)..(682): n is a, c, g, or t
  misc_feature (684)..(684): n is a, c, g, or t
  misc_feature (686)..(687): n is a, c, g, or t
  misc_feature (690)..(691): n is a, c, g, or t
  misc_feature (705)..(705): n is a, c, g, or t
  misc_feature (722)..(722): n is a, c, g, or t
  misc_feature (741)..(741): n is a, c, g, or t
  misc_feature (744)..(744): n is a, c, g, or t
  misc_feature (751)..(751): n is a, c, g, or t
  misc_feature (783)..(783): n is a, c, g, or t
  misc_feature (790)..(790): n is a, c, g, or t
  misc_feature (804)..(805): n is a, c, g, or t
  misc_feature (808)..(808): n is a, c, g, or t
  misc_feature (861)..(861): n is a, c, g, or t
anaattatttggttactgtatacagacatagcctaagtaaacaatcaaataaaacataactacatgcatatatttctgaaaatgaaaataaattaattactganatttttaaaacttcagaattctattatttttctaaaatatctaataaatcaaaatttactaacactttnnttttattttaaaaccttttaaaatatatgcttagatatatatttaaaggangtattttactatttctaccaatatcattnactaaatgcttaannncctaccgcnatgttagccactttnnnanaatataaaaattaaggnctgcnttgcnggngnngttatttnnnancaagtnagacatacacaaaagccctaagaataagaaaagagagtgtaaaacaactagtattttgtataattcatattaaagtaaaacacacacacatacacagaccaaagttagggaagatagtaaaattcatttaataggcatgttccatataaccattttgttacaaattttgcattttccacatgaaaaaaaatcacagtaggcacatactagaagcaaaatatgtcagacaaaaatatcctaaagatgtttctgttatcaaacttttacaatttttccaagangtttttgaggtttgggaaaaagtntggggtatttttggcaaaaaanaaacanantnnatnnatgttagttttgantattgttctttctcacnaaaaatgtccataattttntanaaattcnatgaagttttaaatcaatcatgtttgatttanatttacnaagaatgatttgcnnatnacaataaaaattgaattaaaaatacatcaggctaaataaatccaaaagagaanagtgaattttgttgggttt

SEQ ID NO: 562108 - DNA, 767 bp, Homo sapiens
  misc_feature (402)..(402): n is a, c, g, or t
  misc_feature (457)..(457): n is a, c, g, or t
  misc_feature (519)..(519): n is a, c, g, or t
gaatcctcctcagctagaaagagttggtggggagaccaataaaaataaactgtgtatttatgaatatattctggtttatctccattttaggattattgaaatgtaatgcaaaattacttgataaccaccaaattctttggtaaattgcaactatttctgtccccttgtttttctctctttaaatgcagtttgtgagtcttcacaggtaatgttggacttttctttgtagccctattggccaaaaatggttagacaagtcactgcaactctacagactaatttgtaccatggttgcactaatactttcaacagctcccttaaaatgcactttgaaaacaatagccatcatttaattgtaggatatgcagtaaaggaaaagaatcttatattttgatcagattnatagaaagtggttaatcttaactgttttgttccttgtctgaagaaagaatgaaanagctacatgttaggctgtgagtcaggctgcctgagaggagttgttttttagtctgaagttcntaattacaaatgactgctcagattaccttttttttctttactttatttgacttttggtttcattacaggagaataaaatgtatatgcctgttacaagaagaaactactgaattactcatttatttttccttctactatggttgataccatcttttgacgttttgccttggagtagtttttagttaatactaggtcatggtttaactgaaatgtcttttccagctgaggagggatctctaaatcgccgg

SEQ ID NO: 562109 - DNA, 325 bp, Homo sapiens
accatgtttcccggtaccatctgctcgccatgacgaacactatagtaacaaaccacggtccatgaagcatattagtaactctcagctgcatggatgcaggaccacacccaagggtgcacatacactccccaccctctctgcagagacaagcaacaccgatccgacccaacccagcctcagcgggaaggcctctcttcctccaccattaccaacaataccgactccaacagaccactcggcttactgtcccgggcttaccagatgaccagctaatgttttaagtgaatggataagttaaagggaggaagaaggggtggagtgaaag

SEQ ID NO: 562110 - DNA, 280 bp, Homo sapiens
cagcatttccagcgggcaagcccacaaccgtcaaggttgcggagaaatgcacgttcgttattgccgataccggcacctctggatcaaccgctgccgccgtcgacggcgtctctatgctgcgcgacatccagccgcgcgtggtggatcgggtggtagaagaccttgcgaatttgaccgatgacgtggtgtactcactgggcattggcgatccaattcgggtgggccaatccatgcacgaggctcactcactgttggcctacctgggtgtttcgtcaccgtc

SEQ ID NO: 562111 - DNA, 254 bp, Homo sapiens
cagagatgatgcgacggcactccagcctgggcgacagagcaagactccatctcaaaaaaaaaaaaaaggctgctgaattcgggcagggcttttaaaatcccgggcccagggggttcggtaactcgggggcaccgtggttagtgcccttcttaggccgggcaattaccctcgttcctcaatttagcattgggccagtgtctctaacattctctttacccagtttttacgggggccggtgtaagagcctttcacca

SEQ ID NO: 562112 - DNA, 210 bp, Homo sapiens
  misc_feature (19)..(19): n is a, c, g, or t
tgatttttgtgcttcagcnctccctattagtggggattacaggcgtgcaccaccatgcctggctaatttattgtatttttagtagagactgggttttaccttgttggccaggctggttttgaacttttcacatcaagtgatctgcccacctcgacctcccaaagtattggtattacaggtgtcagccactgcagacaaccaagagtgtcg

SEQ ID NO: 562113 - DNA, 284 bp, Homo sapiens
tccgggatccaaaccccccggcccctggggaggggggttttttttaaaccgtttttaaaagggccgggggttttttaaaaatggaggtcaccttttttttttccaaaggatttttgggcggtgggaaaaagggccaaagccttttcccaccgcccttaacggtgggtttttttaaaccaggttttttaaaatccctaggtttttaaaaaccatggggttgggggttttttttgggttttttttttttttaaacctgggcccccggtaaagggtttttcccatta

SEQ ID NO: 562114 - DNA, 340 bp, Homo sapiens
tttttgcgattttttttcgtttagctcatcagctatctttagtggggttttttggtttgttggttttgagacggtgtcttgctctgttgcccaggctggagtgcagtgatacaaactcggctcactgcaacctctgcctccagagttcaagtgattctcctgcctcggcctcccaagtagctgagactaaaggcgcctgccacacgcccggctaatttttgtatttttagtagagacggggtttcaccatgttggccaggctggtcttgaactcctgacctcagtgatccaaccgccttggcctctcaaagtgctgggattacaggcgtgtgccgtcgac

SEQ ID NO: 562115 - DNA, 290 bp, Homo sapiens
tgaggatccctctctccacactggcagttgctgcatctgttggtttctaaaaaatatgtccccagcccagtagaaatgcccaaggcttcaggcacagagaataactttcatataaagatctgagagtctaggaagagcatatgaaactgtgatacgttaaaccagtgtgccgccgatgcatgtcttctttgtagaaaccagagataattcaaatgctctatgactctgcactgtgtctcaatggcaggacgttacagataggccagttgctgctcccagtgtggagagag

SEQ ID NO: 562116 - DNA, 331 bp, Homo sapiens
cgcagaacaagctgaaagcttggatacatatgtcagtggagtcttctgagtgtgtcctggaagaagtcgaggctcccaggctctagttgctggttcttacatgccaccactccacagttccttcaccagattgattcactggctcatgctgatatcataaatgcggtcaagaagtttgtttctggccagaactcaatggcagcaagtggaaatttgggacatacaccttttgttgatgagttgtaatactgatgcacacattacaggagagagctgaacgttctctcagcccagagcagctcgcccctgagttgcagctcgcccctgagtt

SEQ ID NO: 562117 - DNA, 516 bp, Homo sapiens
  misc_feature (516)..(516): n is a, c, g, or t
ccgggtcctaattaattgagaccccataaacaaaattcctttgcccaaacaaacttaggtgttcaaaacccagaaaggcttttgctcccctgccaaacagaaaagctccaaaaaagctaaggggggcacaggctgttcattttatgcaaaaggggcgggcttgatttgaccaagggtgtgctaagcctaagcgcagtttcatgaagctgcaggcttcaccccacctcggaaaggcgggggtctttttggagacagaggaacttatcacaaaatttgggaaattgtgggaacggaattccccatgcccttgttgaagggacctgcggttctcatggtccaacaataaaacaggggggtgattaccttggggatttaaaaaagggggcgattatccacattttaaggccacacccttagggttaaaccctctgggaaccgtttgaaagaaaggcctcccccaacccacaacaattgggggtttttaccgaaggccatattgggggttttgtgaccccn

SEQ ID NO: 562118 - DNA, 171 bp, Homo sapiens
  misc_feature (46)..(46): n is a, c, g, or t
ctgatagaaagtattgcagccagccgtggtgcggcacttgtatccnagctactcccaaggctgagcaggagaattcttgagcccaggagtttaaggttgtagtcgctagacggcgcctgtaatagccactgcactctagtctgggggacatatgagacccctgccatctca

SEQ ID NO: 562119 - DNA, 132 bp, Homo sapiens
gaatcctagctcggtaccccagtttacagcgtagggtcagtttacaacgtaagggtcattttacagcgtcagggtcactttacagcgtccgggtcaatttacagcgtcagggtcagtttacaccgtcagggt

SEQ ID NO: 562120 - DNA, 834 bp, Homo sapiens
gtgtgtgctccgggctcggaacacacatttattattaaggaaatccaaaaaagatctaaaagaatcttggtaaggaaaccccaaaaaaattgacaaaggaatccgcgtctcccccgccggagacttttatgtttttgcttcctctttgataaaagtaacccggtgaagcagccgagagcgacccgcccgccgcggccccggagaagctccaagaaggaaccaagagaccgaggccttcccgctgccggaccgacaccgtcacctcgctcgccgccggcagccggcagccagcggcagtggatcgaccccgggctgcggccgtcgagtagtatcaattccgggtggatttttggtcccttctgcgctttgtgtccccgttccacctgacgcgcgtgctctccgcgtgcccccgagcccgcgggcccgcgcggtctcccccactcttggccggccaggcggccacggacacgtcgggtcaccctggatgcggacccccgttgccggacggatggtcgccaaggtggtccccagagcacgcgtccgaggggccgggccgcgtctaggaggcggggacacacggaacgccggggagcgtagaaagcggaacgacaagggcgccccctcggcgacgacagcgacatcacagacccgggccgcggaggccccacgcgcacgaagcgatccgcgcggcccaggagacggcaggggaaccacacccggcgggcccacgaagggtcctgccgcggcgggcgacccacgcgacggcacgcaggggacgcggaggcaccgcgtgggaccccgcggggggccgggggggaaccgggccacaccgga

SEQ ID NO: 562121 - DNA, 142 bp, Homo sapiens
  misc_feature (83)..(83): n is a, c, g, or t
  misc_feature (92)..(92): n is a, c, g, or t
  misc_feature (131)..(131): n is a, c, g, or t
  misc_feature (135)..(135): n is a, c, g, or t
agaaagaaagatagatgtttggagattcaacaagcaacatttgcttccaaacatggcacacaaactggatatggtggcatgtncctttagtncgagctgctcgggaggctgaggcaggaggttcacttgancctnggaggct

SEQ ID NO: 562122 - DNA, 781 bp, Homo sapiens
  misc_feature (451)..(451): n is a, c, g, or t
  misc_feature (457)..(457): n is a, c, g, or t
  misc_feature (781)..(781): n is a, c, g, or t
atggccgtgaatcaatttttgttgtaatcgttataatgaaaggatgctgaacattgtatgtgaggtggtgcttatgttaattagcttgactggagccattccacagtatatacaggcacacctcactttattgcgctttgctttattgcacttttcagctattgcatttttttaaacaaattgaaggtttatgcgaccctgcgtcaaacaagtctatcagcaccatctttccaatagcatgcgatctctttatgtctctctatcacattctggtaattctcacaatatttcagactttttcattactggtattatgaaacatagtgatctaagcaacagattttcaatgtagatgaaacagccatctcttggaaaaagatgtcatctaggactttcatagctagagagaagtcaatgcctggcttcaaagcttcaaaggacaggctgactntcttgntacggcccaatgcagctggtgactttaagttgaagccaaaattcatttaccattccaaaagtcttagagtccttaataattatgctgaatctactctgcctgtgctctatacatggaacaacgaagcttggatgacagcacaatattataagccaactgatgcgagctactactcataataaacgattcctctcgaaccattactgcttatttgacatccaccttgacacccaagagctttcatggagatgtcccaagaccatgagtggtggttttcatgccttgaagcccattgatcgagcaattttgactttttttattttn

SEQ ID NO: 562123 - DNA, 855 bp, Homo sapiens
cgcaagcgttccgtggcgactgggcgcgacacgtatggctgtgggctatcacaccaggtccactgtggatcacatggcaagggacaccaacctaggatgcgactcaagggccaccgagtcggcgtccgtgatcgttcgtgaccctagagaaccctaacactaggactagtggctctgtcatcctctgtgtcaagctaattcatggataaggatgacggagtgcgctagggcatgctgtacggcaggcgtagccaagtactacccgtcctattggaaaggtccaccagggtgaaacgtgctcaccacaacgattggaaccctagaagtccgtccgaaggcgtgtagtcgagacactatcttgagttctactagaagatgtgctccgatgcgcgaggaagtccttgggcatttacgcttactacgtccacacaatgagagatgcctcggtcataacaacttagccgatagcacactagatactacacaaagtttaagcctaaatacccagggacaataggagcatttcactctcctaaagcttggcaggcgaagggggagcaagtcctatctgccaatggggaaccctatctgggccgcccaagttgttgcctcgccatatgcatagaccctaggacctacccatcaagagtaccgacatagagcaaagtatcgcccttagtacgaagcggctgtaaacggctcgtgccacgcagtttgtgccggagcgccaaacagatttggccaaacgataggcggcggcgggcaaagaaggggcgccccatagattggcgcctcccctggaagacgacaatgccccatgggtgtccccatggcgtgacgcctacctcctttggt

SEQ ID NO: 562124 - DNA, 884 bp, Homo sapiens
tggccgggcgtggaggctcacgcctgtaatcccagtactttgggaggccaaggtgggtggatcacttgagatcaggagtttgagaccagcctggccaatatggtaaaaccccgtctctactaagaatagaaaactcagccggttgtggtgacacatgcctgtggtctcagctatttaggaggctgaggcaggagagttgcttgagcctgggaagtggaggttgcagtgagccgagattgtgccactgcactccagcctgggcgttgcagcgagactcaaaaaaaaaaaggtattcggttctcactactcaaactggggagagaatacctacacaaaaacaacaaaaaaaccagaaaaaccagagaccattctcacaaaaggatacaaggtccatacttaaatgtattaaatccagcagtgttttacacacttatgtgtctccgggatgtcttatacggtggaaagaaaaagtacctgggagatgtgtttgatacagttcaaacgtgatttttaaaaagcgagatggtgtacggaaccatgagtactagcaaagaacttcagaatcatttccgtaatgagacttgcggccggtacatcttgcattatgtgtaggtgaggtaatattcctctgggtaagggtttgcggggtggtgaataactggaggcgtcagacgggaaagaaattggcttttcggatttacccctgttcataagcgggagaagtggtatataaatttacatggttcgggtggcaagaaatcggcgggggagagtgaatccggggaggaggttcagggagagcgaaaacaacgaagggggacggacggaatgaatattttcccccaggggtgttttatattaaggtggttcgtcgctggtggtta

SEQ ID NO: 562125 - DNA, 285 bp, Homo sapiens
ccatgctgggctaggcaggcacagcccggacccgttccttgatgaaacggatcatccggggcccccgctcggatcacaattccccgtggaaattgaggacgactctgttgtccagcctacatggcgcagtggggctctccagtaggaagctctcggcgtaatgttccaggggcaagttcaccacctgctcgatgtgcccgccttaatattcataggggtatatgcagtctacaatcacccacttatccacgaggttgctgaacttgcccatgacgctgcaaactg

SEQ ID NO: 562126 - DNA, 1012 bp, Homo sapiens
ggaggctctgtgcgcacttgggacacagggtgcctcatgaattcatatcctcatttgaagtcacgtcgatttgttctcatattattccagatgggggaagattgatagcgcatagaggtctctaagacggtttgccacaggaccaaacagccagttggattcagactccgggctgtgctatgtttgacctatgtcggatcgaaccatggtgggttccatatggactgtcacgtagtgaggccgctgttcctggacctgtggggactataccagcatgtggtaaaacctccaacatgaccacgtggggctgcgagacgtgccttagaatcaatcgtttgcgaaagtaagcgatagctcgctgaagccgtgggtccgttcgcctccgtgacgagggagatagggacgaggaccaccccagtagggtcgacgggcgaggttgagaggacgaggagctgagtaaacagttgacccatcatctggcgtgcctagagcccaagcagcgcgcggggcgaaggaggcgtgcttataacgaaatgctgaggcgggtgagggtgaaggagccagcctcctcgcggctcggcccgacgagactgtttggcagacaggtgatccggcggattgctgcagagcctggccacgcgtgggaaattctacccgctcgtcctggtgaccgtgtgctcgcatcgataaccggctgtggatgcggccgggcgaccaactccagggaggatggacctaggccgggggtaggtggagctgaagcagcggtgaaagcagctgggatctaaccggcatgtgctggcatgctggttcccgtgaatccgtccagactacgggggccgccctgcgtggtcgggatgggaatgttccggggtgaacaatttgggcggtgtcccggggcaggcccactgggaggccagctgaagccccaactgggtcagcgcggtcaccaaaagaaccgagcgccgggaagggcagctatccacttagacgcgccgaaaacaccagggga

SEQ ID NO: 562127 - DNA, 408 bp, Homo sapiens
gatgttgtcttgagataataatgtcttctatgggggctggaaggggaagactacttccttctactgcagagttgctccatgctgctttcttccacagacctactttgtatgaaatgctcccatttctcaggtgttttccttccttgatccccttctaacaatggcctcctgaggttccacattttcttttatgccagtttattcattttctcattcattaatccaaaagatatacggagtgctagaatctaatgagaaagagcagagctattgaaaatttgaagcaaggccaggctcagtggctcatgcctgtgatcatagcactttgggaggccgaggaaggcggatcacctgaggtcaggaattcgagaccagcctgaccatggagaaaccccatctctactaaaa

SEQ ID NO: 562128 - DNA, 298 bp, Homo sapiens
gggattaactgatctcacggtcaagcacgcggtactcctccttggatgtctcagccacagtgcctatcagtgatactgagtggagagcacacattgcccgagggcctacggagccctcggagtgctgagtcaaaagagtctccctcgaattggtgggcctttagcaagacttggcttcttcactgggagagcttttattcagtgaggctgctagcaccagtcctccctgcgggcttgccaagaaggagagtgctgaacagggtgcattcctcttgtgctccgggcctgactatcaccg

SEQ ID NO: 562129 - DNA, 169 bp, Homo sapiens
aaagggggggaaaacttttttttttaaaccccccttccttttttttggccaaaccggggttttaaagggtttttttaaaattggtttttttaaaaaaccccctccaggaaaaccccctttgaaccgggaaaaggggtttttttttttttaaaaaaaaaaatttgggcca

SEQ ID NO: 562130 - DNA, 299 bp, Homo sapiens
  misc_feature (91)..(92): n is a, c, g, or t
  misc_feature (100)..(101): n is a, c, g, or t
  misc_feature (156)..(156): n is a, c, g, or t
  misc_feature (186)..(186): n is a, c, g, or t
  misc_feature (293)..(293): n is a, c, g, or t
  misc_feature (295)..(295): n is a, c, g, or t
gaaattagcgatgatcctattccatcacagagattctactccatagaccacttcatcgagaaccgcaaacatatcatacacaatcgccatnnccctactnntcctagacctaacctgactagaaaagctattacctaaaacaatttcacagcaccnaatctccacctccatcatcacctcaacccnaaaaggcataattaaacttacttcctctctttcttcttcccactcatcctgaaaaaactcctaatcacataacctattgaaccgagcaatctcaattcaacatagtncnccat

SEQ ID NO: 562131 - DNA, 821 bp, Homo sapiens
  misc_feature (413)..(413): n is a, c, g, or t
agcggtgggggttgcagtgagcggagatcgccccactacactccagcctggtcaacagaaacaaaaaaaaacaaaaaaaaaaaaaaaaaaaaaaaaaaaaaattttttcccaattggctcttcaatttttgaccataatttcccgggatcaaataagggttaaaaaaattgattgctattcaacaccagggcaagaagaaataaaggcaaaaattttttctgggtctgggtttggagagacgccttcttaggggacttggacaacaactacattattgccacacttcttaaaagacccgggggggtctccttaactctcagcgcgattgtccatttacactgtggctggcgaaaccttgtaacacgacttcccagggctccccattcacagggaagatttgcgctctcctgantgagaccgttgccatagtgtggcccgtggcaccagtgggcttatttctggaaaaaattcgccttccaaggttgaactctctttaaacattcccacagtttagaagaaaccctttaaatttacagcggggttgaaaaccccagaaccccagggggggccttcttaacttaagttgtttcactctttaaactctccccacaaaaagccctttcgggttgtgcctttgtttggcaccagaaaacagaaaaagcggggaacgagagagggcccctaatatgccgggtattaccctggggcaagcttgtgtcttcccctgtcaagacaagaattttgcttacccaaatttttaaaaccccttttttgggcagggtttgtctgggccctcttgttgaagcccaattttttttac

SEQ ID NO: 562132 - DNA, 136 bp, Homo sapiens
cacgaggcgcgcgacgaaatcgagaatggccgatttggccgcgccgtcgctccagctcgcaagctccctcatgacggaatccgccttgctggcgcatgcgaccgcagtgctgaaacaaatcgcgcgcaacggccaa

SEQ ID NO: 562133 - DNA, 146 bp, Homo sapiens
tgaggtgatctagaggatcccaggctttatacttccttagcttagaggtcaggcatacttcctcaaggctttatacttctataagtatgcatggacctctagtagctaaggaagtataaagcgtggagaaagtataaagcgtggag

SEQ ID NO: 562134 - DNA, 109 bp, Homo sapiens
gatggcgtagagcctagcatcagcgcaggctcccagccgagtccgttatggccgctgccgtcccgaagaggatgagggggcctgctcggtcgaagctgctgcccggctg

SEQ ID NO: 562135 - DNA, 1216 bp, Homo sapiens
  misc_feature (659)..(659): n is a, c, g, or t
gccgcttgcccgtcgtgtcgctagctcgctcgtgtgctgcgttgtccctgctccatggctgctcttctgtgctgtgctgctgtgctctcgccctgtgctctgtgccctgtgtgcccctgcctgctgacccgtggctgtggtccctgccaatgtctgccctaccatgctggtgcttgcatgtcacagcatgtgctcctgtgggcctgccatgcacgtgcccaactgtgtagttgcttgttgccagcacagtggttcatttgggcactacatcagtgcaagtcacttacaccccaactgccaccagcgagtgtgtacacaacatggcacacacatctcgttggccaaaatccaaccagtccatccagcttcacgcagtgctttgtccctgtggcatcattgcacacacaagtgtcaccttgggcggcagcaatgtgggccttgtccagagcccaggccacaatacccacatcttacgaaaaaccctttatcacctgaagcaacccctaggcgaagtctgttgtgggatccaacccactcagctcaatgccttggtaccagctgagcacacatgccaccgggaatgaaatggctatgaggtggcctagacgaacttggcagcggtgcaacctgtgacaagacttttcaacccagtacatttnctggcccccgataaagcaaaacgaaagtgagccttaggaggcccttcctattgtcccagcttagcaaaggtttgccttagggaactcccacttgggttccgaggccaacataggttccaaccaatttttggaggctttgctccaaattagccccctttccctggtgtaacaccaatacattgtgtctgagtggccatgtggccgacagtccccctggaacttaggacattgagggcttgcgacaaaccgcagggtccattgcaattcaccccgtaccagcctattccgtacgttgataccaccaagaaacagtttcccataagcacaattccccatagagtttcccagacgcaagcattaaattcccttaaacttgtggggcagttcgggtcaaccctttggttggaagtactttgggttccacccagtagatttgacactacgaaacatgcgcgcagcctagcatccaaatgtgtcaacagagcccaaactaggcgggagtaggggtcagcgaccagccttccacgtccagagaaacgctgcgtccagttccttcg

SEQ ID NO: 562136 - DNA, 325 bp, Homo sapiens
attacggcgttgttctggattcccgtcgtaccttaaggggaactttaaaattgtccggggcccttaatgtcctgcaaataaggagggaggatgtccttaaggtccttgcagcaggaccccacttaggtggcaccaattttgacttccagatggacagtacatttttaaagggaaagttatggcactatttataatcttaagagacctggtaaagcttttctgcgcttgtcaatgttccattaaaccttctgatgcagtttatactcagatctgcacgctgtctgagttctctcactgacactcattgctgcgttatctgacttat

SEQ ID NO: 562137 - DNA, 820 bp, Homo sapiens
gcctgtgtgaatgagattccacgccctgtagctcccgtgtctcagtggcgctaactagccacgcagagagattggttgcatctcacacgaaatccgcaggactacgtggactcatatatgcggaagtactcttgtcctctcaccacttcatttgtattcaggctctgtgagaaactcttatccagtcaacacacgatggccagcaacgttaccaacaagacagatcctcgctccatgaactcccgtgtattcatttgggaatctcaaggactctgtgtggtccacgaaatctgatgtggaggcgaatctttccgaagtatggcacaacttgtgggctgctctgttcataagggcttctgccttcgttcagtatgttaatgagagaaatgcccgggctgtgtagcaggagaggatgtgcagaatgatcgctggaccaggggtttagaatattaactggtgcagagccaaaaagtgaaccgaggaaaaagcaggtgtgaaaacgatctgcagcgagaatgtacggggtcaagtaaacaggacaacccttcctccgtgccccctcctaactcagtccctctttttggaacttgggacttattgactttcaaagggactatcatcgatcaggattgtacagtttaacccaagccacgtggtaccttccttccctcctcctaatttgtcggcgttgtagttgccttcgaaaacggtcacagggtgtatcacggcaaaaacacttccacgaaggggaaaaagtggttccaattcctcaaggagtggacacggggggactttccaagtttggaactttgacacgcgc

SEQ ID NO: 562138 - DNA, 238 bp, Homo sapiens
agaggatccccattatgcacgtgacgatgtgaaggctcgtccctccgagctggcgttaccccgagaatggacagtgcagaaaacgatggatggggcccagtgagaacacctatactccatggacccccacactggagcggcagtgtggagaccatatcgcaaccatgagtggactacataccgtggccaatcatacaacaagatccaatccgcgacctacatgccaacagaccataca

SEQ ID NO: 562139 - DNA, 108 bp, Homo sapiens
gcgtcgaccttcaagcaccgtttttacagaaaggcgaatggcgtttaaaagtttattgtctcggctggggtggtggctcacgcctgtaatcccagcactttgggaggc

SEQ ID NO: 562140 - DNA, 107 bp, Homo sapiens
gtcaaatccagcaggcacgggtccagggccagtctgggggtccgggcccagctggcgcatgcatctttcagcaccagtccagccgggggtccacggcagctcgcaat

SEQ ID NO: 562141 - DNA, 398 bp, Homo sapiens
cccttgggttcattgaatgggccacggggcccaaccctaaaaaattttgggcccaaggtttccgccccccctttttaaggggtccccgtccccctggctggctccaaggtgtggaaaacctgggagtggtttccgtcctggggccccaggaggtttccccaaagaacgactggggcaggtgctggaggaggtcagtggacaaaatggggaaatgtggaaacccccaaagccccttttcaggcagccctgcctccaaaaccgacaaatgggtaagggggccccaaacctggctccccccgctcctgtgtggaaaaagggccacaactgtcccggatggttattttttcctttcccccaacccctttggaactcaagtaaatcccatgcatgttgggtga

SEQ ID NO: 562142 - DNA, 845 bp, Homo sapiens
tgcttgcgaagaaggtatggcctgtcccccctcgttggtctagaagcgttggggagtgtggtcgccccccaactgttgttagaatgggtcggaaggcgaacgcccccacgaggccgtgcaaatggaggtcgccgcggctggacacccgcccagttggtcattgcaagagaccttgcctcgacgaggtgtacccacaccccttgggggggcccccgtgctactcggtgtgtgcaggatatatatgctttgggcaacgccactcgttccgtcgagcgcgaggggccgaactgccaacaaaaccgccgggcgcgcccaagcgacgaggtgcgtccgtccgagaggtcgccacaggccgaacccccacacacgtggaagcgccacgagacgggaccgcagacgcggcaccaaacgggagcactgcattaccctgccgtgatggcgccggccacgcgccccctgcctgcaagatgcgcgcggcgcgggagagagaggcgcggcgtctccgagcaaactgtagcttttggtggtccaccaggggcccgtcgtgaaagtccaggaagggacatagctcttgcggtgatcgagaccacatgcgcggatgataccccgcttcacaagtgcaagcgagacaacatcttgcgagcggcaccccacgggcaagtctatcattttctatggcgccgtgagagcgcgagcggcttgttaattcaattgtaggttttgataaaagctcctcacgttgtctttgtgggcaatcccactcgatgaacgcccacattaggtactcgccagatcgtcgggagagcgcccccagaaaaattcaaaacgagcgacaacataacgca

SEQ ID NO: 562143 - DNA, 651 bp, Homo sapiens
atattctggcacatctgtactttaaagttcactctaaaatctgccctcaaatctagaactgctatcaatgacagaggtcagaccaaagaacaagcaactgcccccaaaagaaaacggaggtttcctaaacgcaaagcagacattcaaatatgcactgatcaatggtgcactaaacaacactttgctaggaatttgttaaggcaaaaggaccctttctacagtgaatgcaaactatctaagaatgaatttttaaaagtttaatatttctaaatattttggtagagacggagtctcattaggttgcccaggctggcctccaactcctgggctcaagggatccaccttccacctcccaaagtgctaggattacaggcgtgagccaccgtgcctggcaaaaagtatttcacagttattcactgatacatttcctacgtttcaagttaggcgagtgtgattgaatcacccttatttcatctcagcctgggttttcacatctgcaaaagagaaattaacttatttgagatcacagtctagtggttgaagtttaaatttataacttgaattgagtcaagctttttaatattgctaagccacttatagatgcattattattatcaggttattgaaatgagattgtagataaattcctct

SEQ ID NO: 562144 - DNA, 359 bp, Homo sapiens
  misc_feature (71)..(71): n is a, c, g, or t
  misc_feature (97)..(98): n is a, c, g, or t
  misc_feature (114)..(115): n is a, c, g, or t
  misc_feature (154)..(154): n is a, c, g, or t
gccctttcccctggctggcagcgcggaggccgcacgatgcctggcagttcactgtacaaagcacgtgaacncagcaggaagttccgtccagcagctnnctggcagcgcttccgnntcaaaaaagtttccggggacaccgcctagacacaggctncacacacggaacaatggggagatcggcgaacttagcacgggttcccaaaacggcctggggggccccacaatggcccaaccgaaacaacgcgaagggccttttgtggcctttccccccttacgactgagaactggttctacacgcgagctgcttccacagcgcggcacctgtacctccggggtggcgctggggttggctccatgac

SEQ ID NO: 562145 - DNA, 239 bp, Homo sapiens
aggagagaagagaaaaggagcggagaaccggcaaaggaaaagccggaacacaggaggaaactgcaagccagtaaagacaagggatagagatgcggatgtaagacaagcaataagggaaaatggagagtagtaaggtgaatgagactgcaaactaaaaaaaggaagaaaaaacgatagtagatatagtgtgatatagatctaaaaacggatgtggatattggcaaacgggatgtaataac

SEQ ID NO: 562146 - DNA, 426 bp, Homo sapiens
gttccccgggtggggcgtacggaatcataactgtcccatgtggcgtccagtattgcggtaccaaccatccaccaggcacggacgcgctaagcactcagattgtggctctctccaagaacgtttttctctctgctcatgtgtcctgctaattgaatgacttgtcttgggagtggtgagtttcctctccccggaaggcagtttttatttgccactttttaggacaagaaatgtcgcatggcgtacgctcggtgctctcgagctgggttggatatgcccccgacgtcgacttctcatgacaaggaacttaatctttaagtgttggaaaccatcttaaaatgcatactagatctgtcaaagctcatgaagtcagcttcgtcagttattatgcctcggttcgatcctgtttgacatgttttcaacatttcc

SEQ ID NO: 562147 - DNA, 441 bp, Homo sapiens
tcactgggttctcatgatcgtgcctgcctcagccccaaagtgctgggattacaggcgtgagccactgcgcccagcctattagttcattttcatactgttgataaagatacccaagactggataatttataaagaaaaagaagtttaatggactcacagttcctggtggctggggaggcctcataatcatggcagaatgcaaaaggcacatcttacatggcggcaggcaagagagaatgagaaccaagtgaaagtggaaaccccttataaaaccatcagatctcatgagacttattcactaccatgagaacagtatgagggcaactgcccccatgattcaattatctcccaccagttccctcctacaacacgtgggaatgatgggagctacaattcaagatgagatttgggtggggacacagccaaaccatattagacagtg

SEQ ID NO: 562148 - DNA, 1524 bp, Homo sapiens
  misc_feature (371)..(371): n is a, c, g, or t
  misc_feature (464)..(464): n is a, c, g, or t
  misc_feature (519)..(519): n is a, c, g, or t
  misc_feature (627)..(627): n is a, c, g, or t
  misc_feature (755)..(755): n is a, c, g, or t
tgggggaatggtggtgtattttctagccacttgtgttttgggaaaacctgtatggcagtgattatattcatattttcctgtccaaagccacacgtgaaaacaggaggcagagactgtgttactcgtgggtggtgactctctgggtcctcgaggtggtctcttcgtgggcctccgtggtcccttctgggccttataggctagctgcccggggcaccagaggtacagggtgaaagcaagggtacgcagcttggggggaagggaggccgtggtccgtggactttaccgagttcttattaccacgtggtgggccctcaaacctctcccgagaacgaggggccagagaaactgtggtgggcagcctcgattggagnttctcatagggcgtgggcgtggagaaggtgtgggaagcctcattgtgaatagaacctcagtggagtgggaaacatattttgtggagaacaggncattccctcctttcgagggagaagaactcagtggcggactataaagcgtggtagncaatttcccatgtgtgcgcacctggggccaagtgagatcccatattatctttatgcgaaaagtacactgggtctcttctggggttcccccaggtaatgttgtgggacncaacccaatatttgactctccctatttttccccctgtggtggaaccctggggtccctgggacttaacacacaagaacacactgtgtgggagctccaaagagggccttcaaaagaagccaagagaaagngggggcccaagtacaaattacaagaggggggaggtcacaatgtgggaatcctcaatcttgagagaggaccagtggcttattcggggaaacactcaaaaaggggggggcccaaaagggcgccgcgagttgttccaagggggcttctctgtggcctgaaggggtttagaagttcttgccgagtgcccccacaaaatagtggcgccaatggttgtgtggaacgagcactaggaggtaggctcctattctccccacatgtgtgtgggggtcgcccaccacgtcccccactgtggtgaacgctcatcatgtggttctccacacgaagtcgcttctctgcggagaaaaacaggtcttcgtgggccacagcgtttatgtccccctctcttgtggaagaagaaattcaccggggggtgagttatctatgagacgacactcttatccctctcccccaccagggggggggccgctgaaacagcaggaggagtagagagtacccacccccgcccctactgttagtaaggataagagcggtagtagacaagacagttagttcaccaagatgaactcaccttctagtgggtgcctcagcaaagattgtgtaccagcaaccacgaggagaaggatggactagtttaaaccacagcatgtagacgagtgagctaaagtgtagatgtatagactgtaacgtaaagacacacaacaaccacatgactcgtgagaaggaggaagataatgtagataacaaccccactgcgaccacgcactggactat

SEQ ID NO: 562149 - DNA, 397 bp, Homo sapiens
cagagcaagacaaagcaagtagagtcggtatctggagacctttttgcaaagaaggtaggttttggtgtgatttttaaactcttggtattaactatttttttattcttttgtattatgatgttttaaaatcaacttttgaagggttttttgcttgctatatgaaatatattattaaactgatttagttgtcctatattcttggaaagtatttctggttgcaaaagggtggcatttttgtaggagcagatattgaaactgctaataaattagaatcaaataataagggagaattcaattcattttggaaccaaaaagggaatgaaacacttttgcaaattgatttgtattaactaaatgctccctttaaaaaataaaattctggaacgatgaaaaaaaa

SEQ ID NO: 562150 - DNA, 378 bp, Homo sapiens
ggaggatcccccaagcagtcatacagattcacctcatataatgagagaaataccgaaaagtgtcccataccttagagaaaaagatcagcaaatacaacagagcacaaatacttagtgaatgtggaaataaagtttctccgctcttctggtctccatcttatgggttacactgcagctcgttgctcttcttacaaaggaaacacatgtgggaaagttagaacaggagccaagtagataagattagggaaagagccaggctacttctagcctcaaagctctgactggctaaataggcctctctccacaagcatggtcccggatgtaactagacctgtatgagatccactaaggaaaccctgagtctgtattaactgcttg

SEQ ID NO: 562151 - DNA, 767 bp, Homo sapiens
ccacgcgtcgctttttttagttgattattaagtgcacaattcagtgactttaaatacacagtgtcttgcaattgaacccactgagatagaaaacgttctggaactgtcttcatcacccccagaagtggaaactcccattacccaccagatcacatccttcagttcatccccttccgccacagacgcaccgtgccgcggccacgaaattcgtgctcgtgcgtggcctcgtgatgagaacttctgccgtggtattgggcgtgtttacacgcctaacgcgtggatacttacagtcgggcaccaacatattgtgtgatctcctgtgtgaggtggtcgctggggcgcattgtctgcatctttgtagcgtactacagtgggtgtgttgtgcacccattatgagcccattaaagtggtgttgtcgcgaggcgtatagcacaaatatagtgtgttgtcacacacggtggtgtcacaactcgcaaacatgtggaaaagcccgacgggatatctgcacaaacaccgcgttgcgaatttgcctgtttccttataatgtggggcgcgttgcgatagtagcgctaaattctcccccctatgtgatgtgtttgtgagtgcaagagaagacaacctcgacagagtttctatttctgcgtccacactattcgtcacatactgaggagttgtcgcatagtgtggccagcactaatgagtcggggcgggttatccttctctccaccagagctttaaaatttccccagagagggtttaactcacaa

SEQ ID NO: 562152 - DNA, 108 bp, Homo sapiens
gcagaagcaggaagcaagggcttggtgagggcagaagcaggaagcggcagaagcaggaagcggcagaccggcagaagcaggaagcagccgggcggcagaagcaggaag

SEQ ID NO: 562153 - DNA, 439 bp, Homo sapiens
tcaggttgagtgtcttcttactatattatctgatgtgtatgctagttagcatattgtgtcactgatactgtttacaaaagtctacgcagtgtagcgcaaggccgtgtctttgtcggaaaactcgcttattccattaacaaaaactacatcaagtgtgcagatttgtctggcaagaaaagaaaaagcgaaaagcatttttgcaagttccagagatacctgcattgttctttctaactcttctacttctcacacagacaagaggctaattctggggcgttggcaacgcgaacacacaaagagattcacgttaacgaagcaattctccattttgtctcacactggcagaggacactctttttgtgccacacactgggtcaatttttacactccctttctagaggggggccaattctgtgggggggaccaatttctttttgaa

SEQ ID NO: 562154 - DNA, 706 bp, Homo sapiens
tgttttgaatcatccgccgcgactttgcacaagaagggttttggtggttccaaagtaatggtggttcctgctggacaaggtttgcacgggtgccactctatagttaggtggtccccgccaccccgctgctacgtagtagggtccccactgagtagaatttacgctgcgccgcggagtatgtatataagatgccgctctgaattttctcaagaaatgtgcccccccaatcaaaggctgttgcgtgcttttacacaaaacactacagtgcgtgcagttgacccatcttctctgtggcccccccagcagtgagttaggcgtagatacacagatgtcccagaattatcatttgttcgtggctgacaaacaaaatatatcgtggtgtaatagacatatttgtcgtccgggtcccacagtgaaatatggggtccacagaataactcacgagtgacgtagtacacggtcgacactcttcagagatagcgctgtctctttgtcgaatagaaccaagagtttgtacagacaattgtacctcctacgttagagctcattttataaacatatatttttctccacttctaataccacactatatgatcttctttctttacagtataatttccacgatatacagattgacaaataggtgttcctacccactcactataacaaccactagtcctagatgcgccccatcaatgatcgaaac

SEQ ID NO: 562155 - DNA, 221 bp, Homo sapiens
  misc_feature (12)..(12): n is a, c, g, or t
  misc_feature (45)..(45): n is a, c, g, or t
ctgtgctctagnggatcttaaaatagcgacgcactgatgataacnaacaggagatctaaaggctctgctccaattccacagatggcctttcccctttattgagaaggttctggttggagaaagccataatcggaccagaatatctttaatgggtaggctaaattataagccactggactttcccttcctccttccgtcgggctaaattttccggggtaccg

SEQ ID NO: 562156 - DNA, 917 bp, Homo sapiens
agggatctggaggcggcggtcggtggacatgtgctggtggtgccggtcgtattctccgggctgcggaggggttgccattaggggactacctgaggtcctatctccaggctgcggtgactgcactttccctggagtggaagctgctggaaggcggaccggccgccatgtccacgttcaggcaggagtgactgtggatgtgaccattatgatgatggtgggacggagctgtgtgcatgctggccatgttttgcgcatcgtgctggaacgtgcctgtgcatgaatgtgtgcacgtgtgcaaggagtacgcatgccaatgttcatcaatgaagctgccgcctgtcatccagcctggcgtggggtgagccgtgaggagatctgacgcgggagtgtgaacatcctgcgggagatcctggcacccccatacatcatcaccctgcacgacatcttcgagaacaagactggacgtggtcctcatcctggagctggtctctggcggggatgctctttgacttcctggtcggagaagtgatgtctgctgactggatggacgatggccacccagtttcctcaagcatgatcctgggacggctgttcactaccttgcatctctaagccgccatcgcatcactttggacctgaatgccggatcaactatcatgctggctggaccgagaaccgtgcccaaacccacggaactcaagctcactcgaccttccggcactcgcgctcctaaggatcgaggctgtgtgaatcgaggtttcatatgaaacaatcttctggctatccctgggagttcggtggcacccaggagacttgttgaacctactgcagcccgctggtgcttggtcgtgccggtcccatgtgtgatccattggttgtctctcaccctaatattcttgtgacgtacctggccgtcg

SEQ ID NO: 562157 - DNA, 258 bp, Homo sapiens
agaggaactgtagtatttggtattcacataggtctatgacatatgtagcctactcatgctctttgccacccaagctatcttatggagtgtttttttttttaacccaatcatatagtggttagttatttacacatttatggcactattgcacacagcttattttgcaggtaggttatccatgtagatcaaaatgtttgtagctcagttggtatttatttatttatttacctttctccatacgctaccacaggagtcgac

SEQ ID NO: 562158 - DNA, 596 bp, Homo sapiens
ccatcaatctatatatttttccttcatcagtattgtgttgtcttaattaccgatactttgcagtaaggtttggagcatgggggtgtgaattatcctaacatgttttcttttcttaagattattttggctattttgagtcccttacaattccatgtgtattttagaatcagcttgtcagtttctagacagaagtctgttgggatacttgcagggatttcatcaaatctgtagttcaaattgtaaagtactacaatattaaatagtccaattcatgggtgtaaggtgtttgctaattatttaaatattctttaaacaataatttttaattttcagaggaaaatcttgtatcacattttccaaattaattattatttctttttttgatgctattttaaattgaagtgttttcttaaattcattttggggttttcattgcagatgtgtgaaattgatttttgtacatttaccttgtttgctgtaatattgctgaaataatttacgagttctatcgttcggtggattccttaaaattttctatatacaagaatgttattttcaaataaagttttatttcttcctgttcagtaaaaaaaaaa

SEQ ID NO: 562159 - DNA, 107 bp, Homo sapiens
  misc_feature (35)..(35): n is a, c, g, or t
  misc_feature (49)..(49): n is a, c, g, or t
  misc_feature (91)..(91): n is a, c, g, or t
gctgaggacacatgcgcttttgtagaatttaacanctggtgtttttctngaaaaatatatatacatatattgctttatttgaaacaaattnaaatatgctgcatttg

SEQ ID NO: 562160 - DNA, 101 bp, Homo sapiens
ccccgatagcccgacaggtcccggactcggacgcgtggtagcctaaagtcctggggagcttctgtccacctgtcctgcacgaggagtcgtttccaggcccg

SEQ ID NO: 562161 - DNA, 523 bp, Homo sapiens
cctgtggaattgaagaaagcaccttgaggaagagaggcaggtgccggcgcaggcaggcctgtggctgtggtttgcagccatggcagcgttctcatttaccacctaagcagggttggaggttgcaggaggtctgcaggcgaggtgggtggcatgggggccaggagcgctggagatcatctttctgggctgccctgggcttcccgcggggcccaggttgctctgtcaccattctatatacctcagtcacctgccgcccggctgctcagcaggggtgtttgtgaggccctgggggtgccccggaaggggcaccccaccgcccctgttgggaaccagagcagaatctgtgggcttgtcgcctgccagtagtataagcaacactttctgttcaccaccattgtcccttgcattacttctttcttacagcatatttttaacataaagctgttagactttatatatttctaataggtcagacattgcctatttttcatacatctggtgctgcctttttgtaaaactaata

SEQ ID NO: 562162 - DNA, 428 bp, Homo sapiens
ccaaggcaggttaaccatccaagggaggttaccggctctcctttctcacacagggtggacccaggtctcccccatcccccaggccagccagcattttgataacattgcatttcacacttcccagcagtcctcaagtaaccacacaggggtttgggtgtccccagcttgtcttgcctacttaagggaaagggcctcatgttggtgagagtctagcagggtcagacgtctcacgcacccagtttcactcactccttaaccaaaccctgcagagatattactgtccccatttcacagatggggagactaaagatccaggagggtgaatcagaatttgaactcaggtgtttctgatccatggaccaacgttctttcctctcctcaaggcagcctcaactccctcttgatttctgaattcctaaagaaaaaaa

SEQ ID NO: 562163 - DNA, 365 bp, Homo sapiens
aacaataccccaagagcagacaggatatttgtaaaacatgagaatttaaacaaattaaagcaagcttagagaaaacccacaggaggtaggagggacaccagcttgtcttgcctacttaagggaaagggcctcatgttggtgagagtctagcagggtcagacgtctcacgcacccagtttcactcactccttaaccaaaccctgcagagatattactgtccccatttcacagatggggagactaaagatccaggagggtgaatcagaatttgaactcaggtgtttctgatccatggaccaacgttctttcctctcctcaaggcagcctcaactccctcttgatttctgaattcctaaagaaaaaaa

SEQ ID NO: 562164 - DNA, 550 bp, Homo sapiens
  misc_feature (13)..(13): n is a, c, g, or t
  misc_feature (16)..(16): n is a, c, g, or t
  misc_feature (32)..(32): n is a, c, g, or t
  misc_feature (40)..(40): n is a, c, g, or t
  misc_feature (43)..(43): n is a, c, g, or t
  misc_feature (54)..(54): n is a, c, g, or t
  misc_feature (56)..(57): n is a, c, g, or t
  misc_feature (84)..(84): n is a, c, g, or t
  misc_feature (98)..(98): n is a, c, g, or t
  misc_feature (107)..(107): n is a, c, g, or t
  misc_feature (146)..(146): n is a, c, g, or t
  misc_feature (185)..(186): n is a, c, g, or t
  misc_feature (223)..(223): n is a, c, g, or t
  misc_feature (247)..(247): n is a, c, g, or t
  misc_feature (252)..(252): n is a, c, g, or t
  misc_feature (266)..(266): n is a, c, g, or t
  misc_feature (268)..(268): n is a, c, g, or t
  misc_feature (282)..(282): n is a, c, g, or t
  misc_feature (290)..(290): n is a, c, g, or t
  misc_feature (294)..(295): n is a, c, g, or t
  misc_feature (327)..(327): n is a, c, g, or t
  misc_feature (344)..(344): n is a, c, g, or t
  misc_feature (384)..(384): n is a, c, g, or t
  misc_feature (388)..(388): n is a, c, g, or t
  misc_feature (391)..(391): n is a, c, g, or t
  misc_feature (426)..(426): n is a, c, g, or t
  misc_feature (463)..(463): n is a, c, g, or t
  misc_feature (465)..(465): n is a, c, g, or t
  misc_feature (481)..(481): n is a, c, g, or t
  misc_feature (487)..(487): n is a, c, g, or t
  misc_feature (530)..(530): n is a, c, g, or t
tctttctgaaaanaanttaattcttttgtcantgccaaanaanacccaagtctnanncaccaaaaaaaaaaaaaacttcttcanttctcccccctganaacccccanctactgaaagggctttaagggcacactgccaatgaaaangcagagtgcatataccatgtccttaacttgtttcaaaannacctattctggcagtatccaattcaggtttcagtgcncccttgtttgaaagtggtcttcanaaaancccacattttaaancnatttggaggagcanaaaaagtnaaannggtaaaagcctttcagaatttgaaaaggtagnacttgtctaaaacaggntcattttttatgtggcaaatgccacaaaaaaggcaaaaanatanaanaccaaaatttacgcaaaatggggaagagaatccanaaacacgacaacaaagctgccctaaccaatgttccananaaagccacccccaaanagaaanaacccattaaacattaccagataggcatgaggtacagaaaaanaatttttctttccagctcca

SEQ ID NO: 562165 - DNA, 310 bp, Homo sapiens
agtcaaacgtttgtgtgggaggcatgtggacaggtgacgttctgccaggccttctaggcgtttacccgacacatcagtgttattgttctaatgcctggagaggaggctctatccagaggaccctgcaccacaggtggcagtggctggtgttactcaaggtccctggtggcggtgtaagctgagtgccgtgtcctcggctaaggtcacctgacagggcttctctgcttgtatcagagactttttttaaaaaaaagtattttttattttgtgaatctagtctaactgtgtcctcccaccacaaacgtgggat

SEQ ID NO: 562166 - DNA, 194 bp, Homo sapiens
agtgcacagatacatcagggtagacttgatctaccctgatgttatctgtgcactggcacaatattatcttgcgtgcctttctagaagatgctgtatgacagggtaagaaatccaaatgttaattgtttgtggccagctgatctgggactagaaccttttgtctgaaagtgccctatgacagtggcctgatatcg

SEQ ID NO: 562167 - DNA, 358 bp, Homo sapiens
aagccgtgaacggtatcctcgggatcaacaggcatcagccccctgtttgctccacatcggcgggcgactcacacgtaatagtcccctatgtccccagagtcgtcttcttcttattcttcctcttcctcacaattagggtcatagtcctcttcatggctgtcagacccctggctcatcatgtccactgacatcttagcatccagccgggttgcagctcaggacagcagctgcattattccccctccccccaaacactcaccgctttctcaaatgcattagtatttatgtcttctaagggcggcaacacacactcagtgtgcctttttccccatgacaagttgtaccagaaaccattcac

SEQ ID NO: 562168 - DNA, 569 bp, Homo sapiens
ctgtcaatcttcagtagcccttaagactttctctagctcctacttaataaccagttcttagaataataacttttaaaaagctacacctgccgcggatttagtaagaagaccatagccttcaaatctccaaatgctccaaagcttattctgagcgtgtggtggctagatgttgataagaggaaaagaaaggaactgtttacttggttgggaatacttatttgggggtaacaacaatgtggacaatggcacaaagttattagaaggaaaattaaaccctctgtctgggcgtggtggctcacgtctgtaagcccaacactttgggaggccgaggtgggcggatcacttgaggccacgagttcgaggccagccttaccaacatggcaaaatcccatccctactaaaaatacaaaaattagccaggtgtggtggtacacatctgtaaccccagctacttgggaggctgaggcaggagatttgcttgaacccagaaggcagagattgcagtgagccgagattccaccactgcactccagcctgggtgacagagcaagactccatctcaaaaaaaa

SEQ ID NO: 562169 - DNA, 277 bp, Homo sapiens
agacattcactgcttatggcatcataactagcaatctctgcttcttcttcacacagctgtcttctctctagtgtagtgtttctgtatagtagatttctaattcctatattttctcttctaaaatttgttatctaccatcaattataaaaatgttaagggtattaataatatgttcaggttatgtatataatatagaagttctgatgtttaaaccttcatacattataggagaggcatcagcaaaatgaattgatatccaatatatccgacattagat

SEQ ID NO: 562170 - DNA, 114 bp, Homo sapiens
gcgcggacctacgtgtccaaatgagctgttcctctttggactaacagattaaatttacaaggggatattagatggtgttctgtgtggcaatatttagacagattgacactaagc

SEQ ID NO: 562171 - DNA, 995 bp, Homo sapiens
ggcagtccggcggttcccgcgggtctgtctcttgcttcaacagtgtctggacggaacagatacggggacgtctctgtccagaactccgaacgccctccgatttcctctccgcttgcaaactccgggaacatcttctcggaccatctcctgcgttctagggacctgccagcagccgtattcggtgagttatgctccttcttggccaaaccaatcgcatgagcatcccaaggatatcgtcaagaattatatccaccgatcgtaggcagagcacgaccgatacaaacaagcactaggctcaactttagtaccatgacagagaccacatacctacaaccctaacacttcttcttacatggcgactatacttatatttcgcatcccgccgaattgcattgattgtacatacctgtgcatagcgacgatgcaggccgagcttacgtatacccgtggccaatctagagccgtaaccgcaggtacaagcttgcgaaaataagggctataacagccaacctcagtattcgtccccctagctactaggcacatggccgagacgaaagacgccaatggcggatagggcacacagacttacccaagtatgacacataccgtttcgtatacacacagtggcagactactttcaaaatagagcaaacagggccacaaagtcaatgagcaacacgtcactttggaaacggtatgagagcatgggatccaatgaggcaccacgtatacgcgagtgcaaacggaggcatcaacaagaactcggcacgatggacaggggcgttttgtgcccccaaactagggaagactcgcccattatggttgggcaagtacaactagcacacaagaccgtgtgcctctatggcaaacaagaccacagagggaggggacaccacacgatacagttgagtactaaggagagaaactttgcacattgtctccaaaataatggtccccaccctaatataggaggctgacattatgatccctattag

SEQ ID NO: 562172 - DNA, 842 bp, Homo sapiens
cagaggtgtgatcttagctgggatgcagcttggaatggatggaccgcacccgtgtctgcatcgtagcgagcatctcgggaggagagagtcctaccctggctgctggtgtctccggtctcagaagtggagatgcagaatgttctgtgaaagacccgtgacatgtattaatatcgatccggtcttagattgtgggatcggaggtgattatctattggagatattgtaaatgggagaagattcgctaggaggatgaagaggaagtgcagttctttcttgtatacatgttagaagggttgagtcgtatggcttgtgtaatagatcctgagacatgatggatgggagactgatgatgatggttagtacaattccagaatgagttcatgttcatgaaatggtgtgctttaggagtaagggggggggtagaatactcggtatcagtgactggtcatgcacatggtcaattatcatggtgatcggtacggaacgttgggattaccgaggatgaacctgcgttttggttatttgtaggggacaacgaatgtggctaagaaagagtggtggggtccatcacctcgctgtaatcggtgggaggagtagctcttgtggtgggaaaaccggctggagaaccgacaggatgcatgctgtcgtggattaaattatagatgatttgaggagatgcatgagaatctgtgtgctgtgaggatggagtacgtgcgattatgaatacacgtaacaggtgaaggaatccttgtattggggcaagtgacatttgggacatcgaggggggaaggccaaggtgatgcagtgggggagttgttacaggcaggatttgagaataaagg

SEQ ID NO: 562173 - DNA, 154 bp, Homo sapiens
aaaaaaaaaaaaagatcatcagccggtcctgcctgagcctaggattcatctttcttttcaccgtaggtggctgactgggcattgtattagcaaactcatcactagtacatcgtactacacgacacgtactacgttgtagctcacttggggatcc

SEQ ID NO: 562174 - DNA, 992 bp, Homo sapiens
  misc_feature (32)..(32): n is a, c, g, or t
  misc_feature (38)..(39): n is a, c, g, or t
  misc_feature (44)..(44): n is a, c, g, or t
  misc_feature (610)..(610): n is a, c, g, or t
  misc_feature (631)..(631): n is a, c, g, or t
  misc_feature (673)..(673): n is a, c, g, or t
  misc_feature (678)..(678): n is a, c, g, or t
  misc_feature (770)..(770): n is a, c, g, or t
  misc_feature (773)..(773): n is a, c, g, or t
  misc_feature (776)..(776): n is a, c, g, or t
  misc_feature (784)..(784): n is a, c, g, or t
  misc_feature (800)..(800): n is a, c, g, or t
gagagttgcagtgacctaaacaggaagatggnctttcnnaactnccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaaccttatgcattcatttggtgcattcaaggcggatgatggcccatgtaaagcaatcatgaaaagattttcttcaatattttcactcgacaagtgcgaagaattatatatgggggatgtgaaggaaatcagaatcgattngaaagtctggaagagtgcaanaaaaatgtgtcaagagataatgcaaacggattataaagacanatggnaaaagaaaagcagattctggttttggaagaagatcctgaatatgtcggaggttaatattaccaggtatttttataaccaatcagacaaaacnggngancgttcaanatgggtgtgccggcantatgaccacttggggcctggcatgccgactggaaaggccgcgtgcaggggtaatatggaccggcagtgggaaacccgttcgaaaacaaggccacttgaattggccatgggcacccgaaaggggtggccgagatttaaactggggcccagggggggaacaccaggggcgctacgcgaaaacgaaggggctcat

SEQ ID NO: 562175 - DNA, 1047 bp, Homo sapiens
ggacgcgtgggtcgacccaagcgtccggttgattcagggaaactcttatgatatctacataccatctcatattcagggcaatatcacgtcctcatgctattgtcatcattgacctaagaacagagtggaatggaaatgctctgtcgtgctatgacggatgagaggaggtgtatagtaaacaccatatggaccggataactaaggatgtggtgctcacaatggggcagaaatgcccacgatctgtgggctacatacattccaatcagataatgggctggggcgagcaaagctatagagatccggtcagtggaaacaggacatatggatggagtattaatgcataagcgagctcaaaggttaaagttactagtgtgaaagaaaatgataaggtatataaagcataccgtgcgatctggaggaagtagccaagatgttaataacatgacacctcaacagaaattccatgatgaactggtaacagaagagcacttggcacttatcttcatggcgttatttctaatttaaacagaacataacgtcatgtggacttatgccagtctagaggcagaaatcagaaggcttggaatgaacatatcgcatttcccatttacctctccctccgaccgtcccagtaacagatcccatctaaacaaatgatgcagacctgggtggagaaggagagaaaacaggtggcaggaactatcaaggaagatcaccaagaaatgatgacacaagacagggaccaacagatggaccaagtgcccaacgaaaatagagaatagagaagaaataatagagtagctcttaaagaataaacatgggtaatagtggaattataaggattataaaactttatgatctttaaacaccttacagtgtgaagaaatggggaaagaatgcattatgtaaagttgaattttagatatgatgtcatatagagtatagaaattgagagatgaaaattaagaatgatacaagtaaaaaaggtacagatatcaaagctacagcttaaacaataggagtactaacaacctgataaatacaaaa

SEQ ID NO: 562176 - DNA, 932 bp, Homo sapiens
  misc_feature (32)..(32): n is a, c, g, or t
  misc_feature (38)..(39): n is a, c, g, or t
  misc_feature (44)..(44): n is a, c, g, or t
gagagttgcagtgacctaaacaggaagatggnctttcnnaactnccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatataacaatagaagaaaagtacagagcaaattatggagaataacatagaaatgacactgatgaattaaaatcttgaacatgaacaataattaatagatgataacatgaggaaaggatgaaagaaaaaaacaataaatacaaagataacggagatagacaaaaaaatgaaaaactatatgcatacaaataagatgcaataaaaggcggatgaagggcaaatgataaagcaatcaatgaaaaaagaataaaaatatcaaataataaaaaaatacgaaaaatgaagaaaaaaataaaaaatatgaggaagatgatagaaggaaattaagaatagaaaaagaaccgactaggaaaaaagaagaaaaaaaaaaatgagaaaacagacagctaccatgcaacaacaagggataaataaagaaaaaaaatagaaaaaaaagaacaaagcacagatatccagaaaaaacgaacagaaagacagggacaaaaaagaaggaaaaatacaaaagaaaataaaaacacaaaacaagacaaacaaaaggaaaaaggaaaaaagaacaagacgaagcacaggaaaaaagaaacgaaaaagagaaaaggaaaatg

SEQ ID NO: 562177 - DNA, 578 bp, Homo sapiens
  misc_feature (32)..(32): n is a, c, g, or t
  misc_feature (38)..(39): n is a, c, g, or t
  misc_feature (44)..(44): n is a, c, g, or t
  misc_feature (336)..(336): n is a, c, g, or t
  misc_feature (394)..(394): n is a, c, g, or t
gagagttgcagtgacctaaacaggaagatggnctttcnnaactnccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgtgagtaccnggcaatatactgtctagccctaagaaataacttaattctttttctcgggggaaagcanggtgcgagaggcaaagaactgataggggaggatcactgtttatttgcgtaaaatgaaaatcagcccttccctgtaaacagagtaaactcaaactgcaatccaaacttgagttctcagcattttgcatttagttcttaagcaaatttatgtgcaatttttatgattttaaaccataaacattttt

SEQ ID NO: 562178 - DNA, 1471 bp, Homo sapiens
cggcggcacactggcggcttgcggcgtctaagctgcttctccggctggcacttcccacgggcacctgctcggcagcgctgctggcactcctgctctgcctacccctggctctggcgcacagcactgcttcctaccacctactcctccactagcaggcacgcacacactccctgcgtgccacccgccgccctacctctccgcgcccccaacaccccttgccctcaaaacacgcgcctgcacacgccaagcaaagcctccttcacccgcacgcgctgcgcacgcgcgcgccaccctgccccccacgcgcgcacacgctcactgcgccctctctgctacacctctgccctcgttcaacacaacccgacttcgcaccacatcttactctgcgcttgccttgcgcctgcctgcacctcccacgccccacggccacgcacggccctctctgctccccttctcttacctccccacgcctctacaagcctacccacaacggccccacttctggctctctctcacatgtgcccccactctcttacacacgggcgcgcagacactccggctgcgccactgcccctgcatcagcctccacccttcacgcgcctccaacccacagcgccttgcccaccttcctcttccaccagcaaacaactctggggaccacaatggcttactgtgccttctccactcctcatccgcaaccacttctccccacttcccccctctccacgcaggattgcgcagcctctctcgcacctccccctcaacaccctccccacacccccgacccccactggcttctaccccaacggcaaccaactggcgccacgttggcaccgccgcacactcatctcctggctgcaaacattccacgacgcacgccccaccaccaacctcgcaacccactccccggcccctctacaccacgcactcccgcctgccgcccggcaacctccccgcctgccccagccgcacccacaacccacacgcttgcacccaactcatctacggccccctaaccctggcccccttccccccctgcgcacctgtgccccgccgcgcaccctctcacccctgttggcgggcccgccccttctggcttcacccccccttggacccgcccccttggcgcctgcgcgccccttccagttatccccccttttggcgccttccatcttacctcccctaagcgcgcaaacgccgcgctgagaaccctgggctcccacaccagccactctcactcgcactaggatctagcgcgccccccaccgcacaaaggggtctctccacacctcccccagcgcccccgtcggcaccgcgcccagcgcacaccaagccgcggcagcaccccgccgccaacaccgcgccaacaccacacatctccccccacacacaccggcgcctcacccgcgccacccggacacacccctcgcgcaccccccttctcacactcacactccgccgcccccctcag

SEQ ID NO: 562179 - DNA, 512 bp, Homo sapiens
  misc_feature (32)..(32): n is a, c, g, or t
  misc_feature (38)..(39): n is a, c, g, or t
  misc_feature (44)..(44): n is a, c, g, or t
  misc_feature (380)..(380): n is a, c, g, or t
  misc_feature (382)..(382): n is a, c, g, or t
  misc_feature (399)..(400): n is a, c, g, or t
  misc_feature (417)..(417): n is a, c, g, or t
  misc_feature (428)..(428): n is a, c, g, or t
  misc_feature (439)..(440): n is a, c, g, or t
  misc_feature (451)..(451): n is a, c, g, or t
  misc_feature (505)..(505): n is a, c, g, or t
gagagttgcagtgacctaaacaggaagatggnctttcnnaactnccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgacaggaaaggccatgtgaggacataggggagaaagcagccaccattggcaagncnagagagagccctcaccnnggaacgattgggaccangcaccttgatncttggattttnntaggcctccangaactaggatggttttaccacaatgaaggaaagttacatggcatttggggcttntgtattg

SEQ ID NO: 562180 - DNA, 386 bp, Homo sapiens
  misc_feature (32)..(32): n is a, c, g, or t
  misc_feature (38)..(39): n is a, c, g, or t
  misc_feature (44)..(44): n is a, c, g, or t
  misc_feature (385)..(386): n is a, c, g, or t
gagagttgcagtgacctaaacaggaagatggnctttcnnaactnccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgatctccctctgtcacccactgcactcgagcccgggtgacagagcgagactctgtctcnn

SEQ ID NO: 562181 - DNA, 553 bp, Homo sapiens
tcatgatggtcatgggctgttggcgcctctgaggtctgactgagtcgatccgctggtgcccgtcctacccttccaaagccgtctctaccctagttgtgctccaaacagaagcaaagccaaggctgagccgtggctggtctccctacagacgtcctgtagatgtgcaattttgcttaggcttgtcgcacacaaggtacagaccctaggaattttcccatctgcttctgtggcaacaaaaatgccaagtaagctccagccttggagctgtaccaccagcgagtgaagcgcggctcccagaacgcggctccagacgcaccccaggtgcttttctttctttctttgttttttgagactggctttcgctcttgttgcccaggctggagggcaatggcgtgcaatctcggctcaccgccgcaagctctgcctcccgggttcaagaaattctcctgtctcaggctcttcagtagctgggattacaggtgcccgacaccacgcccgggtcatttttgtacctttagtagagatggggtttaccggtgttaggcaggatggt

SEQ ID NO: 562182 - DNA, 1107 bp, Homo sapiens
  misc_feature (32)..(32): n is a, c, g, or t
  misc_feature (38)..(39): n is a, c, g, or t
  misc_feature (44)..(44): n is a, c, g, or t
  misc_feature (725)..(725): n is a, c, g, or t
  misc_feature (746)..(746): n is a, c, g, or t
  misc_feature (788)..(788): n is a, c, g, or t
  misc_feature (793)..(793): n is a, c, g, or t
  misc_feature (885)..(885): n is a, c, g, or t
  misc_feature (888)..(888): n is a, c, g, or t
  misc_feature (891)..(891): n is a, c, g, or t
  misc_feature (899)..(899): n is a, c, g, or t
  misc_feature (915)..(915): n is a, c, g, or t
gagagttgcagtgacctaaacaggaagatggnctttcnnaactnccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttactttacagtacgggtggctggcaagatggccgcactaggcaagagctccagtctacagctcccgcacgagatcaacgcagaaggaacagcagtctcagccggttagcacgcaccaagcagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaaccttatgcattcatttggtgcattcaaggcggatgatggcccatgtaaagcaatcatgaaaagattttcttcaatattttcactcgacaagtgcgaagaattatatatgggggatgtgaaggaaatcagaatcgattngaaagtctggaagagtgcaanaaaaatgtgtcaagagataatgcaaacggattataaagacanatggnaaaagaaaagcagattctggttttggaagaagatcctgaatatgtcggaggttaatattaccaggtatttttataaccaatcagacaaaacnggngancgttcaanatgggtgtgccggcantatgaccacttggggcctggcatgccgactggaaaggccgcgtgcaggggtaatatggaccggcagtgggaaacccgttcgaaaacaaggccacttgaattggccatgggcacccgaaaggggtggccgagatttaaactggggcccagggggggaacaccaggggcgctacgcgaaaacgaaggggctcat

SEQ ID NO: 562183 - DNA, 841 bp, Homo sapiens
ggagtagctccagaatggtcgttcctgaaaaggaagcactcggaatccttccgaacttgccaagtccatccatgattcagagatactgcgcttctctcgttctctgggatttatagtgtctctgatagtgaatcgtccgatgtatttgctagtttgcttcttttcgtctttcaatgacttgatcatctgatatgctgtctggagaaaaatcagaacttttgtccagcacagggaggtttcagaaagtgattttggattttctgtaagatgtttgaatttagttctaggggacaggcatctctcatcccggagtaaatttctgcctttgacctgcatggattattctgtcaggctgcggaatttctcgtgcacctacctgtagtatggggcactctggttttggtctgcagagtaagaaggtggagagaatgagctgtacttgggttaagcagttgaaaccttttcttcgagcaggatctgtaaaagcataattgaatgttgtttcacccccgtggatccagtgggcccgacagcgcaacaggtgtgcagatttctttttgaaacttcctttgtgtcccccgctccctctggcctcagctaaagaaaatgaatcctataaccaggttcatgttcacttgcttggccttttcagcactgattcctgaagaccttactatagtctttaaacctgagcctggaacccaaagggctttgtggggaagtgtcttaaattcacttaggggtgccctttaaaatctttcggtttgtacagcccaatttctatggcataaaatgacagatattctccaatattggtttacggcttccaaaccggaaaccc

SEQ ID NO: 562184 - DNA, 100 bp, Homo sapiens
gatggataacacatgtacaggaagaacacacagactccaagagcttccctccaaatatatgatgaagttcctgtaaatcactagattcacctacagcctg

SEQ ID NO: 562185 - DNA, 623 bp, Homo sapiens
gcagtgcctctttgctgtatcagcttgagagatgacgttgtcggccttacgctttagttgagtgagcagattttggtatatggactgagatggggggctagttttttcacgtgaccgccgaactcggccgtattgtcagtcggggctccccctcggcctacctctgtgtactcacgccagtgcaaggggcgactagtttccctacgcccctattgcctgtagaccaccccagcgccctactccttgagtgaggtagtgtcgctccgctaagctccctggattattggtctcaattgttgccccgaggggtcctatggttgtggcacgacggatacgctatgaccgcatgggacttactggaactccggcttgccttgctagaggggccatcgcttgactcggcagcctttctagtgggccagcgaggggttatttccatcggctacgaaacatggagactcccacgcctcgccatagatacgtgtgcacaataagagcaatatctcacgggtggagacaatgcagacagacgcccccaccgccgcctcgtgatcgcgctgtgcccccccccctccccgcctacctcccgtttcccccttgccatttaaaaacgccaaacatgc

SEQ ID NO: 562186 - DNA, 157 bp, Homo sapiens
  misc_feature (6)..(6): n is a, c, g, or t
cccttnggtactcctccctggtggttggtgtaaatgagtgaggcaggagtccgaggaggttagttgtggcaataaaaatgataaccatacacaacactaaaggacgaacctgatctcttatactagtatccttaatcatttacaccaaccaccagag

SEQ ID NO: 562187 - DNA, 234 bp, Homo sapiens
gacctccttcacagcatatgagaactccagttcttctgcattcttgcacactttatttaaactttttaaatgtagctgttttcatggatgtcttataatatctcataaggataaaatttgcatttcactaatgaataatgaataatgtcgaacatctttttaaccatctgtctagcttcttgggtgaagtgtgtgtggctggagagagggagagggagggaggctggtggaagg

SEQ ID NO: 562188 - DNA, 316 bp, Homo sapiens
cccgtgaccggacacgagttttgctttcaatttacttttggcattaggggtattaaagcggatggggtcttaattttatgccctcaaatgtattgattttgttttgtggtttctacctttctttaatctttagaaagtcctctcaatcttcatattgtcttccacctttatggttaaggctgtataatcaatctttgattcatcaacaatatgtgtatgtttatgacgtcaaattaagatatgattccgctacccgatcgctatcacactaggcctaccaagttaccgctcacgggtcccgggctggaatgcctaa

SEQ ID NO: 562189 - DNA, 125 bp, Homo sapiens
gcagcgcggaggccgcacgatgactcggagttactgtaaaagacgtgaaccagcaggaggttcgtcaaggactcttggcaggccttcctcaaaaaggtcacggaagctgaaaggtccaaccatgg

SEQ ID NO: 562190 - DNA, 766 bp, Homo sapiens
  misc_feature (351)..(351): n is a, c, g, or t
tttacaaaagaaattaaaaaaaaaaattagccggatgtgttggtacacacttgtaggcccagctactcaggggtctaaggtgggaagatcacttgagcccaggaggttgaggctgcagtgagcatgattatgccactgcactccagcctgggtgatagagcgagatcctgtctccaaaaataataaaaataaaatagatactgtctacatattttaatcatttcccacttaaggcatgtggtgaggaaataggagaaagaggatgtccctttggctgtgctaatttggccttatctagactgccaccctgggccagtgcaggctactctagacactactgactcatatttncctcctcttttgtaccctcttctttctttctctaactattccttttactagttatgaaggcttatcttttcttaaattatctttactaaaaagtccaaaatgttgcactgatggagagattttatcaaggttaggttacagttggagtttgtgctggaagagttagaaacaatttctaatatacagtaatacaagatcaaaccctatgccacattctcttactattaattctgtgctaagaaacaatagaccttttctgttcatcaagtttatattttggcagcttgagcgatctatatacatacttaaaccttcaaaatattatgcctgataatacagtattctttgcctataagcaacagtaatgaactattggtaactaaagggaagaaaaaaggaaagaaaaaagagagga

SEQ ID NO: 562191 - DNA, 705 bp, Homo sapiens
  misc_feature (603)..(603): n is a, c, g, or t
gagcagacgatgtacgaggcggggacttcggtgtgatacctgtcctgtgcgccagtgctctagaagcagagttctatattctccgtgtggctactctccataccgtatatgtgcgttgctcgacgatgtctgatggaaggcattcgccgggacatggaggatgaaacgcccatgagagtgccacaaactatctattggcgcgatctgtggaacctagaaaggaccgactcaagggatccactcgagattactacgtgtgcactagatcgatgaataatgacgcaaccgagctatactcctcttgagaggaagcgggactagccattggagtgggctggtatgtctgagaggaaactgccgcaaggcaacattatgtccacatgcagccaggcaacattgatcttatgacagagccatcacaaattcaagggtaagaacttgggcaagatttagataaagtgtattgtcacaagacaagctgagttaaccgatttgaattcactttggacaaattaggccattcattccaagttgagtacataacaaggacaggtgatctcgtgtgacctatggcccattgatggctatacatataacggttgngacattgacgattttcacagtacgcattcgatgacattacaagattcgatagcagtttcagcatgacacctggacataatgatggtatggatcgtagaacct

SEQ ID NO: 562192 - DNA, 927 bp, Homo sapiens
  misc_feature (1)..(1): n is a, c, g, or t
ngtttgcggccctctcgccgcattttcttgggcccctcacgatggtgcccccccggatcaaaggttccgccccctcctttggtgtgcccgccctctctgctcggaagaggcactcctcccttccggtttgcggcctcgtccagttctggctgtccccgaatgctggctgtgccccggagccccggtttggggaaccccccagttgtgccagacgtgtcactctcccttctcgcgccgatgggtccccgttggtgtaggtcctggtgcataagcgtacacgtcccatcagtctcatcgtttgccagcgtccccgcgcccatttttgttccgcccggcgcgtctgtattataaggtgcatccttcattgcccccagcctccggttgtccgccatcgcaccccagacagtttgcagaaccaccagccagtgagactggtgcttgtcctaccgtgtacccccgcatatcaataaggtggaacttttcgcgagcaaaacatgtcatagtaaaggagtggtggccccaaaataaataaattgtggtggcaaattcttataggggcaattattccgtggttctctcaacaccttacgaggcgcttcattatgccacccaggtctcacgtcaggcgggtataatcattgagtgccagctctttaagacaaatgttgcgcacccctccatcacgaggtcttgatgtacccaaagcggtggctcctccctacgccagtttgtatcacattgctaattagtacccaccaatacgggcagggacagttatcgaatgattaatactatgagagaggagcttatgagcgtcctgagtcggcgagccccctgagacataacggtccgtgtctaagaatagggcgggctgccacaacaggaacaaaagtaaattctttaagcacccctcgaaccacaaagaca

SEQ ID NO: 562193 - DNA, 83 bp, Homo sapiens
cccaaaattgcctttaaaaaaaacccgggggggttgaaagcctttgaaccgtgcaggggatgcctggggcccgggccctttgt

SEQ ID NO: 562194 - DNA, 81 bp, Homo sapiens
gccgcggacacggccgtgtattactgtgcgacagtaccctaccgtggtgacccgagaggctttgactactggggccaggga

SEQ ID NO: 562195 - DNA, 241 bp, Homo sapiens
ttgtagagacaggtttcatcatgttgcccaagttggtctcaaactccgtcagctcaagccatctgcctgccttggcctcccaaattgccaggattacagatgtgagccaacatgcctagcctgattgagctctaattcttcagatatgaataaacaactatggtcaaataatgcagtgcctcttcatcttcctccccaagcagtgcagacacttgtggattgttgggcacacattatggag

SEQ ID NO: 562196 - DNA, 344 bp, Homo sapiens
  misc_feature (238)..(238): n is a, c, g, or t
  misc_feature (261)..(261): n is a, c, g, or t
  misc_feature (271)..(271): n is a, c, g, or t
  misc_feature (330)..(330): n is a, c, g, or t
atcctgccggaaaggtagctgtactgagagaagctgggtttggggtactcaacgaacctgctgtttctacattttttttttgaacctaaaattccttcaaaacagttaaaacaaaagacagttatgctaccctcagcttgaatgccttacatgtgtgtaggatatagataaattttctctctctatagttcttagccgtgtaaatttgttaatgtacaagtgagttctggagatcctnctccaagagaaccaggtgtatcnagtatgttcnagctccccgtgttcctttgttcttcaattttaaaggtttaaattcctaagttctttatnttactccttgcctc

SEQ ID NO: 562197 - DNA, 500 bp, Homo sapiens
acgcagtgatacagactcatttccatggtttggtagagcttcaacttttggtctaaggccaccacattcttcaatcataatactaagttactcagttccacctagtctctcagcagcctgaactatatttgatatggcatccaggataagcagaataatcttggcatcttatgcagtgaagaggtcatcaacggttctattatgccacagtgaacaagggtacacaatctgttcaagtgttccaccactggtatagtagggcacggcccacacagcttcctttggtgtcttaaattctgccttagagagaacgctgccgcaggaatgggactaatccatgatacacaacttgctgtatctggtcctggcgtccggctgtgatgtctgacattggtccacgtagcttccttctgaatgtaagtttaggggtgggtgagcaggccgggaaagacggcgagtgctcctggaatcaatcacaacctgagtcgggattaactgct

SEQ ID NO: 562198 - DNA, 1153 bp, Homo sapiens
tgcgcgcgcgcgatcgcgctcggatcacggacgatgccgccatcactgtcgcccgcccaggtcgcccctcagccgcttcccctcgccatggaggcgaggccgccgcagcagccgcaggggctcggagccgcgaggccagggcaggcggcccttgagggcataggaggaggacacgaacacgccggcacggaggaggcacgaaggcggaagccagatagacctacgtccccaaggtgggatcccgccccaaaaggcccgacgtctcgctgacacacaagatagcgaaaaacgagacacagggtactgagatgggacattgccaactaggacccgcgagaaaagggagaatgcactgccaggtccaacaggtaacacctaagcgcactcagcgacaagttggaatctccgtggcgatcacagatacacccaggatcgcacataggcaggcgggaggagaggggagagacaacggaatcaaatgggtgtacaacggtaggcccaaacgaaaatgggcatagccaaagaaggggttcaggcaccccatgtgctgcggaacgcgaaaagtcacacaacggaatacaacggacagacgcaaccaattcaaagacggcgacgagaaaaaaacacagatacacaacggcaacacggacggggcccaaacaagagactgatgcgaaagacgtgccgcaggaccgtgacgtaacacagacagacagcgatggcgtccataaacacgacgaagggaaaccaccaaggaacagtcgcacgacacgacagaaagtaataccgcggaccaggggagacagcccgagcttaaacatataagccgacggggccaccaagatgacgtccaggaccgtcctgagccaacgtagggggacacccagcaagagcagcactgaacagagacacccaagagtggtgatgaggggccaatgcagcagcgcgccaccaccacaaagtggggaaacaggatggagacttgccaccggaagtagaggcaaggctgaaagaagaaagaacagggaaacaccagccaccgcgggtgaaaaggagcacaatacccaggacagcacgaaggagaacggtccgagtcccagagaaacaagtgggaccctctgatagaccgaatgacggcagccgccacagcata

SEQ ID NO: 562199 - DNA, 281 bp, Homo sapiens
atttgctgagtaataaatcttagtattactgatgataatgtttccaggcattatatgcttcttattatggtacaaaataaggtatacaacaccacctagttagactattcttgccaaaaatatttaatttgagtccagtcaagcctttaggtcttatttttagtttataagaaaattacagaacaaattagaaaattcctgtgttaggtattgactattattttggataacaaagtgtagatcattgcacacgctttgcagttgttatcgttttgccctct

SEQ ID NO: 562200 - DNA, 1733 bp, Homo sapiens
  misc_feature (1)..(1): n is a, c, g, or t
  misc_feature (1032)..(1032): n is a, c, g, or t
nactgtgttattgagtgtttactacctcactctacctctccgtcaggtccgttttgttgtcgtggtctctatgttttctcctgctgaatgtgttgtgctcctacatctatgtagtggttttcctctcactcattggttgttgctctttttgtgatctctctgcttttttgagtgggtcttgcgtccccctgattgggcgtcgcaatgtctgccgtcagcttgctcctgatttttgtgcctcactatgcacccttttggggcccctacctctacctcgcgtggttgcgcctcggggggtgcgagacaccccaactgccccgagggtgttgttcctcctccccgcagaactgtggtggggtgtgttcccccaccagggggtggctactgcgctcacaatggtttttgttttttttttcttgcggcgcgctgttcttttctttctagtagttgacttatgggggccacaccccgggggttgtgtgtctctctccactatgggcggttatgcccctctggtggtgaccgggggttcatacacccaccacctgtccaggcgcccgtttgtccaccaagatgggctttgtgggaacttcgtcccggagaggggcgttgtcccccggagcgcgggctttcctaggagcttttttttctcagaggccgccacccctcgtgcgcgcctttacaccactggcgttctacacaatggggcccccaaggcccctcaatcttgtggcaaaacagttttggcgccacaccaattatgttgggggaaccccactagtatcctccccctcccgctcacatattgtggatcctcgcgcacctatcttcgggccacaaaatgggccccaccactcctgcgcacacaagagtgcggcgccctcgtagccgtggagcgtccctactagagtagtctcttgatattgtgaggacctcacagccgtttggggagagcccaacctgtgtggagggcttgtgggcgccacacacgcgcacgagctgtctctactttctcatgagcggtgctcaccntactactatcgtagagagcctctttggtgtgtctcctcccacagcgctccctcttctcatctccgccgcgctgcaggtggtgtctctacttttctcatcctcacagcactcgtcctcacatctctctcagcactcttctctcgcagcaccacgacacacactctccctctgtgtttctgtggccacacacacgctgtgggggagacccccccagacactcacactcgctcccgagtgctcgttgagagccacccgcgcgcgcccgcgtgtgttgtggggcccagcactctttttggtgagacacgcgctcgcctcacgcgagaactcggtggtcgcgaggttgggcccacgagacctctctcgcagccgggtccacacccaccacccacggccccgctgggccctctcccagccgcgttcttcggcaccttccccttcaccaccctctccccagatgtaagctctcatggaactttcctctttggacccaccgccacgctgccacttgagtgccctctgggagtggccctcggttcctcgggggaactccacggtggcctcccctcgatttcctcgtggggaacccccggtttccgggcccgggcctccttggaataaatggttattgttactaggtcccccccttccctctttttctggaaacccaaatccagcctcccccattaagtcctccctgcccc

SEQ ID NO: 562201 - DNA, 279 bp, Homo sapiens
  misc_feature (23)..(23): n is a, c, g, or t
  misc_feature (31)..(31): n is a, c, g, or t
  misc_feature (166)..(166): n is a, c, g, or t
cggtcggcaagaataggtatgtnactggtantataaaaatgcgattttatcataatgatttttatccaaatcatgtcaagggtgatggatcattctatataatctaaggatatttaagtggcagctggagatggttggaggcaagatgggaaagtaactgctgaangtggcaaagatgaatgttaccaaatcaaaggtgataaccttgagcaagaaaacttgaaaactcagggacaggaacagtaagagctaagttaacaagtcagggcacaaggggta

SEQ ID NO: 562202 - DNA, 512 bp, Homo sapiens
gtactctaagatccggctcagtgatctcactgtacgcttgggctcagtgatctctggctcagtgatctctagctcagtgatctcagcttgtatgtctgggctcagtgatcctttgggctcagtgatctctgggtcaagtgatctctgggtcagtgatctctaagagacgcctggtgggtgctcaaccacatggggcgacccaaaagacgcccaaaacaagagctgctcaggaggcactaaatgttgacggtcttggccggctttcacatcctcaatttcagcagacagccagcggtaagtgcaatgacggccgcagcacctcaaatggcctttgagttccagtgtttgtttgcctgaataccaagggtctttctaagcccaggcaggtgaggcaatttcatgtctgtgatgtgcatccgctccactttatcccttgtgatccagggctcaaatgggcttatttcaaagactcttgctacccatcgataggcaaaaagcggcaaggggaatgg

SEQ ID NO: 562203 - DNA, 404 bp, Homo sapiens
ggggggggttccccccggggcccgggaattttaggggcccccctgtttccgccccggaatgggggtttttttttcccccccttttttggcccgggggggtttttttttttccccccccccaaaaaccggggaaagaattgcccccccttgccccggttcccccccttttaacccaggggaaaacggggggggggggggttcccaaacccaggggccgttttttggtttcccttttgcccccaggggggtttttttttttttttttttttcccgggttgggggggcctttcccggggccggtttggcccctggggtggttttttttccccccccttttttgtttttttccggtttccccttttcccgggggtttccgggccaaaaaaaaaaatttttttttttta

SEQ ID NO: 562204 - DNA, 218 bp, Homo sapiens
cttgaagttgacccagtccagacacctattactcccagcgctggcagagctgacacacaggattcagtggggctgacatcgccaacatctagcaatgaggctgcgttgcacgcggcgcgggaagggacacacttccgtagcacactactcaactatcgacgtacgccgttggagccgcgtcctcgacaggtgcactgccagcaaaaagagcaaagatc

SEQ ID NO: 562205 - DNA, 341 bp, Homo sapiens
cacgaggccaacgcccatttctacaacatccctgccagctcttctgccggacctggggctacgctggagcccatggatcggaaagcagctcgaaggcacaatgacagttgtccttagccatctgcacccccctgggctgaaataaacgcacgcacctcccatcctaatcatccaatgctcaagaaacaacttctacttctgaccttgccaacggagagcgcctgcccctcccagaacacactccatcagcttaggggctgctgacctccacagctacccctctcccctcctgcccacgtgtaaaacaaagccaaaagctgagcaccaatggatgaatggag

SEQ ID NO: 562206 - DNA, 156 bp, Homo sapiens
ctgaacgtcaccaatcaactcacaatgagaaattaccggccaggcgtgtgactcacgtctgtaatccccggactttgggagggcaaggcaagagcttgagcttgagcctagacgtttgagaccagcttggtcaacacagcaagaacctgtttcttt

SEQ ID NO: 562207 - DNA, 360 bp, Homo sapiens
  misc_feature (11)..(11): n is a, c, g, or t
atgggatatgnagggcctgacctataataaatttccctaaagttgtagggatacacaatcgacatacaaaaatcattgctatttctaaacactaacaatgaattgtctgaaagggaaatttaaaaaacagtatcaaataaactactttggaactaactaaccaaacaagtgaaagacttaaacactacaaattataaaagattgatgacagaaatttaagccaaagtaaattgaaagacaacccatggattgaaagagtactgtattattaaagtgtccatattactcaaagcaatctacacatttaatataatccatatcaaaatcccaatggtatctctcacagaaatagaaaaaaaa

SEQ ID NO: 562208 - DNA, 258 bp, Homo sapiens
gcatagaactaccatgtaatccaacatcccactcctgggcatctacccagagaaaaacatgactcgcaagacacatgtactccgatgttcattgcagcactatttacaatagcccagacatggcaacaacctaaatgtccattgacagaggagtggcttcagaagtggtacatatacacaatggaatattactcagccattaaaaagaacgaaataccagcattctttgcaatgtggatgaacccgtcggctaattta

SEQ ID NO: 562209 - DNA, 231 bp, Homo sapiens
  misc_feature (170)..(170): n is a, c, g, or t
  misc_feature (180)..(180): n is a, c, g, or t
  misc_feature (190)..(190): n is a, c, g, or t
  misc_feature (195)..(195): n is a, c, g, or t
  misc_feature (200)..(200): n is a, c, g, or t
  misc_feature (204)..(204): n is a, c, g, or t
cagtcatgagcttcttgctgttgttgcggccgtgcatcatcatggagttagtgaggcgctccacaatgggacactgagctttggggcagcgttgggcggcataccggcccttgactgtgagggcaggtacttggcatacttctccttcacagcaatgtaatcctgcaggnaaatgtcatngatctgcacntcatnggtgntccntttcccaaagagctagaggtctggggt

SEQ ID NO: 562210 - DNA, 130 bp, Homo sapiens
gcggaggtgcagcatctcctctcggcatcatggccgccctcagaccccttgtgaggccagagatcgtcaaaagagagaccaagaggttcatccggcaccagtcagaccgtatgtgcaaatagggcgtatc

SEQ ID NO: 562211 - DNA, 159 bp, Homo sapiens
tgcaagtataagcattcttgatacgctgggcccgggggctcaagcttgttaatcactcagcactttgtgtaggccgatgtcgcgagtagtatcacctaattgtcagggaattcgaaatcgggtaccgacgtctcgaattacgtgatctgtcgttcatag

SEQ ID NO: 562212 - DNA, 1135 bp, Homo sapiens
cctgccccctcccagcccggcgactgctctgggcccgtgcgcacctgcacggctgggggagccgctcgccgtgggagcgtcagtgagggcacgctgtctgcggctgaacctgctggaagtggcctggtgatggaaccgggcctcgtggagatggccctgagggcccccgcactgctgccgcgtgctgctgctactactgcctgctcctgcgcctgccggctgcccagcagcctgccgctgctacagcgccacggtggagtgtggctgccctgcggttgcgcgtctgtccctgctgggaatcccgccagggacgcagacactgttcctgcaggacaacaacatcgccctgcctagatgcctgggagccctggcgccactcgccgctctgcgccggctctacctgcacaacaacaagcctgcagcgccctggaggccggcggccttccagcgcgcagccagagccttgctggagctggcgctcactagcaaacggctgcgcggcttgccgcagtggcggcccttcgtaggcctggcccagcttgcgcgttgctctacctaggcgggcaaccaggctggctgcggttgctggatttcaccttcttgcacctgccgcggaacaattgcagggaggcttcaacattgcaaagcacaaacagccattggagcttgcttggacggacccagtgatcataagacggaggcatgtcccatcccttagcaagtggttggaacctacacgcagggaaccaggatggggcaaccaatacagacacggaaaaggacgctggaaagcacccattgagaccaaggtcttgcaaaggttactagcgaccgtcacaaagaagaagccccaaatttggagcggcctttgttgaactattgggcccaccattgagaaaagatagagaataggagagatagcacttaggaaattcaacaaggagaggcgccgagagacaaaagcaggagatggaaacaaaacataccacaaggggaacacagggaaacagcaatcagatgtagtagagaagaaagcacaccgttgacacaatagaagaatccagaaaaatgattacatggagaacataaatacccaataagagagccaacaaatataagcaaaaaaggaaacgct

SEQ ID NO: 562213 - DNA, 822 bp, Homo sapiens
tgttcccaggtgacagcccccttaacctcagtcctctccagtacagtaatgcctttgatgtgtttgcagcctatggaggcctcaatgagaaatcttttgtagatggcttgaattttagcttaaataacatgcagtattctaaccagcaattccagcctgttatggctaactaaaaaaaagaaaatgtatcgtacaagttaaaatgcacgggcccaagggggattttttcttttcacctccttgagaattttctttttataagcttatagtagggatacattcaagctgggttaaaaacaataataactaaaacatgcatcatttttcattggccaaccaagcacaaagtcatttaatactggacggtgatatttcaaaggtatactctcagatatggcctcttacagtatttaagatatagcaaggacatggctgatttttttttataaaattggggcctaataagggggtcatgggcctttcctaatggtataattcaatttagtacaaagttggtcacaatatcagaggatatatatatatggggcctacgacatggtatggcatctatatcttttaactacagtgatctgtgacagcagcagctcacatgtggaatatgttacggaaatgtgtaaaatatccatcttaaagaattcaatatgctaaaactggtgtaccggaatatcttaaagggggggaattaaaggtcgataattgctttttaacaaaagtgttttcggtgaacgtttaagaattgggcataatactgcgagaaaactgtactcgaactattaattggcccatatgtgaatatgaaag

SEQ ID NO: 562214 - DNA, 396 bp, Homo sapiens
gactaataacactgaattcagcttttgtgaatcttatctgcagatatgtacagaccacatcctaagattgacttctgcctcaacagaaatacatgagccagtgccttattggaaatgatttgcgtgttttaagaactggtgtatataggtacatcttgaatgttctgctttccttgccttatgcctgtacttcacctcagccttcaattccattgtgtctccttgctacttggtatcttgaaatctggtacgaaactattgcatgattcctgcacctttggttctggatatattataggtcttttatagtgaatttggacaatttaattccattgaagtaattcaaggtcactatatcgggttagtaaaaactccaatacaactttaaatacgcac

SEQ ID NO: 562215 - DNA, 181 bp, Homo sapiens
ggtttcattgttcaggggacaatcgttcgttcactgctaacagccttcttcgtcagtatcgtgagtgatgcagtggagccgacttgtgtacatactgtaagaccagagaggaattcggtcttccagcagggagatgaagaacaagatcttgctattatggcctctttgaagacgacagccc

SEQ ID NO: 562216 - DNA, 398 bp, Homo sapiens
  misc_feature (33)..(33): n is a, c, g, or t
agatttattcttgttaaggaacggccacaaaanttgcacgtcaatgcaatgcacgtcttcaccatccaattgaaagctgaatttatgttttatgtatacagtaactaagatactgttttaaatggcatacaggtctgctctgactttacacggttattgttctatttagttattaatacttatttccaaaaaaggtcttaggaacgtttgtatgtaaaacattttgttattcaattattttatgatcagttttcatatgtacttaaaatagtaggtacccttttatttaaattattatttgtatgatttctcagaatagttcctgattacactaaagagggtttttagtctctcttactacaagaacccttggtttggtcttgaacataagtcgacgc

SEQ ID NO: 562217 - DNA, 120 bp, Homo sapiens
agctcagcgagaagtgactttgagctcacagtgtcaccgcctgctgatgggagagctgaattcaaaaccagggtgtctccctgagcagagggacctgcacacagagaggggatcctctag

SEQ ID NO: 562218 - DNA, 382 bp, Homo sapiens
  misc_feature (332)..(332): n is a, c, g, or t
  misc_feature (364)..(364): n is a, c, g, or t
aattcgcggccgcgttcgacacggctgcgcagaagacgacagaaggggaacagggagtgtactgatacaaattgtttgtcaggaattgtccttgatttacagaaacaacattggttcgtgattggctatccattgttgagctatgcattattaggttaattgcagctgcttgtggcaatagcaatcagtttcaacagttgaagacatagctcaaaagggagggggagtagaaagtgattgctgtatcgtttaatgtctctctggggcctgataataaagacttgcatccctcagatgttatttctcagtaactagcatgtattaagttaacnggattttgtcgtacaatgtgtatattttgaangagttagattgttttgtc

SEQ ID NO: 562219 - DNA, 125 bp, Homo sapiens
  misc_feature (2)..(2): n is a, c, g, or t
gngaggtggaggttgaagtgagccaagatcatgccattcaaaataaaataaaaataaaacaaaataaaataaaatattagttgggcatggtggcatgaacctgtagttctagcgactcaggaggc

SEQ ID NO: 562220 - DNA, 476 bp, Homo sapiens
atataagtacagactggggtcttgcatatgttagcccaagctgaacttaaactacctggactcaagcaatccttctgcttggcccccaaagtgctgggattgtgggcatgaactagtgtgaccagactccatgtattaatatcaactctcactcctgaattcagttgcttagcccaagataggagtactctgatgcagacattattgggctctattagggtaagaagtatgtgtctttgtctggccacatcttgactaaatatagtctactctgaagacctttactggcttccctctttcatctcctgagtatgtaacttgcacatgggcagctatccagtgacttgtaccagagtaagtgtgtacattaatgtatatttagctctgaagcaagagtgatatactccaggacttagaatagtgcctaaagtgctgcagccaaagacagagcggcactatgaaaagtgggcttgaag

SEQ ID NO: 562221 - DNA, 132 bp, Homo sapiens
tacatccctgatatgcgtctcagatctcatagaacacagaaattttagctggaaaggactttgctatagatcactgggtcgaatatcattctttttggaagaaggtttactcagaccaccaagagcctacat

SEQ ID NO: 562222 - DNA, 875 bp, Homo sapiens
taaaaccccccccccaaaaaagggaaaccaaaaaaaatatcacccccttttaaaaaaggcccattttgggggggggtttctcaaccccaaggggttttggggtttaaggaaaaatatgggggggggataaacacaaaatagggaggaaaatgttgtgccccaaaagaggacgatgaaatccgcggaggaccaccggggggtcatcacaaatattgtgtccccccgataacatcccgcgcaaaatggggtacagggggcaacctcagaaatcctctggaggggctagcgagggaggagttaaaaaaagacccccagacaaggtggatcacagcacggggcatgaaaattatagtgggggtgcaggggggctctctataatacaccaagtagggcgaccccgggggagagtgagaccccccgggacgagcagaactaaccgggagaggttgtgaagcagaggagagacaactgggggggatgcgcgaccacgccccaaacgggagaaagcggaaccaacaactcggagagagccgcccgcgacgagtgggtccgacgccaaaatttattgtgaccccccggggagaaactcctgtaaagaaaaactcttgttcccgcacacaagaggcgcgtgagcgcggagcctcgggaagaataagtggtgcgctccgaaaaacacacgcggacgacggcgtggagaggggagcacaaaatatcccgccgggggaacaaattaccaggagaaggggcgcggcccgagagacaacttaggcgaccgtcgttaaagaagaaaagaggcccccacagggggttttgttggcaaaggaggacaaccccccattttgcgggagggatgtcggcccccaaaatagagggag

SEQ ID NO: 562223 - DNA, 550 bp, Homo sapiens
gggctatattgcatgcgctgagtgtgcggcgtgtatcaagatgacacctgcttcagactaggtttctaaatgagcacatgcagggagcgccccgtgaagtgaacatgtagtatgagcaaaatataaaattaatttataagccactgaaattttcggattgtatgtaatggcagcataacctaaaccatcctgactcatataaaacttggctcctagatatgggttagtgtaataacaacaataagcataacaacaataaaactaaacaatcatttagagggcgataactaagaacaccgctatcagaagctgaagggatggtgctctgtttggtaaacatctcacctgtgctactgtagacggcagatcatgaccctgatgacctaaagaacaggatggtacaacagagagtgagtagtgtgtgtagggggctgttggatgcattctgaaagtactcacaagctattcaaagccaaatgatttcatttaattgtcataataactgaccacccctcacctgttgtagctactatgtaaatgctgcgaatat

SEQ ID NO: 562224 - DNA, 242 bp, Homo sapiens
  misc_feature (76)..(76): n is a, c, g, or t
  misc_feature (99)..(99): n is a, c, g, or t
  misc_feature (142)..(142): n is a, c, g, or t
  misc_feature (153)..(153): n is a, c, g, or t
  misc_feature (209)..(209): n is a, c, g, or t
ctatctccttgcctgtcaaggcaggccgggctcccagggctccccttgcgtggggcatgtaggtgggggaggcgtntgcaggtcaccctgggggcccanccctctccccagccttgcctggctgagctgtgttccagggganccctggaaaanccctcataggcagggagggggtttccgaggccagcatccgccgccccgtgtcgcancctggaataaaatgtggctctggcatggttcca

SEQ ID NO: 562225 - DNA, 82 bp, Homo sapiens
ctgggagctgtccaggaacctcgacaggagccggacgggccacaccatccacaggcaccaaatggacgacccggcgcttcag

SEQ ID NO: 562226 - DNA, 317 bp, Homo sapiens
  misc_feature (1)..(3): n is a, c, g, or t
nnngggggaacagggtacttgtttttttcaccccagggttggagccccatggcaatgatcacggctcactgcaatgtccactccccaggcttaagcagtcttcctgtttcaggctcccaagtagctgggactacaggcatgtaccaccccacaccttgctaatttttggatttgaattttttgcagagatggggtcttgccatgttgcctaggctggtcttgaacttctgagctcaagtgatcctgcccacctcagcttcccaaagtgctgggattagtggcatgagccactgcgtccagcccacggtaacatttct

SEQ ID NO: 562227 - DNA, 419 bp, Homo sapiens
agcatgccccgagtcttaaacaaagagctctccattcgacctcctgaaatcccaccccagatgaatgtctcctcccagttagccacagagggtagctcagacttccagaagtacacacttgcattaaatgcacgcagccagtcctatacgttgacccttggtccaaccctcagcttaagcgcggaaagaagtggttctgatccatgcccacccagatctcctgaggagtctggggttcccaggcaccagatttgcagatcctgcacaatggtccttcccggactggctcggtatcccctaccttaatggtttctctgaacacagttggtggagaggcaaaaatcactgtcttacacaggtcttctcacacgtggacagctcagcaggcccacacatctgtacagggcccaccatgagct

SEQ ID NO: 562228 - DNA, 289 bp, Homo sapiens
taccccaccaatgtgcgcttgaaccggggggactccatgccaccagtcaagcgtcggcggatgaattgaatcgaccccccggatgacgttttctacatgcccacagaggagaccaggaggatccgcaagctgttctcatcctcggaaaccaagcgtgttgtccgccgtccgaacatgaccatcgccttgcgccagagccaggcccttccgcagcgaccaccaccacctgcgctcgccaaagatgagccaattgtcatcgaagaataggaacaaccaccgcgtgcggccg

SEQ ID NO: 562229 - DNA, 194 bp, Homo sapiens
gtgccacttacattcaaaggtggaagagaactgttccagattacaacactaaagacacattatgaaccacatgcacgttttaacctcactggccctcatgtggggattggggtgggaaaactagaagaggtattcttttctaaatttttatgggtttttttttttttttttccttttttttttttttttttttt

SEQ ID NO: 562230 - DNA, 736 bp, Homo sapiens
aggaaatggggtgccgattgtatgggtctactatagaacaagggtaatcagaacatggaatcaggtggaggcgacatatttaggatttgccgcttccatacaatcacacgcatgactaatacggggtctctgcaaatgtaacgggctccaacttcacttaaggcagtcgcacgatgtctgcacaacggattggccctagtgactcatgctacacgcatgggctccgacactgacccggctaggatcactgcgtccatgcaaaaaaagtcgaatcctgtcattgaattgaatatgaatttctctaactctctccagaaaatggatggagataaccttgtctttaaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgccacagttggagcccaggggccatgtgtgcgctgatttcatgtgcatgggtgacagggagtactggttcactacaatgctgagctttctctactagctgtcctcccataatacaagagatcgggagatgcccctgggagcttcgcaccggaatctgaagacgggaggaacgcgggactacaggcggacaggcggggagacaagccgggggagccgggac

SEQ ID NO: 562231 - DNA, 182 bp, Homo sapiens
cgtcagagtctaatccaactgaaccacattagaatctctaataactgttattctgtgccatctgccatcacagagactctgctagggtgtaactgaggtggaaacatctctgatgccattattgactttcactatgacctgtccatttttcatgtgagcatttaggtactccccactgacaa

SEQ ID NO: 562232 - DNA, 556 bp, Homo sapiens
ggggcagtggaggggtgggaggctggtttaccaagggctttctgaaactggaggctgctatggggtatgctccttgagtttgtttgtttgtttttttttttggagtgggagtttcaatctgtgtttcctaaggctggagtgcagtacaggggcatgatctcggctcacggcagcctccatctcccgggtccaagagactctccggcctgagcctccggagatagctgggactacaggtgtgccatcatgcccagctaattttggtattttaagtagagatgagttatcaccagtgtgggccaagcgggtcttgaactcctgacctggggtgatcggcccaccaccacctcccaaagggctaggattacgggcatgagccacggctccgggcggggcaactaaacttttcaaagaaatcatatcctatattaactctagcagtgtcacacctcttggcaagggggtccatcacctttacttataccagggtgtgcccagggtcttctcggtgcaggaaatatcactagtccagaacatacttaatctattttcggga

SEQ ID NO: 562233 - DNA, 828 bp, Homo sapiens
gacgcttccatagcaaagggttgcccttggtacaggaggacgcgggctgcaggcttggttcctggcgagtttctaagcccccgctgcggtctagaggcacccggtgaaccatgtcggagatcctgtgccagtggctcaacaaggggagttgacagggtgtctcggaccgtgagtcccaagtcatttgcaaaggcattttcccagtggctaatctacttggagaagtctacaccaagtttgaacttcaggcatgattttccagcaatttctctggacagcaggggtttcaacgtgccaaacttaataactttttctcgctggggaagccaaacattttaacccttctgggtgtgcagttggatcacgaatgtggcccatggcatcattcacagaaaacgcctgggggttggcaacaaaaggttgttatactcacttgtgtccattgctcttcagaacacaacgaggaccaccgtggcctgctggagtgggaagatgcaaaccatgcaacgcctgacaacattttaacagactttcaaaaacattgaacacgtgcatactctttccaagagaagactttagacacattgaatacccacggtccacacttgatttcaatcttgatgcggcattacccttacgggtttcccaggaaaacaataccaaccccgttgcaaaggaacgactctttgccccattttgccattttgacgcacaccttgagatgattccaaaacttcaaggaagagcaagatgtttggcttttgggaaaggcaaacttaaatggaagacacgccacattgcatacatgggcacaaccaggcgggatta

SEQ ID NO: 562234 - DNA, 1217 bp, Homo sapiens
gacatggcgtgcggctttcgccgcgctattgcttgccagctttccagagtgttgaatcttccacccagaaacacttgcatcacatcaactatctggcagcttccaactttcccaacaacagaagcaagctagcctgacttttcagcatttctgtggacttccttctacttcggcacaacaagacacatgacccattcaagcacccagcactatctcaacagcttccaatgcccacacgcagacctcacccagcacgaatgcgtacacgatgctgcatcacacgctggctgcagctgcaacatccagctcacctagcgctcccacagcgacctggtacaactctctcaacacaatcacaacccagcagcagtcctcctctccacacccacaagccaccagcttgcctaacccaaaccaacgctcacctctgcccacgcactgggcatccgacacaccctcaatgcggcatttcaacccaccaggcttggcagagcgcattctccagaacccatcagtgggccacccattcagcccccaccgaggccaacagcgcacacagcaaactctggcaaggggcactccgcaacagacttctccgagggcaagtccccaaccccgataacagctgcgtcaggaccccgacaaacccaccagcccttcccccaacgcggctccggggtgcgcccccagctatgctgggccggcctctctcttcgacgcccgcacgttcccaacttccacgcgccaccacactgtcgcctccaattcacgggccaaagcaacttcgtttcctaacacacgcaacaagcacatgcttccaggcggcacaccaattcgccaacgcgttccgcactcaagaggaaaacctacccccaggtgtcaacgccttcggaggccgcaacctcggggcagggcccaccgggccaagcacctcgcgggggactccacacacacccctggggcggaaaacacgcggcgcccttcaccccaggccccagggtcaacccgcggggaccctacactgacgcgcgaacacagctgacccccggggctacgatgcccccacaacatgaccccccccataaaaccagcccccacttccccatcccatcacaggcaaacccgaccgcgcacaccttgcatcaaccacaagcgcacttcccagccccaccacacagccaacacagcacgcagccaagccgcaccagtgacagtac

SEQ ID NO: 562235 - DNA, 136 bp, Homo sapiens
gtctctggaagattaattgtcaaaagaatacaccgccttgatatgggctgtcatttaggtcccataattgtggcttgctattgaaacatatcatccccaattggaccgtgcagaactattgtgctgagagggtcac

SEQ ID NO: 562236 - DNA, 376 bp, Homo sapiens
  misc_feature (105)..(105): n is a, c, g, or t
  misc_feature (137)..(137): n is a, c, g, or t
  misc_feature (227)..(227): n is a, c, g, or t
  misc_feature (303)..(303): n is a, c, g, or t
  misc_feature (328)..(328): n is a, c, g, or t
tggctcccagtttggcagaaacgggaaaactggatgcaaccaagtcattgaccgaataatctttatatttaaacgatggaccgaaatcaccgtgcgccagttgtntcaggtagctgaaatactgtgtcatgatcggntcattaagatgatatttcgcttcgatattggccatcacttctggcggtaaagtacgttcgccggtaaaagggcttcccggcgcgaggcgnatcataaagaacgaaatagtaataagaataaatagcgtcggaatcgcttccagacagcgacgtagaataaattttnacattgccctaccttctggcctgtncttctgtaatgcgataaaactcagacaccgtggagcaggacacttcct

SEQ ID NO: 562237 - DNA, 1267 bp, Homo sapiens
cgagacagcctggccaacatatgtgaaatcccgtctctaccaaaaaatacaaaacaaaaaagaaaaaaaaattatgccacggtgtggtggtgggattcctgtagttcccgagatactcaggaggctgaggtgggaaatttgtttgaccctggggaggcagagtgttgcagtgaactgagaagtcacgaccactgtgttacgtccagttgtgaggcgacagtagttgagaacccaggtctcaaaacaaagaaaacagggtgtggtggtggtggtgtactctattatgtgttattatttttattattaccccaccacaccacactactttctccaattaccaaggtcggcaattataccgcgccccttgtgggatatcacttaggcggcgtgcggagattatctcacagccaccacattatctacattgtctcgtgggataaaacaaagaaggacaacaagacaaatcataggaaactttttcgtgaggagaaagagcacagacccttttgggtcggacacctcagagcgccatagctgtatcatataaacctcgcaccacagaggggcgatacgagtagacattcgcccgggatagcgaacacaggtgtgtgtttctcctatacaccactcttattaaagcccccgcaagacatatgtttggacaaagaagcctgcgtgatccctcagatagcaaccagagaaatttcgcaggtacaaagcacaagaccggaaatagatcccggcgggaacaacctcgagggcgcaacctacaatgagcttccttatatacatacgacaccgctagcagcactactgagggttgtgagtctaaaccaacccaaatgtgttgagcgagatatgagggaacacccccaccatacggaggggggacgaaacgacccgaagcaacgactcagaggaaacacgcggcccaagagagagagattgagaggagcgcccaacaggaaggaactaaagcagcaaacagcaaccacaactacacatcagtcgaccacacgaggagaaggccaagtgcccccgagcgagaaagaggagactagcaccctttagtgaatacgaacagaaagcgcaggttgcgacagacacgcgactcattatcaaacagccgagagcaacaaaacatcgggggccccaccacgagtagaaaacacccaagggacatagcatacgcgagacgcgcgaacacaacacaacagatacaccgagacgggtgagtcaccaaaacagggggcccactcaaacacgg

SEQ ID NO: 562238 - DNA, 756 bp, Homo sapiens
cagcgcgcaggttgtccccggtcccctcgcccttcccttctccggtggcctacccgggtcccttacactccacagctcccggtcccgtcatgtcccagaaacaagacgaagagaaccctgacggaggagagcggcgagcgagagagcaggacacgcaggagataacgaaggtacttctgcactgacgaagcagctgcaagaggcgaccgctaaaggccaaattatccaaggccataggacacaagcctggaggctccgcactgtccctcatgactgagactccagaacacagggccagaagtagctctcgactcaggagactacaacagtggccgaagcccagatgaacgatataacgcaggttgcacaacgctgtcagaggagtcagcacatagataacctggtgtacctggatgaatctacgatactcacagccctataggttactgtgcccagtagaaagtccttcgacatcgtacaaccagcacaggacttgccgggtgtatatccctgagactgcccttcttcctcctcctttccttccagatccctcctgttaccgtctcatactaatctaatacgcgtccaggggggatgcataactggggttcacccctagtttccaagcaatctttcctgcagcgcgttgtctattagcccagacaaatgacctggttgagtttcttcgccttgggggcgcttgccttgaggaacatggctaagttgtactgatttggagacacgggggcttcctcc

SEQ ID NO: 562239 - DNA, 1238 bp, Homo sapiens
  misc_feature (189)..(189): n is a, c, g, or t
gatgccttcctacagtgtccatgaatataatatctagtgatgcaccactctcgctttcataggcacatacgtatgctaataatcgtcatcattacccttaatatccctctcccgtaacataatggcggtcacgaaaggtatatacactaactagtcgcctgccttcatatactacgcttatatcatcantaaacccatcaacaccacaaaccctactatagccaagtattggtgcctattgggccatgactagatcttgtgccagcctgcgcaagcaggcggtggggcctagacccgtagctagtgctccaatcgtgccaacacgatatgggcctaagacatgacgtagcgataagcctaaagcgctacgtccatatgctaacaactacatcgtcccaagcgaagttatattgactaccacgtgacattgaccttccaagaaaaccacataactttgaatcgacacaaacaaccagagctctaattattcagcatcatccctctactatttttagaggcaaatccaacaacaagctatttagcttgttccccaaaccttttcctccgaaccccctaaaaaacccccttcctaatactcaaactaacctgagattccttaaccccctccacaaatctatgggacaagacacagggccagcttatccacgtgaaaccccttattccgcgaagaaaatcacaccttctcatatcatcagttctcgcacagaattctctctaaatatacacctccaagcgccggaagatagacacagtatacaatatcactcatagcaaaacacacggttatacccaccatggtggacaactaccaccgcgtgatagcgtgaatgaccaaagaagcggtgctgaacaagagaacacatatccatcattatgaactcagtagaggtggcatccacccatcatatacgaagtgatgggctatgcaacggcacaccactcccggcggaaagacaactaacacagccacatcgaaggcaagcgaatgatctcacgctgggcggaacaatgacacgagacgcacgacagtaacgctagacagcagaggaatctagacaacagtgagccagtgcaacacagagtcggaacgcacaacgactaacaggacgggtcaggcagcaacaagcagatagtggactaacatctactacgcacacattactttgggacaacaccaggaaagagtaagacgacatgatagagtgaggggggggctg

SEQ ID NO: 562240 - DNA, 246 bp, Homo sapiens
tgtggcctgcctcctcccattcctagggcctggacccctcagctgggactatgcagtaatactgggaaaagggcaagtgaggcagggaaggaccctggtgagggccacacggcaagagtgtgctgcagagacagggccagcagtcctcactggcgcttgcacttgcaggtgcgagagcgtttccgccgcgcaggcttccgctgcttgtggagcctggcgatgcagaccccttggcgccgccgcacg

SEQ ID NO: 562241 - DNA, 234 bp, Homo sapiens
cgaggtttactcaattaaaaaaatattcttactcggtaataaaatagaaaaatctgagaatctgtagcttagagaactacagtgtgggatgtctataaagaccaggttattttatcagctcctaacaccccttaatagaagcttagccaagacttgcactatttcagtctttcccattccacattccatggactcttgaagagacattgatgaaacggtacagccatttaggta

SEQ ID NO: 562242 - DNA, 233 bp, Homo sapiens
cagtcgagtatcagtctgaccaacatggtgacagcttgtatctactgaaaatacaaagaaattgggcaggcatcgtggcgtgcactgtaatcccagctcgtcgggcaggctggggcaggtgaattgcttgcaccaggcaaggtgggagtaacagtgagccaacattgtgccagcctgggtgacagagggagactctgtctcaagagaaaaaaacacaccacaaacacaagagt

SEQ ID NO: 562243 - DNA, 812 bp, Homo sapiens
ggtggtggctaacgcctgtaatcccagcacttgggaggccgaggcgggtggatcaactgtggtcaggagttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagattgcaccattgcactccagtctgggcaacagagtgagattccgtctcaaaaaaaaaaggaaagggaaaaaaaattagctttatacctctttcttggtctcaacggccaggaaaatttctggaacattccaaatttcaggtggaattaatccaaaacaaaatttttataaggtttaaaatatttttacttcttatagtaataggtatacttaaaaagcctcagggtatatatcttctaaacagttacaattcaggtgcagttacattaaccaattatgtctctagtggagaacaactaaggcctatttcactgtgtgtagcctcaaggtgcctaccttgggtggccaattaaattattcgtagattacctgatggtaaaaccatccgtttgtgttcacattggcaaaatctcaaagggcctgtttattgtactcctggacattataatctattgcgatctcaaggattgcaggtgggggactagaattagtcccatttataactcaattggttgggttacacaatctccttttccagttatttcacattggctctccaaaggttattgcgacacggttcctttggtg

SEQ ID NO: 562244 - DNA, 929 bp, Homo sapiens
atcaccatggcggctgggaccctgatacgcgtatccgtgaaaactggagggccttcaaggctctcatcgctgctcagtacagcggggctcaggtccgcgatgctctccgaagcaccccacttccattgtgggcaagactcaaccgctaacccatgaaattgtctccgctaaatttcactgtcgcggcaatggtcccagcgagtctgagggtgatgatggtagttctgtgtgtcaagagagcaatcgccattgcctactatgtgagcaatgagtgagctgcgtgggaagatactccagaggcggcaggcccaggatgatgcgagtgggtgagcttttgcctggagttccgcatatagtagcccccaagtcagctacctgggtgtgccccatgctagcggcatcatgctacgataacaaacaggccactgagaatgcaaaggaggaagtgacggcgaattctgggtgctgctggatgcttacttgaagacgaggactttactggtgggcgaacgagtgacataggctgacatcacagatcgtctgcaccctgtagtggctctataagcaggtactaggagccttctttccgccaggacttgcccaatagcaacacgctggttcctcaccttgcattaaacagtcccagttccgggctgtctggggggaagtgaaactgtgtgagaagatggcccagttagatgcgtaaaaagttgcagagaaccaacgtaaagagaggaccagacacggcaaagagaaagggttcacgggtgaaggagaaagccagaagccccgaggctgcagcggacgggaggcagaacaaaggcggctggcccttgctgctgaaggggggagaaggccgaacggtggagcaggcgcctggtgctggaacccaaaggccaggaaccccttgctcacctgcccaggactac

SEQ ID NO: 562245 - DNA, 141 bp, Homo sapiens
gagtgtttcaggtattctgtgttggttgaggcaccctagcgcaggctggtgtgacgaactgtgactttttggcttcatgacagcctcatgttgatcacaggccaggccccaggttgcttctgtatcggtgcctgagagcag

SEQ ID NO: 562246 - DNA, 608 bp, Homo sapiens
  misc_feature (145)..(145): n is a, c, g, or t
  misc_feature (150)..(150): n is a, c, g, or t
  misc_feature (172)..(172): n is a, c, g, or t
ggaacgagccaaaacagcacacaaaatggacgccataaattctgaaataaaagtgtatgatgtgttctgagtcactgtagaagtcatgcatttattatcaagatagaaaagagcagagaatgacgtggacattggtctcggaggnctgcntaggtggtgcggtcccgggggnattctggcatgctggctctctttgaccgctgcgcggcagccctcgccgcctgcccggcactggctccactccagaccactttggcacacggctgctcactcctgcctcctcggcgtccctcttctctcaacgcctgcatttccctgcctccccaagcaggaggcttcgacgcccccattctgccctgccaacttacaactccctgacagcatgtgcacagcactattcgccgcggaattcgcacggcctcgacttacttggcgcggaatcagagtcccattccacaccgaagccccatccacgtggcctgagcaacacccctgtgtcccctgtatctgtctcactggctgtctttctgccagtttcttaaagaaccacaccattactgcgatttgccgttcgaagcgtcgtcccaacaatgcagatggttctgaca

SEQ ID NO: 562247 - DNA, 253 bp, Homo sapiens
accccgactagcgcgacagctggaaacggcctgtggcccagaggtcttctccgaaaggtgagggtgacatgctgtgcttttgtgcccaagctcaccagccctgggccacctcagtgcagtagtacaccatctcacggcagtagcacgccctccgtgggccgtctggcctgtggctacttggaggtgacggcactcccatgtgctgactcgccccatccctgccacgctgtggccctgtcgggctagtcggggg

SEQ ID NO: 562248 - DNA, 177 bp, Homo sapiens
tgatgctgcggtcgctctacgacgactcccccaactggtcctcacgctccgaaaacaacaacacactacgacaccgggtcctacttccacttacttcctacgcgcggtactccacggcggctcgggcctgctttacacaccacctctagctgacggacccactcgttggggtacccg

SEQ ID NO: 562249 - DNA, 433 bp, Homo sapiens
  misc_feature (115)..(115): n is a, c, g, or t
  misc_feature (148)..(148): n is a, c, g, or t
  misc_feature (192)..(192): n is a, c, g, or t
cggggctagaggaccggcagctatcggtcaatagctagtggccacttgatcacaagactgaagctacttctccactaaaaaaaaggggggaggtgacaacagccattagcaccanaatagactctctctgacatcataatagactgtntaaaacagaaggttggaaaggaatgactctcaggccagttcagntttaaggcgggattggccaatgccccccggggaaaaaagggccatctgaaaatcacctctaggagtttgggggaccaactgcgtgaagacaggggacaaagtccaaacccctacttgagaaggggaagagagcagctgggcaggacagcctcggaaaagcccatcgcctttgggccaaattggttgaagcggctttggtttggtccccccatggataagggaaaggagaaaaccaggccag

SEQ ID NO: 562250 - DNA, 335 bp, Homo sapiens
caaagcaaagcacagcagagacagcacagcacggacagcacagacatcacagcatagacagcacagacagcacagacagcacagcacagacagcacagcacagcacagacagcagagcacaccacagcacagcaccgacagcacagcacagacagcactgaacgcacatgcacatgcacactcatgcaccccacaaagcagagaatcacacaaatatggctcacctcacataggatacagacaaaccaaagacctgattagtatggtcaggtctacctggagcatacaagaacatggatggaatggaggcgtgtatcctggaaaagcgtcgacgc

SEQ ID NO: 562251 - DNA, 115 bp, Homo sapiens
gtcactggctggtcaggaatcttagaaacaagagacttatactgtctgtctgaggcaaaagataacagcagcatctctgacagcctctgccttaaaggaaatctttattaatcac

SEQ ID NO: 562252 - DNA, 954 bp, Homo sapiens
gcgggcgggatggggcggacggggactggcaggatttctatgagttccaggagccggcccggagcctcctgaccaggagaactgtaacgcgagccccgagcctgggggagggggggccgtgggcggttggtgtggcgccgacgttttcccggcctctggcctgcagtctgtggaggaggaagctggagcctgtgcttccgcccctcggaatccgggcgccgagcccccgaggacggcgtgcggccaatacacgggagcgcagctctctgcaggggggaccgagaattgtggaaattgccctgaccagattattatgcgaatggtgttgcctgtagactgaaaggttccatcggcaatacttaggaccttttgagttgtgtttactttgtgaacctcttcaggaaaaagcggggttagtgacagttgtgctctgagataccgtcagatgattgaagagtttgagagaaacaggggtggatatgcatcaatcaatggtctctccgtgtgttaatgattgaacccctttaggggagaccgaggtttttgacgacacttgcagaaattggtgcgggatcaccggacccagaagatggattgagaacctaaaaaggaagatgggtttgcaattggttcccaagggaaatttcaaactctcaaagaggttaggtaacgggagttgtgaacgaggggtggacagggcccaagtggcggataaatgaaatctgaagaaattgggctgccataaggggagcctagagagtggggcacagtggttctaccaaacagatgggttgcaagaggggaacacttttttgtgtttttggtggcaccacagaagagagagacgaaaaaaaaaaagtagggtcaaagggaagggtagtcgggattaaagtttagaaagacgggggtttaaattcgggggagagtatattgtcaccggagagagcactgtga

SEQ ID NO: 562253 - DNA, 681 bp, Homo sapiens
gggggcttgtaaggtgtctggataataaatgatttaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaacttgtggcccccttggcccaagccacctttaaactcaaccaagttaatccatgcgccccaatttcaacctaattggcccaattccccctatggggagccgtataaaaatcaactgcccgcggtttaacaacgcggaaactggaaaaaccctggctttcccaaactaaatcgctttgaacaaaatccccttttcccaattggcctaaataccaaaaagcccccaaccatccgcctttccaaacatttgcccaccctaattgccaaaggaaatttgaaaccgtaaatatttggtaaaaatccccgtaaaattttggtaaaaccacctaatttttaacccattagcccaaaatcggaaaaaccccttataattaaaaaaatttccccgaaaaaggcttaagtgttgccccagtttgaaccacgatccccctttaaaaacacgggacctcaaccgtaaaaggccaaaaaaccgtttatcaggccaagggcccattacggaacccatcccccaaaccaaattttttgggcccaggcccccgcccttcgcct

SEQ ID NO: 562254 - DNA, 201 bp, Homo sapiens
ctaaagatgaacgatggtgaagaaatcttaaggtgtacatatcactgaatcggaatgggctgctctttgaaataatacgtatgtctagcaatcttatcaacttaacattacttaaaacaatgtctctattcagtctgttacaaacacacttttttcttatcccacataagtactgcctaggaaaattcactcattcacatg

SEQ ID NO: 562255 - DNA, 914 bp, Homo sapiens
  misc_feature (330)..(330): n is a, c, g, or t
agcggtctgtcgcatggtggcccacgtggtgcacgtaaaacagggtgaggagagcggggtcgggtccaccagtggaggaggctgtgcgctgcacagcctgtgaggcagctttgacgtgtctgagacttggcgtgcgatcatcttgactcctatacccctggcagatagccatgtcccaatttgtctcgtggggtctccgatgagtgtgtagcctactgcatctgggtcgagctctcgttggggacagctgggtggtggttacacggtggacctctgcctggctcccccttggtgcatctctctgctcgtctcgatcgaccctagtctggnggttcacctcgatccaacttgaagagagcaccttagagtgaggccaaggacgtcagacaggcaagggacgcctgggtctaggctaacgtggggtgtgtgcccagctctcctccctgaccctaaaaactcctgtactgcccagaccaacagacgagagctggtccctgatgaccccggagacgaacgcagctgacgaaatgctgcaggctttccgcacttctgagaccggtgatcttcgctcctgccagggggacgagccacgccagcaggccatgtgcaggccctacttccgctcagacccctaggggcgttccttctggccgccgtctgaggattcctcgtagggctgtcccgcatgaggggcgttccccaagtctctgtggtagaatgcctggaatgtggcaagagtgacgaaagtcgagacgggaaacacggacaaggttgctaggcccgggctcctgagggcaacaacttcacagactctgggtgttcccccatcatcgcctgaacaagtgtgaggctcctgttaccgactaacaaaatggccttgggattcattgggggaggggaagtttccccaccat

SEQ ID NO: 562256 - DNA, 157 bp, Homo sapiens
ggagacggggttcagggttgaaatccccacattccaggcaggggctctttctgggttccttccctagaagggctggtccccggcccttccagtactatctcaccagggagaccctcccactcccccacccggctccacagggtaccggagctcgaat

SEQ ID NO: 562257 - DNA, 1192 bp, Homo sapiens
  misc_feature (620)..(620): n is a, c, g, or t
  misc_feature (699)..(699): n is a, c, g, or t
gctgatatataatcttctaaagcgatggaacataccccccagaataacgattacagttgttggggttggcgctgctagtgggcatggcctgtgcctctcacgatactcattaaatgagaaggactagtgcggatgatactctgactcttgcggtgagtggtcgaatcgacagcatcggcagatctgcacaggggagcagactgaatggtatctctcaagcatgagcaggctctctatgtgcattagaaacaccagaagattgatcttctggtcatcaagaagctataccagtgtaacctagcttgaaagctctcgagactgggatcaattatccaacaggacttgaggagacaaccgatctatgctagatgacggtgaggtagagaagtcgctgttacatatgaaactatatcgagatgcccacgccaggtaataatcagatagcagagcgacttcgtttgtaaaagaatatgccattgctaatttgcacctaatattgtgacttggttgaggacaccataagcgatgccacaccgaacacctggccaattaggctgtggccctttggaatttggctatggtacgaaaaggtacacgaggctagtgaatattatttcctntagcaatgccgtcatcgccttgggaactttttgcgcaaatgcactaaaaggtggagttgtttgcccccaaaaaaaaaanccctgtgtggggtatatctatggcataagattgcgtggatgcctcacaatcgttgtgacaccttcaaagtccccctgaaatttcctgctatattcctatgtaatagcggagcgtgaaacaatagggaccctgcggcgacgcatttccaacccccaaagattttaaaaggccattgtgccaattagggtgtacgggcgttcccctattcgggcggggaaaagcaattggtgcacaggaattttaccccaaatggtagttagggcccctttggagtagaattgccggcagaaggtgggggaaaaactcggaaatagttggcgtctcgcatatcgggcgcggtttccgtaccttcctttgagaaaaggaaaccgttcgatgtgcatagccccaccaaggaagttttcttcaacggggggaaccttggaacctaaaacaaatggaatttaaacggggaacacccagggtgggaaaaacacgcaaggaggttttccag

SEQ ID NO: 562258 - DNA, 215 bp, Homo sapiens
gtctctagcaggatccccttcatttaggcaatttcactatgtgccattaaagtattcgttggatttatccagactatgttaaaaaccatcatcacagcttgctataaatcaatagctgggtttaattgactttggtcgtggcttcccagggatttcccatgtcattaagtccatatctgaaagttaaaagttctgtctacctatcataagctgca

SEQ ID NO: 562259 - DNA, 261 bp, Homo sapiens
gcagcccaggtttctgtcttgaatccagctaacatcaagattgcagtcaatggctgggcgctgtggttcatgcctgtgatcccagtactttggaaggccgaggtgagaggatcacctgaggtcaggagttcgagaccagcctgaccaacatggcaaaactccatctctactaaaaatacaaaaaaaaaaattttagccaggcattgtttgcacttgccactaggcttgccactagggaggctgaggcacaagattcatttg

SEQ ID NO: 562260 - DNA, 93 bp, Homo sapiens
ttgtctgtggagacggaattacacccttttcccactgctaaaaggtcaaggccttctttggctgatccattctgcctttgtggctgctgcccc

SEQ ID NO: 562261 - DNA, 564 bp, Homo sapiens
gagctgggcagcacgatcgctgccagtgtggtagctgcgcctgcatgaaggggagagcgatctgaaccggctgcgcagccggatccgtcaggatctcagccacttcgagggcaacgcccaggcgatccgcatggtgtacagcctgctgaagctcaacctgacctacgcgcaggtcggctgcattttgaaatacacccgcccggcctactgggcgagcgacatccccgccagccacagctatctgatgaaaaagcccggctactatctggcggaagaggctttcgtcgatcggctgcggcgcgagctgcacatgggcgagttcgatcgtttcccgctgacctacatcatggaggccgccgacgatatctcgtactgcgtggccgatctggaagacgcggtggagaagagcattttcaccgtcgagcagctgtatcagcacctgattcaggagtggggcgaagtggcgccgggcgatctgttcgacaagaccgtcgccagcgcgtttcgcaagatcgatcggggcggcgcgcggcgcagcgcggaagatcagttcttcatgtatct

SEQ ID NO: 562262 - DNA, 159 bp, Homo sapiens
ggggggtgaggcagaatcggaattggtttgggacatggtaagttggtgatgcctctaaccattaagtggagatacaaaataagcagttggttatatgagtctggaattgaaatgacgaggcctgtagctgaagaatattataatgcatatagtgtagta

SEQ ID NO: 562263 - DNA, 229 bp, Homo sapiens
ctctgttgcccaggctggagtgcagtggcgtgatctcggccaccgcaagctctgctcccgggtccacaccattctcctgcctcagctactcaggaggctgaggtgggaagatcacatgagcctgggaggtcgaggctgtagtgagctgttatcatgccactgtactctatctagcctgggcaacagaggctagagcaactctgtctcaaaaataaaataaaataaaata

SEQ ID NO: 562264 - DNA, 150 bp, Homo sapiens
gcagggtgaccgcggtccctgtgtcagctgccgacgcactgaggagatgaccgaagtcgaagaaggagttggagtagtggcgaagataatgacgcagccgcagaggagcgaggacatgcgacagtgaggaggacggagaggatgtgttcg

SEQ ID NO: 562265 - DNA, 1204 bp, Homo sapiens
tctgagcaccgttcttccaccactgattaacagtggggtggcaggtattagggataatattcatttagtccttctgagctttctgggcagcactacggtgacctcgccagctccacgcagccttactcgctaccactgccttcgactgacacccaccgccaactgctctgctcctcatactcacgaaccagcaaagcgacccaacaggctgcgatagctcctgacacagcctctcaaccacaccatggcgccttgccacggaaccaatactcaacctaactggccacgccatcacccagaacctctcaacgcacacttctacgcgcgccactccttccagacctcactctccacccagacaccggcgcactcaactcgttctctcctatcagtcctctagtccaacacccttgctactgacacactgctgcacgtccgctgtctgcgccatactcccacactaccagcggcgcccactaacgccagtgccgcctctactctctggccccctggcaactgcggtatcccacggcacctacactccgacccctgacgcccagcctgcaaaagcccacacgcccatagccctctcgcgacctctgcgcctgcgcgcctccacctaccttccacagccccagggatcaaacccaacgccccagaaccgccgtatgccccaaccgccacccgaacacgcgacaccggccaccacacataatcccccaaggccacgacccccacctcgcctaccgcaacacaacatgcaacccctcccacgacaccaacgcgcggcaaccgccccagcccgcgacctccaccatcccgactcgcaaacgacgacgacacccacacaacacacggccgaaaacccccacaatgaccggacgcaaaaccagagacacccaaacgaccagaacccactccccaacccaacccatccccacagcacctggctatcaaccgcaaacaccccgcctcccaaacccgcgccccactctacacccaaacggggccacaacacacacagcaccacgccaccacccacccaccgacacagacggcacacaccccccaggacacagcctcgagacacctacaaaccatcagtgcgcatggctcgcacgcatctaaaccctcaacgacacaacaagcaggcaagccgccgaggccccactaaccccgggcacccccacccgcaaacccccca

SEQ ID NO: 562266 - DNA, 398 bp, Homo sapiens
  misc_feature (1)..(1): n is a, c, g, or t
naacctgcgggataacaaaaagtggctcagtctcagcagaatgagacccaggcaggctggccccagagtccatgttctagacattgtgttcttcttgcctgctggtcaaagaagaaaaaaatcttttatgtaaccttgtatataaatgtatcttcaattttactcagtcactgccctacctattatatttatcttcctccaactcataaggcaaaaataatcctattttcatatatctagctcaactgcaacttttatgccctataaattaacattttccaccagccaatatatttataacaaaaatttttaagacataggggtgttcaccatgttgcccaaactggttctcgaactcctgctctcaggtaatctgcccacctcggcctctcaaagtg

SEQ ID NO: 562267 - DNA, 224 bp, Homo sapiens
  misc_feature (36)..(36): n is a, c, g, or t
ggagcttatgtcatcccccttcgtccacaacacggntaggcaggtgtgctcagggggtctgaggctttcacggatgttaaatgtatgtccagaaaagagtcctctcctcagagttcactaccctcggtttcacagctgtgccaaagtttaaaatcaggacggatttccttcccccgctgtgtagaaacgcctggtgttctttaaatgtgagatgtcgtttctac

SEQ ID NO: 562268 - DNA, 470 bp, Homo sapiens
  misc_feature (48)..(48): n is a, c, g, or t
  misc_feature (52)..(52): n is a, c, g, or t
ccggaatctgccgcatctcttgtctatcgcctccatcctacgatcacntacngcgggtcacgtcctccttacctcaatcattggccccatggtctgaactacggtacacgatacggcggattatcttcaactcctacatattcccccttattcctagaaccaggcgactgcgactccttgacgttgacaatcgagtagtactcccgattgaagcccccttcgtataatattacatcacagacgtcttgcactcatgagctgtccccacattaggcttaaaaacagatgcattcccggacgtctaaaccaaaccactttcaccctacacgaccgggggtatactacggtcatgctctgaaatctgtggagcaaaccacagtttcatgccctcgtcctagaattaattcccctaaaatctttgaaatagggcccgtatttaccctatagcacccctctacccctctagagcc

SEQ ID NO: 562269 - DNA, 481 bp, Homo sapiens
tgggttgggggggaaaggggggaaagggagggggttgggaacttcctttaaagggggggggggggggcagaaacgtcgcccccaggggaggtgtatcaagtagaacccaagcgcgaacgcggggtagcagccggccgcacttccacaaacacgcgggcgcacaaacagacgagcgctgggggcacacacatcggtgcgctcgtcacagtcacgcgacacacaaggggcctcaacatagtgggtggtcccagaagcaaaacatggtctgcgggcgagagcgggcggcaccgtacagataagacacatgagctggggatacccgcgcgtaacacaaaacacactgagggagccgcgacggcccccgccgcagcaccatccgcctggttttgcaaaccccccagacctaagtcgcggcacccccccgctccgcaccgccgcagcggcctcccgcacgtgccccgccacccagcggcaaaccgcc

SEQ ID NO: 562270 - DNA, 139 bp, Homo sapiens
gagtatgcacggccctcagtgctgataagtctactcaatgggtcactcatatcctattcatctgtatcttaaatggcccaggcatcttgcctctggaaactattgagcttgcatgtacttgaaggatggatgagtcaga

SEQ ID NO: 562271 - DNA, 1459 bp, Homo sapiens
ttttttattttatcaagattaacctggtttaaatgcagtctgctataaaaatgaaaacttctgcatggtatattgggtctttccaaccgtttacgtgccatagttaagtgctgtgagtgttcatctgtggtacacattcatttacaactcgtgtgggccagataacagcttttgtgcaacagtgggtttaatacataaaattgtggtgaattcagtggacactttaatcttacagccacaccacacacgacatattctacacggccaaatcttaaataacactaatattctaataatatacacctaacagctgggggttatatgtgggatccctatgtggacacagaattggtgggctttatattctattctccacaagcgtgtattaggccaaacctcagcaacaaaaatatacacaacatttttctattaccacacccctctcttctacccccctcttcttagaagaaacacaacaacacaacaacaacaacaaccacacacacacaaaaacaacaacacaaacacaaaaaaacaacacacaacaacaaaaacaaagagagagaggcgcgcgcacaaaccaatacaagatataatccagcgagagagaggaaccaccaaaaacaaaaacgaggagacacacaaaaaaaatagagagagaaaaaaaaaagagggagtaacaaaaatagaggagagagaacgaagtgataaaaaagaaaatcacgaacagcgagagacccaaacaaaaccaaaacaggagaggaaaaacaacacgagcaaacaacaaaacgacaaaacaagaacagaaacaaaaacctagaaacgaaagaaaaaacaaacacaaaacaaacaaaaagggcggaaggaagaaaaaaaccagctaaagagaaaacacaaccacacaactaaaaaggaagaaacacaaaggacacacaacaacaccacaccacaaccacacaaacccacaccacacagaaagacaacaagagagggagacaaagccaagaaaaacagaaagaacgcataacgaagacgaagaaaaaaaaaacaagtacaacacaacaaacgaagacaagagaagaaacaagagaaacaacaacaaaacaaaaggcaacacaaacaaaacaaacaaaaaaaacagcaagaagaaaagaaacgagacaacgggaaaagaaaaggaagcgaggagaggaagaaaaaggaagagcaaagaagacaagaagagaaagaggaaagaaaaaaagagacagaagaaagaaagaagaaggcagagaacgagacgagagagggaaaagagagagagaagaagcgaagagacggacgaacacacgagcagagagagagaggaaggaaaggaaggcaacaggagaagagcaagagaaagaaaagaagaacagaagaaaagaagaagacaaacaagcaacaacacagacgacgcagacacgagaggagcgagaag

SEQ ID NO: 562272 - DNA, 437 bp, Homo sapiens
gatatagtagtagtagtagtagtagtagatatatatatagagagagagagatagagagagcacagatatagatattatctgcgtctcttagatataccaattgctacctatcgctttctaccatcctcttcttccctcttggtttcacttgactttttgttattcctggtctctttttatctttctgatctctctgtctcctgggttccattttttaaatgtttaccactatgttgacctgttccttcccttcttctccactgacttgcggatgatgccttccattactgtcgatggtatttacagtccattcgtcacgcatgtctggctaagtagtctcgcgtatgctgttgcgctattgactgtatacgtacatggctgtgtctgctatgttgctctgtctggtccgagcttcttctgctacgtcatgtccatct

SEQ ID NO: 562273 - DNA, 377 bp, Homo sapiens
cagaaaaatccagatacctcaacaacaaaaatacagctcaacatggaactgcattaaaatcccagactctctcattttcgatgaccattccttatacccctcaaaaggtgtcccacagaagctctttcacaaactgcattcattcagaatgtcttctcccccactctcccccaaacagccaagtcatgccatggcacagtgcgatgcatttatcaaccgttcaagcacaatgtcatttcttggatacccattcaatcatcaccacattcatcaatcattacatcattaacatcacacacatatgtcatcatccacacaagtcatccaacatagcagtcatcacaccgtcaacacaagattttcagcaccagcatcat

SEQ ID NO: 562274 - DNA, 665 bp, Homo sapiens
  misc_feature (11)..(11): n is a, c, g, or t
  misc_feature (103)..(103): n is a, c, g, or t
  misc_feature (142)..(142): n is a, c, g, or t
  misc_feature (144)..(145): n is a, c, g, or t
  misc_feature (157)..(157): n is a, c, g, or t
  misc_feature (170)..(170): n is a, c, g, or t
  misc_feature (213)..(213): n is a, c, g, or t
  misc_feature (220)..(222): n is a, c, g, or t
  misc_feature (239)..(240): n is a, c, g, or t
  misc_feature (268)..(268): n is a, c, g, or t
  misc_feature (270)..(270): n is a, c, g, or t
  misc_feature (287)..(287): n is a, c, g, or t
  misc_feature (295)..(295): n is a, c, g, or t
  misc_feature (306)..(307): n is a, c, g, or t
  misc_feature (320)..(320): n is a, c, g, or t
  misc_feature (331)..(332): n is a, c, g, or t
  misc_feature (334)..(334): n is a, c, g, or t
  misc_feature (340)..(340): n is a, c, g, or t
  misc_feature (347)..(347): n is a, c, g, or t
  misc_feature (350)..(350): n is a, c, g, or t
  misc_feature (356)..(356): n is a, c, g, or t
  misc_feature (367)..(367): n is a, c, g, or t
  misc_feature (371)..(371): n is a, c, g, or t
  misc_feature (403)..(403): n is a, c, g, or t
  misc_feature (408)..(408): n is a, c, g, or t
  misc_feature (575)..(575): n is a, c, g, or t
  misc_feature (587)..(587): n is a, c, g, or t
  misc_feature (661)..(661): n is a, c, g, or t
attttctaacnttaatttatttaaagatatagaggttatggatatagataagtatgcccgactatgatccttaattcagcaatctaatattcacaatgtgttngttgccatttagctatttatcccaacatgcccttaaaangnncaccaaaaaacngcatgtgcctagncagggtggaaaaagaaacaccaaggccttgctaaaaaggagangcctaannnagataaaattcccacgnntgttctgttcaactgtcgcctgtgagtncnggaataatgttcccgtngggaagcnttatgcccagnngtttcttggtgtnaacgtgggaanncncttgangttttcngtngctgtnaggggggagcncganaactgtttatggaatccagtcgatgttcaggnaccgngcgatgaacgcaaacatgtctgagacttcctctatcactttggctgtgggcttccccgccccgtggcccgccttggtgtccacgtggataagcagggggttgctttgcttcctgctgcggcccacgatgtactgaagggtggcaatgaacttcagggagtgaagggngaccacgcggtnataatggtcagcagtgaggagcagcatggacgggtactggatgtcatctgcttctggtaacttcacattatgcnatgg

SEQ ID NO: 562275 - DNA, 291 bp, Homo sapiens
  misc_feature (35)..(35): n is a, c, g, or t
  misc_feature (50)..(50): n is a, c, g, or t
  misc_feature (121)..(121): n is a, c, g, or t
  misc_feature (131)..(131): n is a, c, g, or t
  misc_feature (151)..(151): n is a, c, g, or t
  misc_feature (163)..(163): n is a, c, g, or t
  misc_feature (197)..(197): n is a, c, g, or t
  misc_feature (268)..(268): n is a, c, g, or t
tcatgtctaagaacggggaccagcatccatcagcnatcctctttgtgaanatctccctccaggactaggctggaggaagccaagtggggtcccccctgaagtggctgggccctctgtccanatgtgggganagggctggtgtgctgctccnagcctcttgctnagagctaggcccccaaattgccttcagccctaanatagtgtctgctgctgcctccctggggcccaggagctagcccagtccctggagctgtccttcattccgttnggaataacactgcagccctctcc

SEQ ID NO: 562276 - DNA, 718 bp, Homo sapiens
  misc_feature (697)..(697): n is a, c, g, or t
tggctgtaacagtgttttttgatgatgattccaggcccctgctgaacccctggtggggaggggcacaaagcgaaatggggcgtaatggaatgtcttgaaggtctgccccgtgatgtcggtcggagtttccagactaggcgagggcagggttgaggccttcgggcacacagccggcgcccagttcacccggcccagatggagggcggccgggccctgcgcaggcactttgccaaggttggcctcacactcacgcacactcgcaccgagacctcaaggccgttcttccacaacctccacccaggtgcaaattgacttaggtgcaaatttaaatttcagaagggacgggggaaacagagctcggtggaggcttttgaattcttctcagaaaaaaaggaaagacaggaaagcctcagaaacaaagagacagaaggattgaaaaaaaaaaaaagggaggtggtgggaacggcgttcattcccgctggaggagcctcagcttcgtgggatgatgtggtggctggtggatcaaccgatccgccgcaggggttggcctgtgaaatggattccccggtgcggggtgggtgctgcgggcgctgtgtcccgatggtgtcctagatgtagggctgataggtctgggtccccctcgcttacctttaaaaggcagatcctgactcaggtaggcgtggttgtagtgggcttntcttcccatgggtccttggac

SEQ ID NO: 562277 - DNA, 527 bp, Homo sapiens
aaatggtcccttcccttgtagtttctggcaagaggctttaggaagataaaagtttaggagacccccccggaattctgaattaagcccagagttgaagtttaaacccgtttcacaggctttcaagaatgtcgcaattactaagaagcagataatggtgttttttagaaccccaattgaagtaaattccccccaaacctttaagggataaaataaaaattaaccaaaaaacttggaaagcagtttttgcttcccatttgattttttcaaatttaatatttaaattagagatccaaaaagggataaaaatgtattttggcaaatttgttccttaaaaaaaaaaagccccgttttctttggaagtttgtttaaatgccaaaaggggaaatgaattcaaaaaaatttaagccgcaaaaatgtatttgctataaaatgagaagtttccctgaaaaaggttttttattgctcattttttaaaaaaaggactcttgaaatctgttaaaaaaaaattggacatttggagatgttta

SEQ ID NO: 562278 - DNA, 163 bp, Homo sapiens
tgaatggctggaaaattatccatagagatgtcgttccgcttccccccatgtactgtaggaggcttcctgcctttcagtgccatctctcgtggagcgtgtactacatctgtgccacagtatggggtcgggagcagtacacttggtacggcatcctcttcttttc

SEQ ID NO: 562279 - DNA, 180 bp, Homo sapiens
  misc_feature (78)..(78): n is a, c, g, or t
  misc_feature (119)..(119): n is a, c, g, or t
tgccagtgtctgtctgcagattgggctacccaaactgtttgatcagtaccccccattctatatcaacggggtacaaancgagttctggccttgtctgtggagacggattacacctttcncactgctgaaaaggtcaaggccttcttggctgatccattctgcctttgtggctgctgcccc

SEQ ID NO: 562280 - DNA, 247 bp, Homo sapiens
catggaggatactagtcatgccaggacacgtacggggctgactaccagaaagcgctgctgtaccgtgatgtggttgtgagatgactgaagcccgacacggccgtgagcgtccagaaatggtgctcaccatgcttccagctaccaggtctggacaaccagcttgcgaataccagtccccgtggccatccctgatgagggtgacgttagcattacccccaacctcattttagttgccgaagctagatca

SEQ ID NO: 562281 - DNA, 109 bp, Homo sapiens
ttatttcataagatgtttagagacaggcaatggctggtataggagcatcagctcaacaatgtggcaactggcatctccgcagttctcttggcccttctgtcgtcttctc

SEQ ID NO: 562282 - DNA, 697 bp, Homo sapiens
caccactccctaatctcaagtacccaggacacaaacactgcggaaggccgcagagtcctcgtgcctaggaaaaccagagacctttgttcacttgtttatctgctgaccctccctccactattgtcctatgaccctgccaaatccccctctgtgagaaacacccaagaatgactcaactaaaaaaaaaaaaaacaacaagaaaagacggcgggtgttgcacctgggaacgtgatgtgcccctgtgaagcccagggaatgtgccgcacattggccggcccaccacccaaaaccgggaaaagggccaggaagggattctctcccttagaaacctttcaaaggcagccaaagccctgtgccaacaccgtggatttcagaactcgtggccctccagaaacgtggtgcagaaggatgacatccgggggtattcagccaccccgaagcttaggaaagtgggtgcagcacaacggggaataagagaggcagccagtcagcctccggggaattcccagggcagcttgcaaggagccacagtggggcccggggctctgaaaaggtctgaggcccaagcaaggcgcaaggggcctaaaactatttctcacccagggcagcgcaaggaaggttcaatcccagaaacgtagatcccctttccatcattctcacaacctccacaagggttccacaagacaagatgtatgaa

SEQ ID NO: 562283 - DNA, 391 bp, Homo sapiens
gtaccattgactactcttaagatctcacgagcgctgctcagttcaccccacggcgagcgggaatcgtgcgtgacacttaggagaaggtgtgctacgttgccctggacttcctgcgcaagagacttgcacggctgcttcccaagctctccctgtgagaagagctacgagcttgctgtacggccaggtcatcaccattggccatgagcggttccgctggcctgaagagactcttccagacttcctgggctgggcatggagtcctgtggcatacacgaaactaccttcaaatccatcatgaaggtgttgacgtggacactccgaaaagaactgtacgccaacacaagtgctgtctggcggcaccaccatataccccgggctgtcaatgggtccc

SEQ ID NO: 562284 - DNA, 215 bp, Homo sapiens
gggttgccctgcaagctgtttccgcgcgtactgtcccgttctgttccccgcggggtcgtcggcccgaccacagaccgcgccaattaccacccagccagatagaacctccaagggccccggggccgtgggggccttccgcctccgtggggcggcaaaggacttcgagcagcctctctgccattttcccgggtcactcctgggaagcaaggcggctc

SEQ ID NO: 562285 - DNA, 201 bp, Homo sapiens
aaggtcccgcagatgaggctgccagcccttctctgcttcccctccagcacagggaccaagtggggagcctgcagaacctgtcaggcacagtggctcctcaagcctgcctgtcctgcagagtcccatggcatggagcttacacctgactgactggagcccctcccgactccacttcagagctaggaccaccaatactgaaga

SEQ ID NO: 562286 - DNA, 578 bp, Homo sapiens
ttgtccccaggtacatcatcctggtagttgtttctcctttcctctgtggattctctctttcctcataccggtccctgtgttcttcagcctctcagtgctcctcccgtcctcagtgcttgttgtcctctgcccatcccccagttcatacgattcggagtgtatctttgcgcgaggtccacggtgtgggcggactgcagcaacggctcatgggctgtcgagatcagcctggccgacatggtgtaaaccccatctctacctataagattacgaaataaattagtcagggcatgagtggtcgcgctcgcctatagtttcctagctactgaggaggctgaggcaggagaatcgcttgaacccagaaggcggagtgttgtcagtgagctgagatcgcaccactgcacatctcagcctggtgacagagcgtgactccatctcaaacaaccaataaaagttgatgctgacatgacacgccacattgtttatcatttattttcccggtctgtctcccaccacataaactcccgttcttgatttgtctccccagtgggacatatttcatacccgggtagaaagtttca

SEQ ID NO: 562287 - DNA, 369 bp, Homo sapiens
tggccctatacttcactatacattcccatcctgtaccttgactaggaatatagttaagtgctgctcccgatacaattcagttagctcttgtgtttgtatatggtccaacccctgctttactgctcatgctgcttaaagcaggagggactagagaaacaagccattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataattgaacacttagtgacatttaaacttctgcctttttttcctgactttaaatctagattcgc

SEQ ID NO: 562288 - DNA, 912 bp, Homo sapiens
  misc_feature (618)..(618): n is a, c, g, or t
  misc_feature (620)..(620): n is a, c, g, or t
gatggagagggcccaaagcaactgccatttatggacatttcagtggctgcggaacagataaaggcttacttactccaatcataaaagatgctgctgctaaaggtatccaggaaattgctgactctgtaagggctctatcaaagaaagcaagagatggaaaatgtgttgcctgaagaataccaaggaggatgttttagtatttccaactgtggggatgttagacatcgaggaatttactgcagtgattaaccctctctcaggcctgcattttgctggttgggaggtgccagacctgtgctgaagctctactgaggatgaggagggaaatgccaaaactgcagcagaggccaggttgataacagtcacaaatgtcaagtgacagtcgaggtggttgatgacgagatggacaaccaggttgcttaaaagttgtaagagcaaaactagagaatcgtatcgcgagttgggctagtcctcaaagataagaagtgggtgtacagctatagtgattcagtagttgtaaccaggaaacatatgttatgggaaaacaagtatggtatataagtatgaacggggatgaaatggttgattgatttaaggtgaaagcattttgacccaggngntgtcttcattcttgcaatgtggggtttcataatttcatggaattaagtgatgataagtcgaataaataaggggaaagaagaatattggggtccctccgatcactgttactgttggggggtataaggggaaattaatagattggacacagagatattgtggacttcgagctttggagttttggactgttttaactgtcttaaactttgaaggcagtttttgaggagagaggtaaaaggcgaaaaggggcattaacggtaattgaaaaatagagggggaacaacagcgggagaa

SEQ ID NO: 562289 - DNA, 280 bp, Homo sapiens
agtagctaaagtcaaaaatatgtctatatgagtatagctaccctactctttattcactattatctgcatggaatatctatgtccatcttttggctgtcagtctgtgtgtgtcttaaatctaaggtgtacacgtgataaaattggagcttatttttttatttattcattcagccactcagtgtgtctttgatttgggagtaaaatccatttacttttaacgtaattactaataggacaggacttatattgctattttagttgaatattttctctccgtgtt

SEQ ID NO: 562290 - DNA, 854 bp, Homo sapiens
  misc_feature (13)..(13): n is a, c, g, or t
  misc_feature (106)..(106): n is a, c, g, or t
  misc_feature (123)..(123): n is a, c, g, or t
  misc_feature (128)..(128): n is a, c, g, or t
  misc_feature (146)..(147): n is a, c, g, or t
  misc_feature (153)..(154): n is a, c, g, or t
  misc_feature (160)..(160): n is a, c, g, or t
  misc_feature (170)..(170): n is a, c, g, or t
  misc_feature (182)..(183): n is a, c, g, or t
  misc_feature (190)..(190): n is a, c, g, or t
  misc_feature (209)..(209): n is a, c, g, or t
  misc_feature (220)..(221): n is a, c, g, or t
  misc_feature (223)..(223): n is a, c, g, or t
  misc_feature (226)..(226): n is a, c, g, or t
  misc_feature (231)..(231): n is a, c, g, or t
  misc_feature (240)..(240): n is a, c, g, or t
  misc_feature (293)..(293): n is a, c, g, or t
  misc_feature (300)..(300): n is a, c, g, or t
  misc_feature (306)..(306): n is a, c, g, or t
  misc_feature (309)..(310): n is a, c, g, or t
  misc_feature (312)..(312): n is a, c, g, or t
  misc_feature (315)..(315): n is a, c, g, or t
  misc_feature (325)..(325): n is a, c, g, or t
  misc_feature (331)..(331): n is a, c, g, or t
  misc_feature (361)..(361): n is a, c, g, or t
  misc_feature (364)..(364): n is a, c, g, or t
  misc_feature (366)..(366): n is a, c, g, or t
  misc_feature (371)..(382): n is a, c, g, or t
  misc_feature (384)..(384): n is a, c, g, or t
  misc_feature (386)..(386): n is a, c, g, or t
  misc_feature (388)..(388): n is a, c, g, or t
  misc_feature (406)..(406): n is a, c, g, or t
  misc_feature (410)..(410): n is a, c, g, or t
  misc_feature (416)..(416): n is a, c, g, or t
  misc_feature (418)..(418): n is a, c, g, or t
  misc_feature (735)..(735): n is a, c, g, or t
  misc_feature (784)..(784): n is a, c, g, or t
  misc_feature (837)..(837): n is a, c, g, or t
gcattgttttttncgggacacctgagtctgtatcggtcggggacaggttccaattggtagaggcctacagatcgatctcagagtcgggttagtcgtcgcattgccnggattcttcttttttgnaacanccgccctttgccctgagnncccttnntctttnttgctttttntttacccctttnnatggttnttttttctctgggcatccntctttttctanngnaanttggncatgggcgnctacaccagggggaggccagtcgtggttccctgctttccacccgggctccacnggcccgnagcccnccnntnctncttcttcccnttgttnggtggggccacatgattgggcgccagggtnttngntgttnnnnnnnnnnnngntncnaacacagccatgtttcantaangcgttnancttcttccctggtgtcccaacctaccagtgccacgttacagcccagagtgagttctacaagcgttgctggcctaatggatgggctgggggaagggggtgggacaggggctggaggaggggctctggggtccatcacggcacaggaacaacacgcatggtgttggtgaagccggagccagggcgccatccggtcagcacaatgaccacatctcccttcttgaagaagcctcgggccttgccaacattcatggcaaagttcacccggaggtccacgtcctcagcccaggcctcctggactgggtccttgcacagcacanggaagatgccacggtacaggtgggcctgacgagctgtctgggggattcngggtcacagccatgatgggggcacgtgggcggtatctggccactggtgagcanactgccatattggtgag

SEQ ID NO: 562291 - DNA, 1156 bp, Homo sapiens
cagcttggaacgagatgctatactaataagcaagtgtaaaaaaaaaaaaaaaaggaggaaagaaaatcttaaggtggattggatggctggttttcttttaaaaaaaaaaaattaaaatccattttcttgggggttaagaggctagagaggaagggcgcccaaggccttctatgggtgttcttctaattctttatggggtataaaggtattgaggtattggtgcatttacccggggcattcgtggtgtaaccgttggggtaatttaaaatgggggtaagtacggggtataccctaagttaacttcattgggattggtggtaaagggagatatttggaggttaacatcttcatattaagtggtgttcatataatctgtggggttacaaaggcttccaaaaatatgtgggggaccaatattgtgtggtaatgtggccaggtggttgacacttaagccatttgtggggttacacaacccaaggcctttgggattacacttagaagggtgggaaaaccaaagagggtggtcaagtataccctcggggtcacgaggaaatcgtggggccgagataagaaacacctctcgtttaagaaactcctaggggggggtgggaccacccttaaatgtttatatttaagacacagggtggcgaggggattgaccttattttgtcaacagaggtgtcccaacgcaatttggggttatcaagaaaatatgtctggggaacagaaccggggtatctgggtacacaaaccattacagggggggaattaggccactagataggatattgtggagaggatcagtgtggagacactttttaaacgggggggaaaagtttagagaaacatagattttgggtggacaacaaagatagtgcccattgaaactttttcaaagaaagttgattagaagccacacagtttctaccacaaatgaaccccctcaagggggcataacttcaaccgggagaaaaactagcgggggagatagaacacaccttatatcatggaacacgcagtagaagcggcagacaaaaactgcggagcctcggggcccccacaaaacggacagggcgtctaaaaaagccccgggcggcccggacgacacgaacccacaccatgagcacaggcatcccgcacgaagggagtgagacca

SEQ ID NO: 562292 - DNA, 331 bp, Homo sapiens
gactactagagctacgctaagcaactgtaatgccctaaatgttcgcagccaggaaggcactgcagagctccagaggtggggcttggtggcctcaggctgggctgacctattggacgccagtcacttccttgggctcagagagcagagagtgtgtgtgtgtgtgtgtacataaggagagccttggttcctagggcccaggcatctgaattgtacttcggggctggccgtggggttgtggcgggctgtctgcaggacaccgtgcacctgtactcattaagctacacacatagcttcatccggatttataaacacacagaggcaggacaagcag

SEQ ID NO: 562293 - DNA, 728 bp, Homo sapiens
aatcctaatccccttattcctttattacgtgtatctcagtcagatgattctatttgatgtccatagtctcatgacttagtgagatagggctccaagctttcgtctgcctaatgtatttcactaatacccatttacttaccatctggtaccagtgagctggtagaacctatcttcttctgatcagtgtcctcagctagcttctacttcaggaactttataatgcgctggcttcccgtcaatcaataatagtaatatgtgtgtgtgtatatatctatatatatatatatgtgatatcatatgtgtgtgatactatgtaagtatatatacatatacatatatacgatatgtgtgtgtagtatatatatatatgtatatatatagagattcgtctagtgtcaagcgagcgtcatggtagctgacacgtttgatgctgctctgaggcaactgtgatatagttatctgcactacaataaggttgcaactataattgctccttaggtaaacgtagaggtagaactacgctgaagtcacacagaaaacaccaaaaaaacaaaagcgatcagcagatatgcacgggccggcacccaagcactcacgcaaaaccagccttcacaaaacaccacataatgatgaccagaacggagacagaaacaaaagaagatgccacaaccacggagcaacaacgagcaaaacagacggagtaccacccgagaaaaacaaacatagcc

SEQ ID NO: 562294 - DNA, 915 bp, Homo sapiens
gccgttcgaaactgctccgtaggggcgcgggctccgtgaggctccacctgctaagacccgtccccctgcggtcgctcccactggtcacagtttcgcgtctgagagtgatctgacagcttcgtattgcattgcagattgtggatgcagccgcattccccaatgcaaccccctgcgcgcttggtagggggtagaaaggtgacatgagagtgccgctgtgggtcggggcccccgtcactccattggggacggctagatctataccctatcaggagtcttgggtcgtgtatgtcccggagccggaagactccgtgagctaattgcccgatttccaagggtttaatgactatcgtccctgatcaaagtactgtcggtgttcaccgtgtagtaattcagtaatcggcaaggtgatcgcgccgcaattggaaggtgtggcctagcatctctccttggagcgaatgggaggaacactaagccttgaaaaaacaggccagatggcccaccaatgaacgggaaccgctcaaacaaagatgcctggtgcgttggaaccctgaaacgggtatggatggttgaagggaaggccaaggatcccttccggcttcgaggtggaaaagccacaaaatgcgcccaggagcgggtcccaagaatcgagacgttgaaacggtacgttctaaaggcccaagagaggccactccctgggctccaaggccgggaaaaacgctggccgcgtaacaattcctttccctggccagagacccgaattcctggaatggccttgaaaatccgagtgcggtatttataccttgaacctttgtgggctttggacttctgggcaactgactggctggttgccaacacatttgatacctcttggtaaccctcttgtgacacctacagcttgtaatggccgcccgtgat

SEQ ID NO: 562295 - DNA, 252 bp, Homo sapiens
  misc_feature (23)..(23): n is a, c, g, or t
tccctttttttttcccttggccnaaaaattaaaaaaagccttaccccccccccccccctggtttagaggccccctcatttttcctccttggggcagttaaggatccccgcccttcaaaaggacaacatcagctcagcaggaaccccggcccccccaggaccccgggtttacaatttccccggggttttttggggggggcttcccttggaaaggggcccctttttttaaaaaaaaagggttttcccgttttta

SEQ ID NO: 562296 - DNA, 1242 bp, Homo sapiens
  misc_feature (524)..(524): n is a, c, g, or t
gcggagagagctgaggaggctgcgtctggctcccggcctctcacagccatgcagtacattgagctccatagaaacagggccggggcaagtgagagccggacgggcactgggcggactctgtgcctctgctgaggaaaggatatacctaagacagtgagtgcaataggagatccttaatgaatgctcgagcaggtcagacacatgtcaatcactactgcattgtttctgtgcaatgttggtcgcggaggagcagtaagaagaagcacccagatgcttcaggatcaaccttctcagaatgttgtcgtgaagaacgctgcatcatgagaagcgttggcaaggaccagtgctctgtcgtaccacgagaaacacggaaaaaactatctgaccagactcatgggcgaggacagtcgtgacccaatggcgctcggtttagtgcacaaggaacgacaattgatcaaacacgtattagtcgcgcattcgcacgaaaaagcgtgggaaggcagcaacatgagaaggacaaggtntccaaaggcaagtctcccttaagtggcaatccgcaagaggaaagggacgcatcgcgtatcgggggggctttcattttcccgtcatctccttagcgtcatggaaggttagtccggcccaataaataacttcaacaagtggacgaatacattccatggcggagccttgatcgccatacttgcgatgaaattgtgtttgccgaacaagaaatgacctgaggaacgaagaagtggtggggaaagtaggccatctattgtcgtgaggcaacgttacatagacctacgccggacatggccccctgtccatgtgcagcatcacatggaaaaaagggccatggtttgcacacagcctatcgcagaagggcgacccaaagataggatagcggaaaaaaaaacggggtacctcattgaggcgtcgacgtttagtgccgaacgacctataaagggcgtgcccacggcaccttgggaagtggtcgaaagaccataaaaacccccacggggggggaagtttcccgactccggaaaaggggggccggggcacacggacccaaagggcgaaaagcaaaaaaccaagggacatctggcaaaggcaagggggactggcaaaaacggtaagggtgacctgcccgagccaaatgggccagcgcacagggcaatgttgagcgggagaaggaccacggggccagggaacggaaataagcaacaaccgggaacgacaggc

SEQ ID NO: 562297 - DNA, 165 bp, Homo sapiens
cgacattgggttacaatgcctcctgctctgaatattctgtagctgtagaggcatttgaatccctttgtcctccagcatcccttcactatcctcatcctctctaaccctcctttttctattttttaatgctacaggccctttagtccgggtaccggagctctcaat

SEQ ID NO: 562298 - DNA, 162 bp, Homo sapiens
  misc_feature (3)..(3): n is a, c, g, or t
agnacatactggctcccccttttttcaagtgccttaatagcaggacaaactgtagagtcaggagggcaggctagatgctcagccacaagacagcctttactgaaaaagctattggactcttgctctttctagctctgaactaataaatgtcttatcacgctg

SEQ ID NO: 562299 - DNA, 118 bp, Homo sapiens
tgtcagatccatccgggcgctcttccgacagggacttcggcagcttcgagcacattttgtcaaaagcgtcgagtatttctttctcagatcttgttgttgtcaatcgagcttgtgtcaa

SEQ ID NO: 562300 - DNA, 876 bp, Homo sapiens
gaccgccagcgtaggtgctaccaccgttgccgtctccgccgcattttgatggcaggaagagtacggttctgggacggctgtcacgacagtggtggtgactgaaatacatcctttatcaaaggagaacaccggctagttttgcgaactatcttctccagcggatagtggccagatgtgcttttgtaacgagatgccagcactgttgccatatctcccaggatttggctctttagttaagagtgttgtcgatatcccctaagagtcttcttcgatgctggatcatcaggttcgtatgagtctcatgtgggtgctgctcctccaggatatatgctctcgaacagtgtgccctgtatgataatctcatggggcacccggtttggtaccctcgaagatcacgaggttcctacgcgttgcctggctactccttaggtggcgcttgtcaccctcgactgggacctgttttcactgaagaaaaggcctggttcataaaattagcctgagtgttctagcagaagctttacttcaagtgagtcgacgtgaagttgtgaatgagctcaaatatgtgatgtgaagtttccagtggctcatgatgcacctggtggaacaaagcctattagcagtcgcagagagttgactggtggaaaagtgcccggagtacactgtgccattgacagacctgtccaggaatttgttgcggcaagtcttcgggagcactgtgtgccggaagtagtatggcaacctatgtgttctgggtgttctcaaccagtcagataggctgcctggttgggttgacaaagtccacttgggggagatggcttgagaatatatgggcagagaatggtccctccacccgggatgggccgtatgcccattggg

SEQ ID NO: 562301 - DNA, 727 bp, Homo sapiens
ccgcaggaggatgctggtggtggagtgtgtgcgaacggccgctccctgtgtgtggggagccgaggcgtgtgcagtgccctccgtggagcgcctgggtgtggggggcctgcacggtagtgctgccctgccccgcgggccccgccagaactcgctgcctggtgcctccctgctgctgctgatgccctgaagaggcgctggctcttgtgcctgagatctggctgccgtgactctggtcagctgccccgcgtccagactctcgtgcaccacagcctgtgccctgacatccttcaagcgccagcaagaggagagcttccagtgatgcagagctgccttgtgcatgctgagtgccctgggagacccgtcgtcatgtgaggtcctggagaagattacgtgaggtgccatggctgctaatgaagcagaaactagaacagtgcttcagggtgccagctcaatgccagtgaggcctggctcgagccagtgctgccaaagaggattgagaccagtgatggccaggcttcgggagagcaggaggaagctggcccctcgtcttcccaagcagtgaccctcaaatggggtagcccccttgcccagatctgctctccttgtccagctggccactgccaggcctcgaccggtcaaggccaggccctggactggcgtgtccagtctaaggatggcccaagcggcgcctgccagaactgggctaagtattacagagaactgtgga

SEQ ID NO: 562302 - DNA, 739 bp, Homo sapiens
cgaattcggccattatggccgtgaatgccccagctaaatactaccgtatggcccaccataattaccgccatactccttacactattcctcatgacccaactaacaatattacacacagactagcacctacctagctcaccagagcccatagacatacctgattataacacaccctgagaaccaatatgaacgtcggatcgctacattcattgcccgcgcaatcctaggcctaccagtcacagtactgatcatactatgtgcccctctattgatcgccacctccaaatatctcatgaacatccgactaatcaccacccaacattgactaatcagactaatctcaaatcagacgatagccatacacatcactaaaggacgaacctgaactcttatactagcatacttaatcatttagatcgacacagctagcctcgtcggactcctgcctcactcattgacaccaaccacccaactatctataaacctagccatggacatccccttatgagcgagcgcagtgattataggctatcgctctaagagtaataatgccctagcccactgcttaccacaaggcacacctacaccccttatcgccatactagttattatcgaaaccatcagactactcattcaacgcatagccctgggcgtacgcctaaccgctaacatactgcaggccacctactcatgcacctaattgtaagcgccaacctagcaatatccattccttcgctct

SEQ ID NO: 562303 - DNA, 747 bp, Homo sapiens
gagatttattgaaaatgaaagtacatttcacaatgtgggagtgggcccaagtgtaggggcttaagggccccgctacagaagttttgggagtttaaataccctctagaagattccattggttacttgggcgtatgccctatataagtgaagaggatgaagtaaagttataaactcatttattcggcatatgtcctatggagaggatatttcctgtcatagctgaagtgtcaatcgaccttcagttccctgcctccagaccctattttcctgtctcagtaaagaaatatgttcaagcactttgcagaacaaaaaataggcatcacaccatagattgaacataataatggagaaacagactgaacgataagcaacttgtcccgtataagccagtcaaaaatagacaaagtatcaatacgatctaagcatatcttaaaacaaaaagacagatacaacattacgttaaccatgtagactgctattttatctgttacagattctctctcttctattattttttctggggcaacacaagtttggctacgagtggccccaaaggtgtggacttccaggtggcccacacctccggactaagcgtgaaaacatcacggactccaagagcgcctcaagtgcacatcctctcgcgccctacacgccccccctcgacgacagcgacggaaccaactccagacagcccagcaacacaacgcgcctgggacaagactctcggggaccttacaaggctcacct

SEQ ID NO: 562304 - DNA, 127 bp, Homo sapiens
agcagagaggaagggcctcctgaacaacctgcctctttggcaaagcaggggcttcagaccctccgactgtgcctcccgcctccacccgtcacactccaggtgaaaatccccaggggtaccgaagctc

SEQ ID NO: 562305 - DNA, 589 bp, Homo sapiens
  misc_feature (467)..(468): n is a, c, g, or t
gccgcagcagcacccgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcagccaccaggacttctcccggcagagggaggagctgggccaggcttgcagggcgtcgagcagaaggtgcagtctttgcaagccacatttggaacttttgagtccatcttgagaagctcccaacataaacaagacctcacagagaaagctgtgaagcaaggcggagagtggaggtccagccgggatccaccgacagtgctggcaggaaacctccaagaatggagaattcctcaaaacgacctctcgcgatggggatccatggtggtggaaggaacgccccgggagcggggactttcacggtcccctggnnagaacaacggtggacgcgagcggctgacgggagcttcaccgaaatcccatcaacggacaaacatcgccatcttcacagaagtccagaagaggagccagaaggagatcaatgacatgaaggc

SEQ ID NO: 562306 - DNA, 440 bp, Homo sapiens
actttcagagttctcggagtttccgggaaaaagagggcccccacaccccggttggggggaaacagggcacacaattgggggcaaacccactacatcctgagaacccgggggccccaaacaggggcaaactcctgcggtaaaagggggacaatgggggccctcccccccttaagaagggggcaccgttttcccctctgccacctcacaggcacacagcgcgcccctgttggcaccagcagcacagatgtgtgtggagagggggagtctcctcctcagagagattctctttgtccgcgggggccctctctctctctctgcacctttttttggcgttgctctctctctgttcgctcacccgcgggtcccctttttgtttttttgggggagtccccccccccctttttaatatttttttttccccattggggggggaagaggga

SEQ ID NO: 562307 - DNA, 234 bp, Homo sapiens
ccccccccccccggggtttttttccccccccgcccccggcccccttttttacccccgggcccttttgtggttgggggcccccctttttttttttggggggcggggggggaccccccccccccccccctttgggtttttgggttttttcggggcccccccccccccccccccccctttgggggggtttttcttttttccttttttccccccgggggggttggggggggtttttta

SEQ ID NO: 562308 - DNA, 453 bp, Homo sapiens
  misc_feature (36)..(36): n is a, c, g, or t
  misc_feature (108)..(108): n is a, c, g, or t
  misc_feature (139)..(139): n is a, c, g, or t
  misc_feature (147)..(147): n is a, c, g, or t
  misc_feature (151)..(151): n is a, c, g, or t
  misc_feature (157)..(158): n is a, c, g, or t
  misc_feature (162)..(163): n is a, c, g, or t
  misc_feature (175)..(175): n is a, c, g, or t
  misc_feature (179)..(179): n is a, c, g, or t
  misc_feature (189)..(189): n is a, c, g, or t
  misc_feature (222)..(222): n is a, c, g, or t
  misc_feature (224)..(224): n is a, c, g, or t
  misc_feature (230)..(231): n is a, c, g, or t
  misc_feature (285)..(285): n is a, c, g, or t
  misc_feature (289)..(289): n is a, c, g, or t
  misc_feature (307)..(309): n is a, c, g, or t
  misc_feature (321)..(321): n is a, c, g, or t
  misc_feature (418)..(418): n is a, c, g, or t
tgtttatatatatatatgcacagagaaaccttagcnaacaaatccctgagtccatgggaaccaggacactaacaaagggaaaggagagtccatgcctaaagagtaggnaatatggcaaaatctttacctttcctcctgnatccctgnaacngagggnngggnncagatcactacnaatnaaaaaaacgngggtttggggggggcaggaaagtggggtgagantngtaggnnggggaactcagatgccaccagtctgggaaagtaaaacatttgatccagcatganagcnaacatgaccgcagaggannntttccagactgntgggcatgctgctggcctttggtatatgccaagcctttgcttggtagccccacgcctgggccagcacaacaaatagcacctgtggggcctataagcngggaggggatgggggagatagggactggggaaatg

SEQ ID NO: 562309 - DNA, 342 bp, Homo sapiens
attagaggatccgcccatggtagatttccacaaaagaacaagacaatgatatgctctcatatccaaaaaactaatgggagctggggactttagatgtaacataccataggtttttttattttaaaacatgacaggctgggctcagtggctcacgcctgtaatcccaacacaatgggagtgcaaggagggcggatcacctgaggtcaggagacaagcctggccaacgtggtgaaaccccgtctctactgcaaatacaaaaaaaaaaatttagccgggcgtggtagtgggcgcttgtaatcccagctacttgggaggctgaggcaggagaatatgaaccgtggg

SEQ ID NO: 562310 - DNA, 196 bp, Homo sapiens
ctcgatagtacagccattctcatccaaaccccctgtaagcttcaccggcgcagtcattctcataatcgcccagggtgcttacttcctcattgactattctgccctagcaaactcaaagctacgaacgcactcacagtcgcagcatattcctctctcacggacttcaaactcgactcccagtaatagttcatgctgt

SEQ ID NO: 562311 - DNA, 235 bp, Homo sapiens
ccgctatatcccctataagtcccactcgtgagagacactctacgtattgactcgcatcgaagcagtatcaatcacctgtagctcaccatagtctaatagagaaagacgcgataacgcaatctaattcaagcactgcttattacaatttcagtgtgtcatctatttgtaccctcctacaagcctcagagtacttcgagtctcccttcaccatttccgaaaacggcttcttcatcgg

SEQ ID NO: 562312 - DNA, 169 bp, Homo sapiens
  misc_feature (7)..(7): n is a, c, g, or t
  misc_feature (18)..(18): n is a, c, g, or t
cttcatnttttacctttngcataggaaaagatacaaaaatattctttcaggtagctgttttagcgtaagagctatagggcggactgaggaagggaggaccactttacccttccttaagggcctcacaatttcctccagctccattttgatctcttgttttcttctcatt

SEQ ID NO: 562313 - DNA, 567 bp, Homo sapiens
  misc_feature (269)..(269): n is a, c, g, or t
  misc_feature (293)..(293): n is a, c, g, or t
  misc_feature (454)..(454): n is a, c, g, or t
  misc_feature (483)..(483): n is a, c, g, or t
  misc_feature (506)..(506): n is a, c, g, or t
  misc_feature (531)..(531): n is a, c, g, or t
  misc_feature (541)..(541): n is a, c, g, or t
ctcagaccggccgacacttaggaaaaatagaaagaacctatgttcaaatattgtgggctggttcccctgatagattggaaaagaatgagaccctgcaacttggaatggggaggtatgggaggacactggtgaagctggggtcactgactttgtaaactccaatgaactttttttgccagaagaaacaacttcctccccacccagtagtggcagcattccctccctaacccatgctgccatcagcctttccacctttgtctgaggggggntaaactctgtgctgcctgaggaantagtgatggcctcccctgaggaagttgccaagcaagataatgagaaataataatcagtacagtttggctctcagaaagccacatccctaggaaaaggggaaagagtactacatcagggggaacatcccatggggaaaaaaaggaatctggaacaatagccntgagccccagattcttccctcttaacatnagcctacccaatgagaagggacnaggaaacgattctggggaatatggncaaaacaggntggtttaaaacctccccccaaaaatt

SEQ ID NO: 562314 - DNA, 151 bp, Homo sapiens
agcccgaggaaggggcccaacagcaggagcccaagtccaacagaattgggaagagggaagggggggataagaagttccagaaggcacccgtgaccgcaatatcgaaccctaacctccaggaagggccattgttaaactggtagccccgcca

SEQ ID NO: 562315 - DNA, 162 bp, Homo sapiens
tgtatatcagtacagaaagacctttgagcgagttcctcatagttggcagaggatcaggcaaagtcgcaagatgtgtttcaaaccctctcatttctgcacactatgaggaagcaattagatgacttccaagcccaacattccgaaaatttcaaaggtgaataa

SEQ ID NO: 562316 - DNA, 197 bp, Homo sapiens
cgctctgctcgggctcggcgcgggcgtggctgctcggcctggtgcagcagcaggttgcggttcggcaggccggtcagctcgtcgtagaacgccagctggcggatgcgggcgcgggcctcttcgcgttccagcgccagcgcgcacaggtacacgcagacgtccaccaggcggtggtggaagtcgtccggcaggcggcg

SEQ ID NO: 562317 - DNA, 221 bp, Homo sapiens
taagtactgcagaggtgtcgagctctcatgggacgcgtgcagctcatcgtaccagcggctgggtagatacttgtgggggacagaacacgaattcgatttctgggggtctccttgcaacaggaaaacaaccttattcttccaaatgagaaagacagacccactcatcacaggcagcactgaacacccgaggcctccccacagagagagcgtcgggtaccgag

SEQ ID NO: 562318 - DNA, 210 bp, Homo sapiens
accaagtcttgaaactaggagactatgggcttgcgcactgtgagtagaaggcccttttatacacagtctgtggcacaccacttatgtagatccagagacaatgctcagtattacatacatacacagacgatggaagtagccacttcttccctgggcggtgtgggtttccccagctcttccacacgtgtgttaggaatgcccgtgaacttg

SEQ ID NO: 562319 - DNA, 296 bp, Homo sapiens
aatgtttgatattgtcaggaggatttctcacgggttgcatagggcccgtgatcgtgtagttatgtaaaaagccatagttgagttcaccagttcataagaattgaatatcccaataggataatctttcacaaacttggagagagcaggtcagcatttggaggcattagcagagtgccccatgagcagtagaggtcataattaggtccgtggactaaagcgccgaccgcagggctcacaagatgtgcgcaaatcaaagcgtgtgcccttccccttccccttctccttcccttcccccc

SEQ ID NO: 562320 - DNA, 324 bp, Homo sapiens
cacgaggtcctcggtgatctgttcggcggtgcgccggaccaggcgcagcggcgcgaggatctggccggagacgatccaagacgcgatcccggccagcagcagcccgattccgctgacgacggccatcgtgcggaccgtctcctcgacgtcggcgcgctgggggtcgacgcgctccccggtgatgagatagccgtccaccagcgcgtcgtcgcggttgatgagggtgcgcgaccagcgcagcaggcccgccggggtgacggtctcgccggtgtcggcgaccgtggggtcgaggatctccgcgagcacctcctcggtgatcgccgc

SEQ ID NO: 562321 - DNA, 237 bp, Homo sapiens
acacaaatccgaaccacatcgccaactcgaaataacttctgtctgtggtataaggtaggagacaacattattattttccatactgatgtctagttgttcaacaccatttgttaaaaagactttcttttcccattgaattgctttggcacctttgtctgtatattaattaaccatacaaggatggatctattttggttactgtacttcttttttataatgctatcccacctctagtgt

SEQ ID NO: 562322 - DNA, 976 bp, Homo sapiens
gaggaatctcttgcactaccgtgatcctggattcctggctctaccctgtccgtccctttgcttggacgcagcatctgtcctcttccctgaacgttctcttcttgccctggactaggcgaggctgccttggtgtgtattcagagggcagtgatgacttggttgtccaggcaggtccctcctgcatagcagaatggtcgaggggtgcgactagaaccaacatgcttctcgtgtttgaaggtagagcgtcagctgtcgacattatgcaagctgtgggcctcgcggagagtcatccatccttacacgccctggtgctttccctgccatactgatggctcaagcacaaggcatggataaagcctccccagaaacatctctggcccagaaagcctctactcatccctcgcctcttctcatgaggcacagcccaaagccaagtcgctcaatgtgtgacgtccatgtggcgtcccaagaccacagagctgaagacgggtttattttcagtcctcgcgtctctctgggtcagaaccagagggcatgcgtgaatgcacctcgctgcttacttggtgagggtgccccgccatgagtcgagtgcctctcagactggcagtgcaatgcgttgtagaagtaggaggaaacagttctcactggggaagaactccagggcggggaatcccaaagtggctcatctcgaaagggagggcctgttgcccctgggagtcagggttgaactgacaaagttttggtggagacctgggcgattttgagatacctataatagccgtgctgaaacacgagctgtgtgatgcagtgaaagcataatcaggattacctacaagcgtagaggcggaccataggtgttccaagtctggaaagaaaaccaaaaaagggaattttgggaaacttggggccaatttctggttcctgtaaggttagtcttaaaagcgaaattgggttgggcgtaattaaaatgggaagt

SEQ ID NO: 562323 - DNA, 355 bp, Homo sapiens
attttagggaaaatttaaggagcccatttttaaaaccggaagaattttggttttggggaaagattgcccaaaattttttttaaaattagttaggcccctttgttttattccccaattgataaaggcctgttttattttttttttggttaaagggaccatttttttttttggggtttttttatcaaatttttttttttggaggtttgtttaattaaaggagtccttttcttttagggccatgtaagtttttatttttctgtaaggaaggaagggccccctcctaaaatttgtttttttacccataatgtctgttggggaatgggttgtggttaaaatttaaagttggggtggggga

SEQ ID NO: 562324 - DNA, 191 bp, Homo sapiens
aggcgagtaatcctaccgagtcctcggctgatagctggttgtccaagatcagaatcttaggtcaactattgagtatgcccacagaaccctctacatctccttgtaaattttactgttagtccatagaggaacagctcttagcacactaggaaaaaaccttgtagagagagttaaatatttaacacccattg

SEQ ID NO: 562325 - DNA, 336 bp, Homo sapiens
cccccatcattgcagcctagtgccaaactttgtcttcatgaatgagagctagtttcctctcaaatcatgatgctttaactgtttagtttccaaagccaacatccaagataggaaatcacagcatcaataccaaagcacaccccaaattataacaaaatgaagacatactgcccaccaaacttcttttctttatccctattgctagtgctagggaacaggtactaataagacagcaggtgtattcactaatttttcttttttcctgaagctggcccacagataggacatctgatttaacccgatccattgacaccgttcagggcagctgaatccgca

SEQ ID NO: 562326 - DNA, 135 bp, Homo sapiens
gttgtcagtgagcgttgtcagtgcagatctagagcattggttctaaaagtgttgcctggaatcttgttagaaatgcatatttttggaccctgacctcaaactcctggactcaagcaatcctcccactgacaacgg

SEQ ID NO: 562327 - DNA, 149 bp, Homo sapiens
gaagtagattcttctccagtccagccttcagatgagaccccagccatgccaacatcttgattgcagccctgtgagagtccttgaaatagaaccatttctgatctcctgacccacagaaactgtgaaataaatatgtgttaaggtaaaaa

SEQ ID NO: 562328 - DNA, 157 bp, Homo sapiens
cacaaactccacctactgccccccccccctcttttttttaagaatggcctgatcatggctatttcagccacattgttggcaatttaatttatttacttccttttttttttttaagaaaggaaaaaagaaaaaaaaatcaaacttgaaaaaaaaaaaa

SEQ ID NO: 562329 - DNA, 162 bp, Homo sapiens
ttttgacggcagatggctaaactcacagacatacagtgcagaagttgcaaacaatgagggcagctctctgtgtactcccaggcatctccctactgttaaatgaagacaaaactaatcaataatgtttaggacacaatagcatttcaccactatcgtatagaa

SEQ ID NO: 562330 - DNA, 121 bp, Homo sapiens
cgtggttccttgcagaaggtgttggtgactttcattcactcactcactatatctacaagtagtttcctatgggtgcttctctcttactagtgagtctagcaagggaacccgacgcggggta

SEQ ID NO: 562331 - DNA, 205 bp, Homo sapiens
ttgcagtgagagagattgttccactgtactccacactccagccttggtgacagagcaagactttgtctcaaaaaaaaaaagaaaagaaaagaaaaaaagaaaatcctgtcagtcaggtgcagggttcacaccttttaatcccaataaacttgggagaggctgaggcagagaggataatttggagcccagggagtttggagaccat

SEQ ID NO: 562332 - DNA, 620 bp, Homo sapiens
  misc_feature (71)..(71): n is a, c, g, or t
ttcttccaggtgcatggagcatgctgtgggttgaacactgatccatcaggattgatgtaaggtgcataatnagagcagggtctcatgtaacctttaactgttcagccaggaccataatatcacgagcttctgctgcagaatccagacaagaaataacatcttatatgctcttttcattcagagagttatggagttttgtaagagctactgtggtttcttctgatgattgacttaaaattttctctcttatttcacttgtaatgtctgcaggatcgtctactgccatcgttaaatccgaagctaagcagttgagaataaggttagtaagatcagttcacactgacttcagcaagtgtttggtaagagcagcttgtgtgtcatctgcagtaaacttcatcccgttttccaatagcctaatgttattgtacaggtttgaaacttcttctagcaagtcgttgactgtgcgttttctggccgtctcagaagcagaagttgttgaagacatgaatactgaacgtaccacctcgagataagttttagtaagaggttttattaagtactcagcaagttccgtaatcaactcctcaggggcatcttgtatgtgttatcttagaaaatct

SEQ ID NO: 562333 - DNA, 368 bp, Homo sapiens
cttacggccgatatatacatctgcgaagagtagagtcagagtcatgtctttcatattcccatagtacatcatgtctacaacacttcagcaatagcaaagcaatatcaaacagaaatataagtggtaataacaacaagaacaacttagggtttaaacaattgggaacagctaggcagtggagcaacggggggttgtttttggtataagcatcatactaccttgttacattaatcttatgtccatgatattgctttgataaaaataatacattagagaaacaaaatattaggatcattttcacctgtccaagctctacatacagatcggaagtattgactatgagcttactgatctgattcttcatgata

SEQ ID NO: 562334 - DNA, 164 bp, Homo sapiens
gcacttgcatgctgctgtcgatctagtaggatccccattggagcactgtggcggtggctgaatgtgccccgctccacggttctggccgctcagccgaatgtgtgatgccctccttcaggagcgagccaatacgccatgatactccgctacgagcccatgtccac

SEQ ID NO: 562335 - DNA, 661 bp, Homo sapiens
gtcagccaacaaggtagctataacctctgagtagctgagacagaggtactcaatagagccattcctatgagaaacgtaagtatctgctgtttaagacgcgctaaggttatagctaatgtattatgccataatagataagttatatacaacctttatcaaataataagagtaaccatcatcagtaatgagacaaatcaaaaaccatggcccacccaacagaacataatgaggagagtacagaatggcttctgggatatttctgacaaagatgtatatgcttcattcatacatgaggaaacatcacacatactcaggatgggagagccattctaaaaaataactaggcagaagtcttcaaaaatattaaagtcacggaaaccaagaaaaaatatgaacctgtttcagattaaaggaaactaaacagacctaacatttttaatacaatgtttgattttgaacttgaactttttgttatataagacactattgagacaagtgctaatgcttgaatagggctgaaggattagattataataatacattaatgcaaatttcctgattttaaacatagtagtttgattgcacaaggagaatgtctttatgtgtgggaacataaatagtccacattctgtcttcaagcttctgagaaaactctgtttag

SEQ ID NO: 562336 - DNA, 549 bp, Homo sapiens
cagggaggcggatgcctattggcgtccctcgagcaggcggaagcccaattgggtgggcccaggggtggtctcataccaggtggaggagccataatgccgggaggtggggtggctctgccgaggggtgggggcggagtgccccgtcctggtgggtactgtgtgggggctccagcaatactggcagtcgcagcaccagcagcagttgctacatgtgcctcttcccggtggagtcattacctgcggggatggtcccccaattcctcggacagggcctgccaatccagcaggggcctgggggaattgggcacaccagcgggtactcctctaccagttgccctaccaagcccagggcctccagcagctccagcaagtgttacccgagcattgccagtatcttgggggggtggccctccacagtcatggataccaagttctccccaggcagcaaaaccagagccaaaagcggcttttctacaggctctggtggcttcgcattctttgactggatctatcttgaactcatcacaatcacagaggatcaaattcata

SEQ ID NO: 562337 - DNA, 992 bp, Homo sapiens
  misc_feature (890)..(890): n is a, c, g, or t
tgaatggaatgtaacccgtgtgattggtaatgccagtgacccatgctgtttgtggttcgtgtactgcatccgtaccaccaaggtcgtctgacactggagaagccctggggcctggcctcgttccaggaatgtctacacatagtgggcgtgtagtcgtaacgtggtcctggtggagccgagctgggatgactgtatgctttctcaaacccggctatggctggagcaccatttggtctccagattcatcgttacataacgggaagatagaaagtctgtcgaaggaatgcagccattggagggctatgaggtgatagtctcattccctggtggtatcacatgtggggctattaattgtcgaacgaatgtggtctgccgatgggatgtacggacggtgaggtaatccgtcgcttaggtgacagcaatagagtgatacccaggacaacgtggacatgcatattggtatcaaattgcttccaaagtgatccatccttggaaaccaattccaggtccagaatatcccacccggtgaatgaccctttcgttgtttggcaatgccggtcgggttccacattggttgcacacgttgtcgtctcgaagcgtgaaggggaaaaggattgatccgccgatcctctggttcaaaagttggaatatggcccttgaatgtctgtaagtccgggagaatgcaggccatgttagatattggtgcctgtagcaaacgcccatgtttgtttgagagcggtgtcataactatccacccttgcggatcagctggcagtgccgggagaatagagacagcacgtggcggtgggtgtcatcacacagcaggtggacatgaaagggctgggggagttggaaaaggtttccacttttgtcccgaagtgcacaaaggnatatggatatattcctatagtctgccccccccggtcacgggggacacgggcacacacgaggtctggcgcaagtacggaagaacaggttgaagcctcgtacca

SEQ ID NO: 562338 - DNA, 248 bp, Homo sapiens
tctagatgtcacaggctccatgctaactgatattatggaggtcagcacaggtgctcactgtgtcgatggaacttgtacagggaggcatgcaccgatggtggtgaatacacgtcgaccaggctccagctaaacgatatttggaggtcagcatggtgctcatgtgtcgacggaacttgtccagggcggcatgcatcgcagtggtgaatacacgtcgagctggaggcatgcatgcattggttgggaactgt

SEQ ID NO: 562339 - DNA, 806 bp, Homo sapiens
gacggagtgtagcgttgtgctgtcggcaggaattatctttcagggagctggaggctgcgttgttagtccgttggacgagtattgcccagttggaggctgaaaagtacaggctacagtgcagctattggttcatattcttgtcatctcgaggagaactctcaggaatgacgcttgagtaggccagatgtcgcatgttaagttgtccaataattgtgatcttcttaaataggtgggagttagatgggggatggtggcacaactatttggtcaacttacgattggtcacgtatgtgactgttacgtgttggagattggggagggtgggatgaacggtaagatgctttagatgtcactgatttgctagataaagctctagtgccaagacgaacttaaagtcgtgaggaactgggactagcatgtccagagagatatggcaatctttccaaggtctggcacatgtatacttcgcaaaatgatattaagttctcctgtccccaccaagttttgatattgggagaaaggctaggggggataggttgagatattgagccgatctgggtggtggttacccaagctggacagttgagcttgggcggcagaggggaaacacggtggttcagtaaacttgcgataactggaaattctggtgtatccgattccaaaagtaataggacgctattggggggtgacacggcactggtgattggaacctgggggggttgggtcctgggcctacttggggtgaaaattaaactaacaatttattgggaaaattggcggaagtcgttgggcttgggagtgtgtgg

SEQ ID NO: 562340 - DNA, 286 bp, Homo sapiens
tgagatagagtctcgctctgtcgcccaggctggagtgcagtggtgagatatcggatcactgcagcctccgcctcccaggagaattgcttgaacccgagaggcggaggttgcggtgaggcgagatcgcgccgccacactccagcctgggcgacagagcaagactccgtctcacaacagcggaccacaaacaacaaaacaccttgcctatggagggtgaaaaagccagcctttggggaaccattttaaatttttaaagacccccccccatttggaaaaatgggggggg

SEQ ID NO: 562341 - DNA, 1128 bp, Homo sapiens
  misc_feature (383)..(383): n is a, c, g, or t
  misc_feature (869)..(869): n is a, c, g, or t
taacccctctttagcttttaatgccctcaaaaaccaatttaaaccccccccccttttaacaggggggcagtgacaaaaggcaaagaacgcacggaacccagcctgtggaggaccaccagcgttcctgtgccccccgccatttttctcgcccgtgattgggatttgtggttttccatctctgtgtctcccttgttggcttggggttggagttgtgacggctgtgagacgccctcctgtgggggcgcactgtgggcccactgtgagagccccccctttgggagagaaaagtctcagagagggggaagtgtggacaagaggcccagtgtgttcgcggacccgtggtctatcttcgtggggaaccgagtgtgcgtttgtgtgtctcnccacgagaagagtctcccgtgaagtggccggaaagtgggaggagcgtttgtggggccaaagagggttctctcctctccagagggtgtgtctcagcagagaagagtggtgtgctctcagagaagagtcgcccacacagagggagaggcgggcgctcccctgtggggcgtcgtgcctccctgtgagcagcgcttgtgtcgcccccgggatagcgtgtcaaaaaaggcgggctatcacccgagggtcgtgttttttttaaccaccgagagagggggtgtttcccaattgcgaacccacgaggacatttgctgcaccttgtggggcccccccgcgagagaagacccccaaagagagggatctcagtgaagagtaaagacggcgcatatagcacgatgactaccaacacaccgcgagggagtggcacccacaaaggggagcaatgacgcagacagaggaggcaaccacagcgacgaaccacatctgtgggnaagacgggtttataacaaccactcttgcagggcccccccccacactgttgttgtatcccccccccacaataatatattagagaacaccccactcttgttgcgacaacagcctaatgcctaccgagaaagatttaaaacataggcttataataagaaaggcggccctgatgtaaagacgatctatttctggtgaggaagacaccccagagggacaatataaacagagggcggacctatcgacgcaaattttataaccccc

SEQ ID NO: 562342 - DNA, 772 bp, Homo sapiens
aagcagcagtggacaggacattcaaagcgtgtggatggtgccgtcactgatcatatccaggctgctgaagccatgaagggaacagaatggttagacccagaggaccccacagccattgctgagaatgagctcctgggagctgcagccgccatagaggctgcatccaacaagcttgatcagctgaagcccctggccaaacccaaggaggaagatgagtccttgtactctgaggagcagatactcgatactgccaactccattgcagcagccaccactgcactgctaaaggctgcgtcagatgtccacagagaactagtggcccaagggaaggtgtgtgccattccagacaatgcactgtacgatgggcactggtcccagggcctcatttctgctgtccggatagtggctgcggccaccaacaatctgtgtgaggcagacaatacagctgtgcaaggccatgccagccaggagaagctcatctcatgatcccagcaggtagctgcctccacagaccagatccttgtgggctgcaaggtcaaagctgaccaagactcggaggctatgtaacgacttcaggctgctggcaacgcagtgaagcgagcctcatatatatggtggcagcacacaatgctgcagactttgtagagcaggagaatgatatcactgttggtgatagagagatggggtggcggcattagccacaacattcgagacacgaagaattgctttgttagaatcagagctggatgcgcgcagatactggcccattcgg

SEQ ID NO: 562343 - DNA, 553 bp, Homo sapiens
atcgggacatggggtgtcacgggggtaggcccatcagacttgcggtgaggaccagaagatccattcattgagcagagttcgggcaattaccaggggtacggctaacatcttggacgtctgatcgaatcgcattctgcacgggtaagccattggtcttgtccatcacatcaccctcctctttcaaatctcctagcttatctccatcaaacgtacccttgtccttcttgtcaccttggtcgtttgcatcactgtcggcatccctggggccaaatcctccttttcttagaggggaatcgcccggggatgagctcaacatatattcgaccatgctaacgcctagtccccgagtctccgatcgtgcggacagtacagaatggacctcactgttcacatggaaactctgaccaggtctgctctgcaccatgatgggctgggaaactgaatgatcggatgtgccccaggcactgtctcgccattgatcacccaggaatattcctttggggccatcttgggtggattcatctgtttcccagccaagattgactcatcgggg

SEQ ID NO: 562344 - DNA, 748 bp, Homo sapiens
aggtttaacttgggaattggatgcccaggtccgaaaccatttaagggcctggcccacacatacttcagaatagaattctcttcggtttgtccaatagtgtgaaacaccaccagccgtgtggatctcagaattctaaatggtgtcttaccagactgctgattgctttgctctgcttttcagagcgcgttttcttaatttttagcttctgacctgggctaccccccgaattcatccaagtcttgagaggactggctgcatgtttgaggtctctcaacaatctgcccaaagctcccatggttcctctaagcctcagcagccgattttgtgactgtgcatagacctggattttcagcctccctcccgtaccctaaatttgccaatgtcccccgggtaggagcagctgccagacatctagctcctctccttgaggttttctcctcttgattctcagcctccccagttctcatttcttccatagatagccaatgccttcaaatagatttctatattttatttagctttctagttcgttcttattgagagtgctgatctgtacagagctacattcgtcccccctggaagtcctctcccattatattttgagaatatataattttaaaatttactttccaagccaaagtaccaaagacttcagcagatcataaataccatggacatgtattaccccttggtaagaatgcagaattaataaaattaatccataattaattaaaatgtttgatattta

SEQ ID NO: 562345 - DNA, 535 bp, Homo sapiens
tggagcttcaaatttttttatccgggaaatggccatggcccaaaaccccccaagggcccagttggggggtttgaccgggggacctgaacatgggaagattagggcaaggggaaaaattttcctgggggtggggaaaaaacccaattaatgctaacggcttccaagtcaaagacctttaatttaaatttctcccccaacttcttccaaactttaaaatcccagttttttgaattatccctaagggcgggcgttgacatttcttagagtccaaggtccttttatgttaagacttgggcaaaacctttttgcggtaaaggagggtttcattccacctgcataggttaagcgaaggcccaccgcccgccagatacaaagcccaaacggggaacccgttaaagaaggtgcccccgtggtcggccgcaacggttacaaaaaagggcggttgagtccaaacggcccgagacgtttgtccggggattaacccccccgggccgtaacaaagacgtcccgggcagacccattggagaacagcttg

SEQ ID NO: 562346 - DNA, 150 bp, Homo sapiens
cgtggaggcgcatggcattccgacataagctcaagtggagcatgattgaataaagccctcagacttgacagagccactgctatctgggttgccaagcacagagcgagagcccagccagttctacctcgatagagccgccggatgctcacg

SEQ ID NO: 562347 - DNA, 599 bp, Homo sapiens
cgtggcttggagaacaggcaggaggtagtgttccatggacgactgacaaggtaacaataattccaaaagttcttaggtgcttgagaacggacctggataccttgaagggcttctctggggaccgggtcctgtttttgcctcaccggctgggcccgtcttcactggccaatcccggagagttgtcttctgcccgtactcttggccaccgcttagccagagctggtcttctctcttggcccggctcagttaagaaaagtctccattcctcctctcggagaaccataagggtcataatgactcccattccgggtcactttaccagcaaagagccatgctctgtcaaagagatagtggctctcagcttgctgagcaagtcccttcctaaaaagatcaagggacagtcaggcatgtaccaaaactgatgaatgactttatgtcctcctacagtacaagtctgagacaagcagaaagcttgcttggctgaaacccccgtggctccgatgacgtcaatattctttttggataagggggcaacaagggcggttactagtgaatgttcagcaccgctatctgcaagaaagtcaatatctccacccctg

SEQ ID NO: 562348 - DNA, 264 bp, Homo sapiens
aacgctgtatggtgtctcttcacacggactcgagtgaactttgatgccgtggctcggatcgggggacctcccttaggagatcaatcccccgtctcctgctcttcgctccatgagaaagatccacctacgaccttaggtcctcagaccaaccagcccaagaaacatctcaccaattttaaatccagtaagccgcttctttttactctcttctccaacctccctcactatccctcaatctctttctcctttcaaccttggcgcccg

SEQ ID NO: 562349 - DNA, 814 bp, Homo sapiens
  misc_feature (24)..(24): n is a, c, g, or t
  misc_feature (129)..(131): n is a, c, g, or t
  misc_feature (141)..(141): n is a, c, g, or t
  misc_feature (164)..(164): n is a, c, g, or t
  misc_feature (342)..(342): n is a, c, g, or t
  misc_feature (361)..(361): n is a, c, g, or t
  misc_feature (367)..(367): n is a, c, g, or t
  misc_feature (395)..(395): n is a, c, g, or t
  misc_feature (407)..(407): n is a, c, g, or t
  misc_feature (658)..(658): n is a, c, g, or t
  misc_feature (813)..(813): n is a, c, g, or t
cgggggagagattgaagaggagtngagaatgttttattcatttacaatgtccctttcctggaagggtggacagctagatttaggacaagctaaagatcagtcccctatttaaaaaaaaaaaaaaaaagnnntcggcgagtngtcccgggtgggaggtgggagcngaataaaaaaaaatctgcaatgattcctaattgtttttcaatacagaagcttgggaaggggtttctgccagtttcatgagggaggcacaacttccaggtagtgttggggaagggtatgaggtcctatgcaggctggcctcttatcccacagatgccaagatgatgtctactggcagcncctccaaacttctggctgncaccgnggcattgtcactgggtccaaaagcagcngccgggagcgcnccaggatgtcatgaccaccccggaacacaccagccaggagccacgtgtgggtgttcttgttatccggcactttgtctgacctctcacaagggtgcattcccaagaacttcacaatattacccacagcctcttcaagtgtcttgatggtagacaaggtgaacgtttcctccttctcaaattcatcccctacctcatcccaggctgcttcgaagttcagtttcatgaccttttgaatgtgatcagctacagtnacttccagatctttcagcacatactcatcctcatagccttcgtcatcagtctccccagtggtgggatcacagtccttgacagtgaacttcatcatgcagctgaatgtgcaggccacagctgtggggtcttctttgggcagtgcaccagtgtgtana

SEQ ID NO: 562350 - DNA, 171 bp, Homo sapiens
tggaaacggagcaaggtcccagctactacgggaggctagcggtgggaggatctgcttgagcacaaggagttctgggctgtagtgcgctatgccgggatcgggtgtacgcactaagattcggcatcaatatggtgacctcccgggagcgggggacccaccaggtttgcctac

SEQ ID NO: 562351 - DNA, 368 bp, Homo sapiens
cagtgcttgggattacatggcatgagccagccgcacctggtccaggtacacttctttatactgacctgtcctacgttccccttggacattcagcgtctggagccctgacacttggatactttggggaagagattcagctgccaatgtgctgaggggaggtatttcttcatcctggtacctgataaggactttgccgagcttccgatccagcacttgtgggacatggagtatgcgtattccaactttataaggaagaggggcttccaggctgaaggtcagcaagatgtgagagcagctggtacagtgtcaggcaggggatcacgtggacttgttgaaacgctcccatgcaattggtaaacatggcgaaa

SEQ ID NO: 562352 - DNA, 317 bp, Homo sapiens
  misc_feature (17)..(17): n is a, c, g, or t
  misc_feature (20)..(20): n is a, c, g, or t
  misc_feature (62)..(65): n is a, c, g, or t
  misc_feature (77)..(77): n is a, c, g, or t
  misc_feature (81)..(81): n is a, c, g, or t
  misc_feature (86)..(86): n is a, c, g, or t
  misc_feature (137)..(137): n is a, c, g, or t
  misc_feature (143)..(143): n is a, c, g, or t
  misc_feature (155)..(155): n is a, c, g, or t
  misc_feature (179)..(179): n is a, c, g, or t
  misc_feature (229)..(229): n is a, c, g, or t
  misc_feature (287)..(287): n is a, c, g, or t
  misc_feature (305)..(305): n is a, c, g, or t
  misc_feature (310)..(310): n is a, c, g, or t
  misc_feature (313)..(313): n is a, c, g, or t
cagcaagtaagtaagtngancatcactatgccacacttgagttctgctagggttggaggggnnnnaaggcaggagtnccantctgnagcatacactaagacaaaaataacatgatagtaaaatgatacttcctcatnctactntaaatgtttttncaaaagactatcatattagatggngtacaataggtgaagagaatgtgttaattgtacacacttttatatacctntttaattatatgtatttttaacaaaagataacatcaacacctctgattaaatgaaagnctgaaaacattttaaaanctctnctnttta

SEQ ID NO: 562353 - DNA, 541 bp, Homo sapiens
  misc_feature (241)..(241): n is a, c, g, or t
  misc_feature (401)..(401): n is a, c, g, or t
  misc_feature (443)..(443): n is a, c, g, or t
  misc_feature (449)..(449): n is a, c, g, or t
  misc_feature (504)..(504): n is a, c, g, or t
gtatgtggctcttagttgattgtctcctggatctgggaaggaaggaaagaaaacaaagaggaaatggggttctttatagaatgtggatttttcctacaagagacttttcagggcaatttcaaggtatggcaaggaaatatatttttgggtaaaacattttgattttcttcttgttatgccagagtctgattggaaagtaagtcttgatatacagggttaaataaaacccatctgatgagantttatggtttgtagggcataactccctaagccccttagataggaatttcagcaagataaaaaattagagcttagccaggcacagtggctcatgcctataatcccagccctttgggaggctgaggcaggtggatcatgaggtcaggagtttgagacccatnctggctaacatgatgaaaccctgctctactaaaaatttgaantagccnggcatggaagtgcctgcctgtagtccccagctactgggtgaaggcttgaggcaangaagaatcactttggaacctgggaagtccggaagggt

SEQ ID NO: 562354 - DNA, 249 bp, Homo sapiens
tgaggtgacagaggatcccctccataagtgtgccacaccagccgggtattttttggtgtttttagtagagatggggtttcaccatgtagccaggatggtctgatctcctgacctcatgatccgcccatctgggcctcccaaagtgctgagattacaggtgtgagccaccacgcctggtcgtctggctcattttcttacttttggtagtgatggggtctccctatgttgcccaggctggtcttgaactcc

SEQ ID NO: 562355 - DNA, 1178 bp, Homo sapiens
agcggctctgttcttcctgtctgtttggaacagatggcgttcacgcaaggaaggtaccggctctactagacatctcttccacgtatccaccgtcggacgcacgcagggaagaggcaaaaggcaagagggcaggactctggttagagattcatgcccgtgaatgcacacgtgcagatatgagttggccgttgctggtatgtcaatacgactacactcacacgaggcattatacaagaaacgaacgtgagccaacggacatcttgacaagtatgttcaatggacgttgctataaggcgatctgtgatagatacgaagactgcgggctttgaaagattacgacaaatgcttgacttttaccttttttcccctccaggcatcaacagatggcgactcgactgcctggaccttttcgactgaaagcatcccaacatatgcagactgtgaaacactgattgtcgggatggctcttcgaccaatagttataacacagtgtgactcaatgcgttcaaccgttggggcattgggtggatcgaaggtggcccatggactaacactgagttggggctacaattgcagtaaaagccctggagagacaactacacgtagagaacgtgctttcaaagtgaataacggtttaactccagacatgttgaccagttttgacacagggacacttcacttgttgggatatcatacgaagtttttcaatgtatatcacgcacattgaaatatgataaatttggtccccaaaagggaaattctgtcttcgttcaacattatgatggggccagtaccgagaaggtggcaccttccccttaatggggcttggcattgcgaagaagtttctgggttaacatcgtaaacacaagggtagtttatcaccgcccatgtaaacgtcacttggcagcaacacaggtgcatacatttattccagcccctttttggcaccatacacatggttgttgcaaccgacagtttgccgaagttggtaaaattaaaacaaaatttgcccattcttgaattcacatggtccctaagtgatggagaaccaattgagaaaacgcacgttccaggatgcatggcaaggaattaaccattccaacttggatcaggccgtttgcccacaagcggcacaattaattcggggcgcgaagaattctaacagggtgcgggtaacg

SEQ ID NO: 562356 - DNA, 1000 bp, Homo sapiens
  misc_feature (435)..(435): n is a, c, g, or t
  misc_feature (499)..(499): n is a, c, g, or t
  misc_feature (513)..(513): n is a, c, g, or t
  misc_feature (666)..(666): n is a, c, g, or t
  misc_feature (784)..(784): n is a, c, g, or t
tagtaaaaacagggtctcaccatgttggccaggtctggtctcgaactccttgaacctcaggtgtgatctgctcatctcagcctcccaaagtttctgggattacaggcatgagccactgcgcccagccatagatagcttatatgtgaattcagttgactgtatgtgtatgtgtgtcatattgtgtgaacgtgtttggttgtatgtgactcttgtgtatattatctccttagtgccaattctctcttatatggcgtggtaactttgtgtaaccaacccttataagtctcatagtgagttcctcccgagtttatatctctgccgtcaaaattacctctataattcgtggggataccttggacattgtgcgaaattaacattttaagaactcacgctgggcgattgtggtgcccgtgaaactctttataatatctcagntctcgtgggaagaaacattatctcttttacacacattatgtgggacactcttctcagtgtgaangcgggtcactcganatatactacgtggggctcccaattatagtttatacaagctcttataaagttttctcacccagggtgggtctttccataagaatttcaccctgtggggtatctcccacgatttgggtcgccgtgcgttttcttataaaattttttactcccctnttaaatattttctcaactctgtgggtttgggggtcgcgtgatttgtgtagagctctaacatttgtttttaaacacaccgccttttctcaaacggcgtttgggttatatactcgtctgntacacatttaggaaagatgttggcctctgtggacattttgtcgggaaccatatgttggacccccgtgtgagtgtctcctttgaagtgtgttgtcttgcgggggtaaaaacccccacaggtgggtgtatcttggtggacagggccccctttttaaacgaaacgtttttaaaaagcatttagccgacgttcgattgtaattccttaaagtcacacgcg

SEQ ID NO: 562357 - DNA, 334 bp, Homo sapiens
ggtcgactgtttatgatctcaaaagcctcttaccttaatgtaaaattttggccaggcatggtggctcacgcctgtaatctcaacactttgggaggccaaggcgaggcaggttaatcacctgaggtccggagttcaagaccagcctggccaacgtggtgaaacccatctctactaaaaatacaaaaattagctgggcgtggtggcatgcgcctgtaagcccagctactcgggagtctggggcatgagaattgcttgaacccgagaggcggaggttgcattgagccgagattgcactgctgcactcttgtctgggcaatagagtgagactctatct

SEQ ID NO: 562358 - DNA, 156 bp, Homo sapiens
gatggtaggtagagccattagactaaacaagattaccaaggaagtgaataaaaataagcaatctgagaaatgggccctgggcattccaaatttaagagattcagaagaggaagagcaatcagcagaggggaatgagaaagaacagccagtgtaggt

SEQ ID NO: 562359 - DNA, 623 bp, Homo sapiens
  misc_feature (178)..(178): n is a, c, g, or t
cacgggggaaggttcgacaggacagttctctccctgagcgcatactagtgctaactgtactgtctctatggacttgcctattcgggtcctttcttataaagtggaacgacgcaacatgcagcccattgttttctggctgctttcactgagcataatattttcaagattcacccatgtngtaacacatatcagtgcttcattcctttttatggctgaataatactccattgcatggacagaccatattggtcttatctgttcatcactgacagacatttgggtttgttccattttttggctgtcatgaataatgctgtcagcatgtatgtatgtacgcggtttccttagtttttatctaatgtcattttcctgttccaggatccccttcaagataccacattatgtttagctgtcatgtttctaggctcccttggctgtgacatttctcaggttttcattgtttttactgaccttgacagttttgagttctggtcaagtatttcatgaaaactccctcaattatggtttatctgatgttttcctcatgattaagctgggttatgtatttctgggaggaagaccagagaggtaaagtggcaccgtcatcacatcatgtcaggagt

SEQ ID NO: 562360 - DNA, 186 bp, Homo sapiens
ccccaacccccttggggtggggcagaaggtgaagcatcccaattgattatagattcaggccctgcagggccctataaaacctgtggccatccttgagcaccctgccaccaggtgacctcggccaaattcattgccccccttgggcacccactccccctagaataaatttaacagtgtcccgtggta

SEQ ID NO: 562361 - DNA, 1002 bp, Homo sapiens
gaacacaccaaatggaggatgacgccggtgcgaactaggagagcccgggggccctgtgtgggcctggtgatggggaatcgcggtggcttccgagagaagtgtcgacagtggcattcggggccggggtcgctggccgtggacggtgccatggccgaggccgggagctctgggagcgcatgccgaggatatgagtggagtgcccgtcaccaaagttgtgccggttggtcaaggacatgaagatcaagtcccgtggaggagatctatcatctttctccctgcctattaaggaatcagagatcattgattgcttcctgtggtgccctcgtctcaaggatgaggttttgaatgattatgccatgtgcagaaggcagagcctgtgccgagcaggagcaccaaggttcaaggcatgttgtttgcatatcggggactacaatgtgcgcacagtcgagtctgtggtgttacagtgctccagagggaggttggcagccggcatcctgtggagccatcatcctggtcaagctctccatcgtccccgtgcgcagaggctactgggggaacaagatcggacaagcaccaactgtcccttgcaaggtgacaggccgctgcggctctgtgctggtcaggctcatcctgaaccaggggcactgggatcgtcttccgtcacctgtgcctaagaaggtgctcatgatggctggtatcgatgaatgctacacctcagaccgtggtgcgtgccaccctggaaaattcgcaaggcaccgtttgatggccattctaagactaagttacttgacccgactttgaagagatgtatcaccagttcctatcagagtcatggacactgtagaccgacaaagttcggcaggaatcaagccaacggtgtacacatagtttaccgaaaaaagatagggcaaaaaaacatggcttcttggcacataagccatattttcccaattaggatggccaaagaatacgaagaacagagaaagtacgagaaataaagac

SEQ ID NO: 562362 - DNA, 1602 bp, Homo sapiens
  misc_feature (602)..(602): n is a, c, g, or t
  misc_feature (616)..(616): n is a, c, g, or t
  misc_feature (1131)..(1131): n is a, c, g, or t
agaacgcggtgagcacgtccaggtaaggcctcgaggtacggctacgagagtacaatggttatgctgggtcgcgtgctctgcccaccctcacaagatgcacatcacgtgccgtcgcctctcatcgacaatgcgacactcatttgtcgccgtaagtcagtgatgcgagtcggcgcaagcgtcccgtttgctggttagctttgttatctcgagttgtaaagcaaggatgtaaggaagttctgtcagggggagcattgttctaacttgttggagtgtcagggctgttattgaggtagagtctccacccatggcggtggttgaaacgtaaccatatcagtgtgagtacgtaggactggtcggcgtaacggacctcgcgcgaggagacaggtcgagccccaacaatagcaatggatacctcgggagcaattatcctgtggtacacatggacacaaaacgggcaagagactgtctgtctagcctcgcaaagctgtctaatgcaggaggcacaatgtggttgctcgcagtggaaaatgcgggcagacgcacgaatgaccacaacgttccaatatcaaagcaatccggtgaaggaggtggaagttgaatgnattcgtgctggccncattgttgagttcgctcgggcccgtgttgcgttgcttttgttacgagacccaaagggtgtcgcgacctggagccttgccctaggtggaatccaaacgttgtcccgcggagttagccctcgcgagccgggtgggatccctggcgggctcccgctgcaaggggccaacatgccctagggccctttaggatctcgtaaacaaaaggcaaggctcactataattacacggtaatgcatattccttaatgcgttagcaacgagagcacccattcaggtacaccaggggtgttgtttgtcgccccaaaaattatagaaggtcgaagtgcaaactggcccgttatattagaaatttggtgacaacggggcttggacaccaagagcacgaacacggaggttgtgcgcaccgggaccagcgaaaagcttacaaaaagattcaaattatctctcctccccagagaaagtgggccgaggccacgggaaaaacttatggccaggttgttttcatcccgtccgttggntccataatgatgatacccaacatacgattagtgaggctgcgcatgattgtgaacgtggtgtcaggcgcaagaataactcaagacggtttagagaggcactacgagtgcgtggacactatttaattaacaagagcccgacatttttctactgtgggtggaaaagcaaaggtgtccataccccaggggggggaaaactcatgtggaagatagcaagaagaccctttactacaaaagcgagagttgaggcccagaagcaaaaagttttgccccgacaggaggtcatataccagcgacgagaaaaatataacgggggcttgctagaggtgatacatatgttacaatgtggtacaaaggcggtatataacagagtggacgacacaggagatgatatgattaccagggcgtagtcgaaaaaaaatggtggtatcagagcgagaaatagttgtagtagcagacaatatttttacggtg

SEQ ID NO: 562363 - DNA, 154 bp, Homo sapiens
ctacttagaggatccctatatctgtctcagaagtagaaggagaaaaatcaatgcagcgctattggcccaacatcctaggcaaaacacaatggtcagcacagacttcgactgggccttgtgagaatgcagcagctgaaggggcttttgtgggtga

SEQ ID NO: 562364 - DNA, 267 bp, Homo sapiens
  misc_feature (127)..(127): n is a, c, g, or t
ataggctttctttaattattctacaattatatatctaaatatcaggtctgataatctgcgtagataagcccttatatgcctgggtcctccaggcgcatcccaatctcataatatacttctaaatggnctctgttgcactagatcagataccattctctacttaaaactctgctcatgacaacctttcgctggggagaaaaaactctggtagtcataattccttttataatgatttctttgttttcctgatttttatttcttcaaagt

SEQ ID NO: 562365 - DNA, 155 bp, Homo sapiens
ccaaatttgctcatctgggcgctgcatgctgtagtttgtttgcaggccgactgcagccagcttgatcttgggcgatcacctcgcaatccttcctcctcttctcacagttgatgcgtctgccctgtggaagttggacacccaatggccgtcaggaa

SEQ ID NO: 562366 - DNA, 158 bp, Homo sapiens
ggtagtccacaataagatgtatgctgctgtcagctattctcatgagaaacgtttaactttatttactccatatagaactgttgagactaaatcagttattttcttgtacatttgtggccatgcctgtggtataccagaataggtgtccaagcttaaga

SEQ ID NO: 562367 - DNA, 672 bp, Homo sapiens
  misc_feature (10)..(10): n is a, c, g, or t
  misc_feature (51)..(51): n is a, c, g, or t
  misc_feature (463)..(463): n is a, c, g, or t
  misc_feature (468)..(468): n is a, c, g, or t
  misc_feature (479)..(479): n is a, c, g, or t
  misc_feature (505)..(505): n is a, c, g, or t
  misc_feature (513)..(513): n is a, c, g, or t
  misc_feature (515)..(515): n is a, c, g, or t
  misc_feature (563)..(563): n is a, c, g, or t
  misc_feature (600)..(600): n is a, c, g, or t
  misc_feature (631)..(631): n is a, c, g, or t
  misc_feature (635)..(635): n is a, c, g, or t
acgccttctngattcaagaagacgaggctcacctgttactcggcctcccanaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcaagccaggctttacctaccactgggggaaccaatacttcaaggcttttttagtcactggttancctangaaaggccacnagatgaaaaagaggtactggccaagnaagccaangnttcaattccccactgggccatgagggggggacttttacaaggtgaagnccccctgcggggctaaaggtaccagtcatttttacanaaaatttacgcttccaattggccatgaggtnagcnaggttcccaagccttggtaaccttttttaaggcctaa

SEQ ID NO: 562368 - DNA, 665 bp, Homo sapiens
gaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacactgtttaatgtctgccacgtgaggattacactgaagatgcacaatccctaaaataaacatcaccactttcccaaagaagcatccctcaaatccatgtattattcagacatgttaatagaaacaagacagaggatctcagattgactaggactctccaaggcaattcctagagattcacccaataatccccataagtactccatagtagcaacaaatcatttcataaacccccatatgtaaaatggacctaatcaccacacccttcattcaaccatccaaccaccttaggtactttta

SEQ ID NO: 562369 - DNA, 277 bp, Homo sapiens
  misc_feature (10)..(10): n is a, c, g, or t
  misc_feature (51)..(51): n is a, c, g, or t
  misc_feature (158)..(158): n is a, c, g, or t
  misc_feature (165)..(166): n is a, c, g, or t
  misc_feature (199)..(199): n is a, c, g, or t
  misc_feature (226)..(226): n is a, c, g, or t
  misc_feature (242)..(242): n is a, c, g, or t
acgccttctngattcaagaagacgaggctcacctgttactcggcctcccanaaagatggataggagaaatgactacggatatagggtgcctctatttcagtccaagcatctgaatggggatgagagaagtggcagtaattacaggcggatcccatagngccggcnncagccaccgcgagatgtggccattttacaaganagggctaataagttggtgagatacctnttggttaaggaccagncaaagatccccatcaaacgctcagacatgctgagg

SEQ ID NO: 562370 - DNA, 305 bp, Homo sapiens
cccggcataatactctgtctccagtctctggcggtgacgcagggacacacaagctacggtagtatcttggccatcccaggacacttgtggccttaggacgatgaaggccatgattcagtgtttcacgctactataacatgcgactttttgtcttcctgcttacaagtgggacgatgattgacagttgactctactatgcagggctgttgtgtaccaaacatgagccctatagtgtggctgtccctggagcagtggtcaaagaagatggagctctgttcccctgcgaagctctgagggtaccgagc

SEQ ID NO: 562371 - DNA, 478 bp, Homo sapiens
  misc_feature (121)..(121): n is a, c, g, or t
  misc_feature (130)..(132): n is a, c, g, or t
  misc_feature (411)..(411): n is a, c, g, or t
gagctccaaggttttattgtttttgttttatctgcattatttcttttcttaactctctgcagtgtttgcatctgtattcaactactaacctttgtaagccttttacgcatgcacacatttnatttaaatnnnatttaaatgcaatgccagactctaagtcttttggagaaacttaatggtgatacacgtttggaaggcatcacattattgccatctaaccctaagctggtaatgcaaactcactctataaagtcttatctaattttatgtttgtgatttcccattactttttttttttaagtgtcaggcattttaacgggtattttaggcaaaatgtcagttttgcctatgtattaactaagcaaaattttttaaatttaatctcagtccctttcttcaattatccttaantgaaatagtaactttctttttttttctgatgtatgcataacatttggagttataattaactttctcg

SEQ ID NO: 562372 - DNA, 602 bp, Homo sapiens
  misc_feature (121)..(121): n is a, c, g, or t
  misc_feature (130)..(132): n is a, c, g, or t
gagctccaaggttttattgtttttgttttatctgcattatttcttttcttaactctctgcagtgtttgcatctgtattcaactactaacctttgtaagccttttacgcatgcacacatttnatttaaatnnnatttaaatgcaatgccagactctaagtcttttggagaaacttaatggtgatacacgtttggaaggcatcacattattgccatctaaccctaagctggtaatgcaaactcactctataaaattagataagactttatagagtgagttgcattaccagcattagggttagatggcaataatgttaatgcttaaacgtgttcatcaccattgacagttctccagccgaaagacacctaaaataagtgcaggctcaaatcacaacgcgtgtataaagaacatggagaccggagtctccaacaatccaaatcagggcgacacgtagcgaggaggaccatcgcacgcacaaacagatgaacggactaacaaacaaaaagcgccagcacccaaaacagacaaaaaaaagccagaacatgacaaaaaaaactcccaaacacaacgagatgacatgacgaacagcgagggagacgaaaa

SEQ ID NO: 562373 - DNA, 688 bp, Homo sapiens
agcgggtagttcttaacggttctcagcccgttggtggcaaggcagctggactggaatcccagcaggctgacatgctgaggaggagtgtgcagcccagtgaggtgttggtgcagtggcagtgtgtgacctcgcctgcttccacagctgatgctggctacttgatcgcaggcaacctccttgccatgggaagtgagtctgggagtggtggacaggaggggcaggtccatggctgggcagtgatgtgatgtggcatgacgccgcgaagtgcacctcgcccttgtccaactcggacggagtgtggtccatcaaccccacttccctgacatgctaggctgtggttcccgtctcaacaacagtgcaacatgggatatcttaactgggccatcgctaccgtccgtccagcgcccagggaagcccggccatgacatatattgtgcgacagcttgctactgcggaaacatgggcctgagggtcccaggaggaggcttggtacccacgttgataggccagcatgcaccccagactagatatacatcctaaccagaggaagaagaaagacggcacggtggcaagggcgaacgtaattggggggaaggacacatccgggacgggcccagggacccagcgcaagagttgccaccaaaggttgccgaaaagcatagagccaagggtgttgggtggagaatga

SEQ ID NO: 562374 - DNA, 787 bp, Homo sapiens
  misc_feature (7)..(7): n is a, c, g, or t
  misc_feature (20)..(20): n is a, c, g, or t
  misc_feature (56)..(56): n is a, c, g, or t
  misc_feature (60)..(60): n is a, c, g, or t
  misc_feature (79)..(79): n is a, c, g, or t
  misc_feature (107)..(107): n is a, c, g, or t
  misc_feature (111)..(111): n is a, c, g, or t
  misc_feature (123)..(123): n is a, c, g, or t
  misc_feature (140)..(140): n is a, c, g, or t
  misc_feature (144)..(144): n is a, c, g, or t
  misc_feature (181)..(181): n is a, c, g, or t
  misc_feature (187)..(187): n is a, c, g, or t
  misc_feature (219)..(219): n is a, c, g, or t
  misc_feature (221)..(221): n is a, c, g, or t
  misc_feature (226)..(226): n is a, c, g, or t
  misc_feature (237)..(237): n is a, c, g, or t
  misc_feature (244)..(244): n is a, c, g, or t
  misc_feature (247)..(247): n is a, c, g, or t
  misc_feature (304)..(304): n is a, c, g, or t
  misc_feature (310)..(310): n is a, c, g, or t
  misc_feature (327)..(327): n is a, c, g, or t
  misc_feature (335)..(335): n is a, c, g, or t
  misc_feature (343)..(343): n is a, c, g, or t
  misc_feature (352)..(352): n is a, c, g, or t
  misc_feature (375)..(375): n is a, c, g, or t
  misc_feature (393)..(393): n is a, c, g, or t
  misc_feature (406)..(406): n is a, c, g, or t
  misc_feature (412)..(412): n is a, c, g, or t
  misc_feature (420)..(421): n is a, c, g, or t
  misc_feature (427)..(427): n is a, c, g, or t
  misc_feature (434)..(434): n is a, c, g, or t
  misc_feature (439)..(439): n is a, c, g, or t
  misc_feature (458)..(458): n is a, c, g, or t
  misc_feature (462)..(462): n is a, c, g, or t
  misc_feature (485)..(485): n is a, c, g, or t
  misc_feature (487)..(487): n is a, c, g, or t
  misc_feature (513)..(513): n is a, c, g, or t
  misc_feature (674)..(674): n is a, c, g, or t
  misc_feature (694)..(694): n is a, c, g, or t
  misc_feature (703)..(703): n is a, c, g, or t
  misc_feature (710)..(710): n is a, c, g, or t
  misc_feature (717)..(717): n is a, c, g, or t
  misc_feature (761)..(761): n is a, c, g, or t
tgggggncaaagcactttantgtagggggagtggggggggagaagactttaaattnttcncttaaataaaaaggggggnggggcatgggagggggaaccccatcccnccancctttcccctcntccatcggtccctcggntttncctcggtggcggctacacaggcatgggcatctcattntactcntccacaccctcccgctcatcaaacaccggctntncctcnttagcatccanacatttnatntctcggtcggtgaagatacgggtgagcaccaccatgcggagcggcactttgaggatnaggatnaaggggaaggccagggnggcagctntggacatnacggcccanagcagggccaggcagagcagctncagggccgttaacaggtncatacggagggtncggacnttttttanntaattnacatctnggttnttttttggcggcattaccnccanattcaccccctcataaaactttntncctttaagggaggttactcccatttncaggaaaattccaaaaatcacggccagggggatcttccggagcagatcccgataactatggagaggcccacaagcagggcaaccagcagccccgtcacccgctgctccttgacttcctgaatcttgggcttgtccccaggtgccacagccttgctcatganagtgagcgcgttggcgtgantgaaaaaanggacagnggcagcngccaaccagggcaggccaaagagggcacagatgccgcccattgncacgatgacagcaggtccaggtggaa

SEQ ID NO: 562375 - DNA, 929 bp, Homo sapiens
  misc_feature (929)..(929): n is a, c, g, or t
atccatcattcaatgtcatcctcgctgatgtattcaggagactgtttgcccagttggcaggagaggatgcggagatctctgcctttgagctgcagaccatcctgagaagggtctacggcggagataggatggtcgataagaaccaggagcaagaggatagtggagacacataactctggattgaagatgcgaagatacgcaagaaaatttatcgagaaatcggagtgaaaggtcatgggttacatgagattcctactgaaatgcggaaggatgagaagaagcaggaatcaagaatgcccagtgttaatccaaacaaagtcatagtgtgctcgagtatgcagatgagcagctcagtaatcgagtcaagataagtaatgtaacggtgttaggttcggtggaaaagtactattaaagatatttgagaggaggtggatcccggagaatatgtggaaccaataagatgatcgagcttatctcttggggtcggtaaatcagtacattatgaagtgtataactaatatgctgaagagtgctgtgagtgggaaagtcaggagggataagcttcaatagaaatacagatttgtatatggaccagcaaaatatgggaagatatagaaaaacggatgatatggtgaaattagtgatactggcacatttgagatagtgatgcttcgcatcaatctaaagctgggcttgatatattaatgaatgagtgctaacgtgacgggtcagagtgggtgcgcggtaccagtttctgttacgctacagtgcgggcctcagataacctggacaatgggtgatcaagagggaaaaagccgctcgacagctgcgcatacggcatacgctgtgtcaacaacgagcgggcgagtgttaaggttggacagtgtacaggacgagcaaggaactcgcgtgtgaatgattgaggaggn

SEQ ID NO: 562376 - DNA, 625 bp, Homo sapiens
ctccgagattgaaattgtgtagcaggacattcataaacataactagtgcgaatcacaagaatagactgacctgcttttatgactcattggcaaatggcagctgccttggagcaagtgtcaggatgggtgccaacagcaaggtgcttttctagagctgcttatttctaagcaatgcactcttccagtttttctccttttttacttttttgattgtctttctggtttaagacaaattttaaaatctgcttgttcccaggggggccccacctcatccaatgtatagtttccagcaagtggccaatatgatgatcaggatgaagagagagtttacaggaagccagaattcaatatttcctgtaattgataatctcttgttgcttgatcggaatgtggatttattaacacctcttgccactcagctgacatatggaggactcattgatgaaatttatggcattcagaacagtaagtacatgacatctgtttacactaataggtaatatgagaagaatatcctttgtggaggctactgtttgtatattgcacgcttaagcataattaaagtcagagatccgattctaatgattcagagtgtaaataaatacagaactttttgtaagcaatt

SEQ ID NO: 562377 - DNA, 153 bp, Homo sapiens
taatgagctgcccgtgttaatggtggtatcctcctcagcgatctccgagtatcgtaagcatcttttgctcgtcctccagtcccatgtctggctacggttctagattcaacacgagcagcaacagcggcacctaacccagttcaggatcaagaa

SEQ ID NO: 562378 - DNA, 869 bp, Homo sapiens
tacgtccctcggtccccgcggttttacaccctatgggctctccccgctcagtctgcccgtctttgggagacgcccgcatctcttgtccaccctatacgagtttccgtcctgtcccgcaatatcccggctttgccccttcccccggggcttttttcccacggggtttcccccccaaaaccgcgggtgtcggtaaaacacgcctcaaacccccatgggtaaagaaaccacctaattaaccacgcgtgtccgttggaaaaacccataattctgggccaactccccccacatgcgcgccccacttgaattataacaaaaccggggggtccgccaccaagaagccccctgcgaaacattggcaaacagcaggccctccttggaaaatggaaagggcccctcacaaaaaagacccgggtctctggagaataaaaccggacaactgatgcggagaacacagggataccccccgggataaacccccccccggcggggaaagttgagagccccccccggatctacagcggggcaactcatctgaaggccccccgagccccagaagcctttgtccacaccacagtgaagatcacgcgggacacatttctacagcaagcctcgttcctctccactagttttcgtgcgccttcgtttgtttgggaagagatcttctgacactggagtagactccaccatatgcggctcaaatccgccgagagcgcagtccccgccttttgcggttttaacaacacaggggcgttaaaacaaattagtgtgcggcgggttgacccacaaagggagagtcccctgggccccccctccacccccaaagaagaacaataggcaaaatttttaaggaaccccccctcccacaaaaa

SEQ ID NO: 562379 - DNA, 102 bp, Homo sapiens
ccaaaaatgccccatgtagaattttccctttgtactggcaggctcgttttccccccttttagaatatttaagaatctaaaaataaagggcccctctgcctta

SEQ ID NO: 562380 - DNA, 371 bp, Homo sapiens
  misc_feature (8)..(8): n is a, c, g, or t
  misc_feature (64)..(64): n is a, c, g, or t
  misc_feature (101)..(101): n is a, c, g, or t
  misc_feature (118)..(118): n is a, c, g, or t
  misc_feature (124)..(125): n is a, c, g, or t
  misc_feature (127)..(127): n is a, c, g, or t
  misc_feature (130)..(130): n is a, c, g, or t
  misc_feature (132)..(132): n is a, c, g, or t
  misc_feature (134)..(134): n is a, c, g, or t
  misc_feature (137)..(137): n is a, c, g, or t
  misc_feature (139)..(140): n is a, c, g, or t
  misc_feature (158)..(158): n is a, c, g, or t
  misc_feature (160)..(160): n is a, c, g, or t
  misc_feature (165)..(168): n is a, c, g, or t
  misc_feature (174)..(174): n is a, c, g, or t
  misc_feature (191)..(191): n is a, c, g, or t
  misc_feature (247)..(247): n is a, c, g, or t
  misc_feature (250)..(250): n is a, c, g, or t
  misc_feature (253)..(254): n is a, c, g, or t
  misc_feature (371)..(371): n is a, c, g, or t
ggcacagngcttccctgctgactcctgagaggaagacagagtcacaagctggcccagatgaggncccgggcagcaatgcttctgtgtgggtatggccagtngggacgtggcgccacanactgannanacnananatngnnacgggatgacccgcatancnggacnnnnaaaagnctcacaacatatgaagnatggggcccactggacactccataatactacttaaagccaccacggaaggcctgcntanggnngactagtctacattcccatcacgaacgttgatctgtcaccaaccgcctggcggcctcgtttccccacggaccaccgagacacggtcacacgagacaacggcacatacacacacctgn
